United States Patent 11,602,557 (BUNYAVIRALES VACCINE) - sequence listing, part 9

SEQ ID NO: 11025 - RNA, 4326 nt, Artificial Sequence
  derived and/or modified CDS sequence (opt3) from LACV(77)__DQ196119.1__GP
augaucugcauucuggugcucauaaccgucgccgcugcaagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuuuaguaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuugagucaaccacguauaucacucuagaccaaaccugcgaacaccucaaggucagcugugguccaaaaaguguucaguuccaugccugcuuuaaccagcacauguccugugugagauuccugcacaggacaauucuucccgggucuaucgcuaauagcauaugccagaacauugagaucauuauccugguaacuuugacccuccugaucuuuauucugcucuccauauuaucaaagacauacaucuguuaucugcuuaugccuauuuucaucccaauagccuacauuuauggaaccaucuacaauaaaaguugcaagaagugcaaauuguguggccugguguaccaucccuuuacggaaugcggcacucacuguaucugcggggcgcgguaugauacaagcgaccgcaugaagcuacauagagcaucuggacucuguccugguuacaaaucccugagggccgcucgggucaugugcaagucaaaaggcccagccagcauucuuaguaucauuaccgcagugcugguuuugacuuucgugacacccauaaacucuaugguccucggggaguccaaggagaccuuugaacuggaggauuuaccugacgacaugcuggaaauggcuagccgcaucaauucguauuaccucacguguauucuuaacuaugccgugucuuggggacugguaaucaucggcuugcuaauuggucuccuguucaaaaaguaccaacaccgauuucugaauguuuaugcgauguacugcgaggaaugugauauguaccacgacaaguccgggcuuaaaagacauggagauuucaccaacaagugcaggcaguguacaugcggccaguaugaggacgccgcaggccugauggcucaccggaaaacuuacaauugcuuggugcaguauaaggccaaauggaugaugaacuuccucauaaucuacauuuuucugaucuuaauuaaggauucagcuaucgucgugcaagccgcagggaccgacuucacaacuugucuggagaccgaaaguauaaacuggaauugcacaggaccauuucuaaaccucgguaauugucagaagcagcagaaaaaggagccguauaccaacaucgccacucaacugaaaggccuuaaggcuauuagcgucuuggaugugcccaucauuacggggaucccugacgauauagcgggagcacugcguuacauugaagagaaagaagacuuccauguucagcucacaaucgaguaugccaugcuguccaaguacugcgauuacuauacccaguuuucugacaauagcggcuacucacaaacuaccuggcgcguguaucuuagaagucacgacuucgaggcuuguauucuguacccaaaccagcauuuuuguaggugcguaaagaauggugaaaaaugcuccagcucuaaccgggauuucgccaaugagaugaaggacuauuacucagggaaacagacaaaguuugauaaagacuugaaccucgcacugaccgccuuacaccacgcuuuccgaggcacuucaagcgccuauaucgcaacaaugcuguccaagaagucuaaugaugaccuaauagcguacacgaacaaaaucaagaccaaauuucccggaaaugcucuccugaaggccauuaucgauuacauugcauauaugaaaucgcuuccuggcauggccaacuucaaguacgacgaauuuugggaugaguugcuguauaaaccaaaucccgcuaaggccagcaaccucgcacgcgggaaggaauccucauacaacuucaaacuggcuaucaguucuaagagcauaaaaacuuguaagaaugucaaagacguggccugcuuauccccgagaucaggagcgauuuaugccagcaucaucgcuuguggugagccuaacggccccucuguuuacaggaagccauccgggggaguguuccagaguagcacagaucaaucuauuuauugccugcuugacucccauugcuuggaggaauuugaggcaaucggccaggaggaacucgaugccgucaagaaaucaaaguguugggagauugaauacccugacgugaaacugauacaggagggugacgggaccaagaguugccggaugaaagauagcggcaauuguaacguagcuacaaaucgcuggcccgugauccagugcgaaaacgacaaguucuacuauucggagcuacaaaaggauuacgacaaaacucaggauauuggacacuauugucuguccccaggcugcaccacgguuagauaccccaucaauccuaagcauauuucuaacuguaauuggcaggucagcaggucaaguaucgccaaaauagacgugcacaacaucgaagauauugagcaguauaagaaagcaaucacccaaaagcuccagacaucccugucucuuuuuaaguacgcgaaaacuaagaauuugccacacauuaaaccgaucuauaaguacauaaccauugaggggacagaaacugccgagggaaucgaaagcgcuuacaucgaguccgaagugcccgcccuggcagguaccucaauuggcuucaaaauaaacagcaaggaggggaaacauuuacucgacgucaucgcuuauguuaagagugccucuuacuccagcguguauacgaagcuguacucgacaggaccuaccucaggcauuaauacuaaacacgaugagcuuugcacagguccaugucccgcaaacaucaaucaucaggugggguggcugaccuuugcccgugaacggacuucuaguuggggcugcgaggaguucggauguuuggcuguauccgacggcugcgucuuugggagcugccaagauauuaucaaggaagaacucucuguguaucgaaaagagaccgaggaaguuacagacguggagcugugucuaacguucagcgauaagaccuacugcacuaaccugaacccugucacaccaauaaucaccgaccucuuugaagugcaguucaaaacaguugaggcguauucccugcccagaauuguggccguacagaaucacgagaucaagauuggacagaucaacgaccuuggcgucuacucaaaggguugugggaaugugcaaaaagugaacggaacuauauacggcaauggugucccgagguuugauuauuugugccaucuggcaagucgcaaggaaguuauugugcggaaauguuucgacaacgauuaccaggcuugcaaguuuuuacagagcccugccucuuauagacucgaggaagacuccggcaccguaacgaucaucgauuacaaaaagauucuggggacaaucaagaugaaagccauacuuggagacgugaaguauaaaaccuucgcugauucagucgacauuacugcagagggcaguuguaccgggugcaucaauuguuucgaaaacauucacugcgagcugacacuacacacuaccaucgaggccagcuguccaauaaaguccucuugcacaguguuucaugauaggauucucguuacgcccaaugaacacaaauacgcgcugaagauggugugcaccgagaagccuggaaacacuuugacaaucaaagucuguaauaccaagaucgaggcuucgauggcccugguggacgcaaaacccauuaucgaauuagccccaguugaucagacugcuuauauucgcgaaaaggacgagcgaugcaaaacauggaugugucgggugcgugacgagggccuccaagucauacuggaaccuuucaagaaccuuuuugguagcuacaucgggauuuucuacaccuuuaucaucucaauuguagcacuguuggugauaaucuauguucuccugcccauuugcuucaagcuaagagauacgcugaggaaacaugaggacgccuacaagcgcgaaaugaaaauccgguga

SEQ ID NO: 11026 - RNA, 4326 nt, Artificial Sequence
  derived and/or modified CDS sequence (opt3) from LACV(LACV/00/NC-M (NC00-283))__GU206112.1__GP
augaucaggauucuggugcucauagccgucaccgcugcaagccccguuuaccagagaugcuuccaagacggcgccaucgugaagcagaacccuuccaaagaggcgguaacagaagugugucuuaaggaugacgucucuaugauuaaaacugaggcucgguaugugcgcaaugccacggggguuuucucaaacaauguggcaauccgaaaguggcuggucagugauuggcacgacugccguccgaaaaagauuaucggaggucauauaaacgugaucgaaguaggcgaugacuugagcuuacacaccgaguccuacguuuguucugccgauugcacaauugggguggacaaggaaacugcucaggucagacugcagaccgauacaaccaaucauuucgagaucgcaggaacuacagugaaaucgggcugguuuaagucaaccacguauauuacucuagaccaaaccugugagcaccucaaagugagcugcgguccaaagaguguccaguuccaugccuguuuuaaccagcacauguccugcguuagguuccugcaccggacaauccuucccgggucuauagcuaauagcauuugucagaacaucgaaauuaucauccuggugacuuugacccuccugauuuuuauacugcucuccaucuuaucaaaaacauacauuugcuaucugcuuaugccuaucuucauaccaauugccuacauguauggaaucaucuacaauaagaguuguaagaaaugcaaguugugcggccugguauaccaucccuuuaccgaguguggcacgcacugcguguguggggcgcgcuaugauacuagcgacagaaugaaacuacauagggcaucuggacucugcccugguuacaagucccugcgggccgcucgcgucauguguaaaucaaagggcccagccagcauucuuaguaucauuacagcagugcugguuuugaccuucgugacucccauaaacucuaugguccucggggaauccaaagagacauuugagcuggaagaguuaccugaugacaugcuggaaauggcuagccgaaucaauucguauuacuuuaccugcauucucaacuaugccgugucuuggggacuuguaaucaucggccuguugacgggucuacuguuuaagaaguaccaacacagauuccucaauguuuaugcgauguacugugaggaaugcgacauguaccacgauaaauccgggcugaagaggcauggagacuucaccaacaaaugucggcagugcacauguggccaguaugaggaugccgcaggccuuauggcucaccguaagacuuacaauugccuggugcaguauaaagccaaguggaugaugaacuuuuugauuauauacaucuuccucauucugaucaaggacucagcuauugucgugcaagccgcagggaccgauuuuacaacuugcuuagagaccgaaaguaucaacuggaauuguacaggaccauuccugaaccuagguaauugccagaaacagcaaaagaaagagccguauaccaacauagccacucagcucaagggccugaaagcuaucagcguccuugacauucccaucauuacggggaucccugaugacauagcgggagcauugaaguacauugaggaacgcgaagauuuucaugugcagcugacaaucgaguaugccaugcucuccaaguacugugacuacuauacccaguucucugauaauagcggcuacucacaaacuaccuggagaguuuaucugaggagucacgacuuugaggcuugcauucuuuacccaaaccagcauuucugucggugcgugaaaaauggugaaaaguguuccagcucuaacugggacuuugccaaugagaugaaagauuauuacucagggaagcagacaaaauucgacaaggaucugaacuuggcacucaccgcccugcaccacgcuuuucgaggcacaaguagcgccuauaucgcaacuauguuauccaagaaaucuaaugacgaucugauagcguacacgaacaagaucaaaaccaaguuccccggaaaugcucuacucaaagccauuaucgacuacauugcauauaugaagucgcugccuggcaugacuaacuuuaaauacgauaaguucugggacgaacuuuuguauaagccaaaucccgccaaagcuagcaaccuggcccgcgggaaggaguccucauacaacuucaaacucgcaaucaguucuaagagcauaaaaacaugcaagaauguaaaggaugucgcuugucuguccccgagaucaggagccauuuaugcgagcaucaucgccugcggugaaccuaacggccccucuguguacaggaaaccauccgggggaguuuuucagaguagcaccgaccggucuauuuauuguuuacuggauucccauugccuugaggaguucgaagcuaucaaucaagaggaauuggacgcagugaagaaaucaaagugcugggagauugaguacagugaugucaaaccucuccaggaaggcgacgguacaaagagcugucgcaugaaggacucggggaacugcaauguggccacuaacagauggcccguaauacagugugagaaugauaaauuuuacuauuccgaacugcagaaggacuacgauaaaacccaagacaucggccacuauugccuaucuccaggauguacgaccgugagguaccccauuaacccuaagcauaucagcaauugcaacuggcagguuucacguaguuccauugcuaaaaucgauguccacaauauagaggacaucgaacaguauaagaaggccauuacacagaaacugcaaacuucucucagccuguucaaguacgcaaaaaccaagaaccuuccacacaucaaaccgauuuauaaguacaucacaauagagggcacugagaccgcggaagggauugaguccgccuacaucgaaucagaggugcccgcuuuggccggaacgagcaucgguuuuaaaauuaauaguaaggaaggcaagcaucuguuagaugugauagcauaugucaaaucugcuuccuacagcucgguuuaugccaagcucuacucaacagggccuaccucuggaaucaacacuaaacacgacgagcuguguacaggcccaugccccgcaaauauuaaccaucagguggguuggcuuaccuucgccaaggagcggaccaguuccugggggugugaagaguuuggcugccuggcugugagcgauggauguguauucggcucuugccaggacaucauuaaagaagaguugagcgucuaucgaaaggaaacugaggaggugacagauguugaacucugccugacguuuuccgacaagaccuacuguacuaaccuaaauccugugacaccaaucauaaccgaucuguucgagguccaauuuaaaacaguggaaacuuauucacuccccagaaucguugcggugcagaaccacgagauuaagaucgggcagauuaaugaccugggaguauacaguaaaggcugcgguaacguccagaaggugaaugggaccguguacggaaacggcgucccgagguucgacuaucuuugucauuuggccagccgcaaagagguuaucgugcggaagugcuuugauaaugacuaccaagcauguaaguuccugcagucuccugcuuccuauagauuagaagaggauucagguacgguaacaauaauugacuacaaaaagauccucggcaccaucaaaaugaaggccauucugggggaugugaaauauaagacuuucgccgacaacgucgauaucaccgcugaaggaaguugcacaggcuguauaaauugcuuugagaacauucacugugaacuuacucugcacaccacaaucgaggcaagcugcccaauuaaguccucuuguacgguguuccaugacaggauccuaguuacccccucggagcacaaauacgcccucaagauggugugcacugaaaaaccugggaauacacugaccauaaaggucugcaacacuaaaauugaggcgagcauggcuuugguggaugccaagcccaucaucgaacuggcaccaguugaccagacagccuauauucgcgagaaggaugaacgauguaaaaccuggaugugccgggugcgugacgagggauuacaggucauccucgagccuuuuaagaaucuguucggcucauacauugguauauuuuacacguucaucauuuccaucauggcacuucugguaaucauuuauguguugcuccccauauguuuuaaacugagagacacucuaaggaagcaugaagaugcuuacaaacgcgagaugaagauccgguga

SEQ ID NO: 11027 - RNA, 4326 nt, Artificial Sequence
  derived and/or modified CDS sequence (opt3) from LACV(LACV/00/WV-M (WV00-3178))__GU206148.1__GP
augaucaggauucuggugcucauagccaucaccgcugcaagccccgucuaccagagaugcuuccaagacggcgccauuguuaagcagaacccuuccaaagaggcggugacagaaguaugucuuaaggaugacgugucuaugaucaaaacugaggcucgguauguccgcaaugccacggggguguuuucaaacaauguugcaauucgaaaguggcuggugagugauuggcacgacugccguccaaagaagaucauaggaggucauaucaacgucauugaagugggcgaugacuugagcuuacacaccgaguccuacguauguucuucggauugcacaaucgggguugacaaggaaacugcccaggugagacugcagaccgauacaaccaaucauuucgagauugcuggaacuacagucaaaucaggcugguuuaagagcaccacguauaucacucuagaccaaaccugugagcaccucaaagugaguugcgguccgaaguccgugcaguuccaugcauguuuuaaccagcacaugucuugcgucagguuccugcaccggacaauacuucccgggagcauugccaauuccaucugucagaacauugaaaucaucauucugguuacuuugacccuccugauauuuauccugcucucaauuuuaaguaaaacauacaucugcuaucugcuuaugccuauauucauuccaaucgcuuacaucuauggaauuaucuacaauaagagcuguaagaaaugcaaguugugcggccugguguaccaucccuuuaccgaguguggcacgcacugcguauguggggcccgcuaugauacuucugacagaaugaaacuacauagggcguccggacucugcccugguuacaagucacugcgggcagcccgcgugauguguaaaagcaagggcccagcuaguauucuuucuauaaucacagccguccugguguugaccuucguuacucccauuaacuccauggugcucggggaaagcaaagagacauuugagcuggaagaguuaccugaugacaugcuggaaauggcaucgcgaaucaauucuuauuaccugaccugcauccuuaacuaugcugucuccuggggacuggugauuauaggcuugcuaacgggucuccucuucaagaaguaccaacacagauuucugaauaccuaugccauguacugugaggaaugcgacauguaccacgauaaaucagggcuuaagaggcauggagacuucacaaacaaaugucggcagugcacuuguggccaguaugaggaugcggccggccugaugacccaccguaagacauacaauugcuugguacaguauaaagcaaaguggaugaugaacuuccucaucauuuacaucuuucugauuuuaaucaaggacagugcuauaaucguucaagccgcugggacugauuucaccacaugccuggagaccgaaagcauuaacuggaauuguacuggaccauuucuaaaccucgguaauugccagaaacagcaaaagaaagagccguauacgaacaucgccacacagcugaagggccuuaaagcaauuuccguguuggacauccccauaauuaccgggaucccugaugacauugccggagcucugcgcuacaucgaagagagagaagauuuccauguccagcucacuaccgaguaugcgaugcugucuagguacugugacuacuauacacaguuuagcgauaauucacgguacagucaaaccacuuggcgaguguaucuucgcucccacgacuucgaggcaugcauacuguacccaaaccagcauuuuuguagaugcgucaagaauggcgaaaaguguaguucuucaaacugggacuucgccaaugagaugaaagauuauuacagugguaagcagacaaaauuugacaaggauuugaaccucgcucugacggccuuacaccacgcauucagggggaccagcuccgccuauaucgcuacuaugcugucuaaaaagucgaaugacgaucuaauuacauacaccaacaagaucaaaacaaaguuucccggcaaugcccuccugaaagcaauuaucgacuacauagcguauaugaaaagccuuccuggaauggcuaacuucaaauacgaugaauuuugggacgaguugcuguauaagccaaaucccgccaaaacuuccaaccucgcacggggcaaggaaucaaccuacaacuucaagcuggccauuaguucuaaaagcaucaagacgugcaaaaaugugaaggauguugcuuguuuauccccgcgcucaggggccaucuaugcaagcauuaucgcuugcggagagccuaacggucccucuguguacagaaaaccauccggcgggguauuccagaguagcaccgacaggucuauuuauugucugcuugauucccauugcuuggaggaauuugaggccauaucacaagaggaacucgacgcggucaagaagaguaaaugcugggagacagaauacccugaggugaagccccugcaggaaagcgauggaacuaaaucgugucguaugaaggacuccggcaauugcaacguugccaccaaucgguggccagugauccagugugagaacgacaaauucuacuauucugaacuacagaaggauuacgacaagacacaagauauuggucacuauugccugagccccggguguacuaccguccgauacccuaucaauccaaaacauauuucaaacugcaauuggcaagugaguagauccucuaucgcuaagauagacguacacaacaucgaggauauugagcaguauaaaaaggcaaucacgcagaaacuccaaacaagccugucccuuuuuaaguacgccaagaccaaaaauuugccgcacauuaagcccaucuauaaauacauaacuauugaaggcacagagaccgcugaaggaaucgagucagccuacaucgaaagcgaggugccugcacuggcgggcacuagcauuggguucaagauaaacucuaaagagggaaagcauuuacucgacguuaucgccuaugucaaauccgcuagcuacucgucaguguaugccaagcuguacucuaccgguccaacaaguggcauuaauacgaagcacgaugaacuuuguaccgggcccugcccugcaaacaucaaucaucagauuggauggcugacuuuugcuaaagagaggacauccagcuggggcugugaagaguucgguugcuuggccgugucugacgggugugucuuuggcagcugccaggauaucauaaaggaggaacucuccguuuaucgcaaagagaccgaagaggugacagacguggaacugugccuaacuuucucagauaagaccuacuguacgaaccugaacccaguaacacccaucauuaccgaccucuuugagguccaauucaaaacuguggagaccuauagucugccgcggaucguugcagugcagaaucacgaaauuaagaucggacagauaaacgaucuuggcgucuacagcaaggggugcggaaaugugcagaaaguuaacggcacaguguacgguaaugggguaccuagauuugacuauuugugucaucuggccucuaggaaggaggucauugugcgcaaaugcuucgacaacgauuaccaggcuuguaaguuuuuacaguccccagcgucauaucgacucgaagaggacaguggaacugugaccaucaucgauuacaaaaagauucugggcacaaucaagaugaaagccauacuuggugacgucaaguauaaaacguucgcagaaagcguugauauuaccgcugagggcuccugcacuggguguaucaauugcuucgagaacauucacugugaacugacacuacacaccacuaucgaggccucuugccccauaaagucgagcuguacaguguuucaugaccggauucucguaaccccuaaugaacacaaauacgcccugaagauggugugcacggagcgucccggaaacacuuugaccaucaaggucugcaauacaaaaaucgaggcuucaaugacccugguggaugcaaagccaauuaucgaauuagccccuguugaccagacugcguauauuagagagaaagaugaaagguguaagacauggaugugccgcgugcgggacgagggccuccaggucauacuggaacccuucaaaaaccuuuuuggguccuacaucggaauuuucuacaccuuuaucaucaguauuguggcucuguugguuauaaucuaugugcuccugccaauuuguuucaagcuaagagauacacugaggaagcaugaggacgccuacaaacgagaaaugaagauccgcuga

SEQ ID NO: 11028 - RNA, 4326 nt, Artificial Sequence
  derived and/or modified CDS sequence (opt3) from LACV(LACV/03/NY-M (41030016))__GU206130.1__GP
augaucuacauucuggugcucauagccgucaccgcugcaagccccguuuaucagagaugcuuccaagacggcgccaucgugaagcagaacccuuccaaagaggcgguaacagaagugugucuuaaggaugacgucucuaugauuaaaacugaggcuagguacauccggaaugccacggggguguuuucaaacaauguugcaauucgcaaguggcuggugagugauuggcacgacugccgaccgaaaaagaucgucggaggucauauaaacgugaucgaaguaggcgaugacuugagcuuacacaccgaguccuauguuuguucugccgauugcacaauugggguggacaaggaaacugcucagguccgucugcagaccgauacaaccaaucauuucgagaucgcaggaacuacagugaaaucgggcugguuuaagucaaccacguacauuacucuagaccaaaccugugagcaccucaaagugagcugcgguccaaagaguauccaguuccaugccuguuuuaaccagcacauguccugcgucagauuccugcacaggacaauacuucccgggucuauugcuaauagcaucugucagaacauugaaaucaucauucugguuacuuugacccuccugauauuuauccugcucuccauuuuaucaaaaacauauaucugcuaccugcuuaugccuguguucauaccaauugccuauguauacggaaucaucuacaauaagaguuguaagaaaugcaaguugugcggccugguguaucaucccuuuaccgaguguggcacgcacugcgucuguggggcgcgguacgauacuagcgaccgcaugaaacuacauagagcaucuggacucugcccugguuauaagucccugagggccgcucgggugauguguaaaucaaagggcccagccagcauucuuaguaucauuacagcaguucugguguugaccuucgucacucccauaaacucuauggugcucggggaauccaaagagguauuugagcuggaagaguuaccugaugacaugcuggaaauggcucuccgcaucaauuucuacuauuuuacaugcauucuuaacuacgccguuagcuggucgcuggugaucaucggauugcuaaccggccuccuguucaagcgauaucaacacaaguuccugaauauuuacgcgauguacugugaggaaugcgacauguaucacgauaaaucuggucuuaagagacauggggacuuuacgaacaaauguaggcagugcaccuguggacaguacgaggaugccacaggccugaugacucaccggaagaccuauaauugcuugguccaguacaaagcaaaguggauaaugaacuuccucaucauuuauaucuuucugguguuaauuaaggacuccgcuaucauaguccaagccgcuggcacagauuucucaaguugccuggagacugaaagcaucaacuggaauuguaccgggccauuucuaaaccucggaaauugccagaaacagcaaaagaaagagccguacacaaacauugccgcacagcugaagggucuucgugccaucuccguguuggacauucccaugaucaccgaaauaccugaugacauugcuucugcgcugcgcuauaucgaggaaagagaggcauuccauguucagcucacugccgaguacgcuaugcugacgagguacugugauuauuacacacaguuuagcgacaauucaggcuauagucaaaccacuuggcggguguaccuucgaucccacgauuucgaagccugcauuauguauccaaaccagcauuuuugucgcugcgucaaaaauggggagaaguguucuagcucaaacugggacuucgcaaaugaaaugaaggacuacuauaguggaaaacaggccaaguuugauaaagaccugaacuuggcucucaccgcccugcaccacgcauucagaggcacaagcuccgcguacaucgcugccauguuaucuaagaaaucgaaugaugaccugauaaccuacacuaacaagaucaagacaaaauuucccgguaaugcacuacucaaggccauuaucgauuauauugcuuacaugaaagggcugccuggcauggccagcuucaagcaugacgaguucugggaugaacuuuuguauaaaccaacgcccaccaaggcaccgaaccuggcuaggggacgggaguccucauacaauuuuaaacucgccaucaguucuaagagcauaaagacuugcaaaaacguaaaggacguggcgugucuguccccucgcucaggcgccauuuaugcuagcaucaucgcaugcggggagcccaacggaccaucuguuuacagaaaaccuuccaaugguguguuccagaguagcacagaucaaucuauguauuguuuacuggacucccacugccuugaagaguuugaagccauuucacaggaggaguuggaugcugucaagaaaaguaagugcugggaaaucgaguaccccgacauuaagccacuccaggaaagcgauggcaccaaaucguguaggaugaaggacuccgggaacugcaauguggccacaaaccguuggcccguaauacagugugagaaugacaaauucuacuauucugaacugcaaaaggauuacgacaaaacucaggauaucggacauuauugccuaagcccuggcuguaccacggugcgguacccaauuaacccgaagcacaucucaaauugcaacuggcagguuagucgauccucuauugcaaagaucgacguccacaauauagaggauaucgagcaguauaaaaaggcgauuacccaaaaacugcagacaagccucucccuguuuaaguacgccaaaacuaagaaccuuccccauaucaagccuauuuauaaauacaucaccauagaagguacagagacugcugaagggauugagucagccuacaucgaaagcgaggugccagcauuggcuggcaccaguaucggauucaagauuaauucuaaagagggcaagcaccuguuagacgugauagccuaugucaaauccgcaagcuacucgucaguuuauacgaagcucuacucuacagggcccaccaguggaaucaacacuaaacaugaugaacuguguacagguccuugcccagccaauauuaaccaccaggugggcuggcuuaccuuugcuaaggagagaacuuccagcugggggugugaagaguucggaugccuggcggugucugacggcuguguauuugguagcugccaagauaucauuaaggaagaguuguccgucuauaggaaagagaccgaagaggugacagacguugaacucugccugacguucucagauaagaccuacuguacuaaucuaaaccccgugacaccgaucauaaccgaccuguuugagguccaguucaaaacaguggagacuuauagucucccucgcaucguugccgugcagaaccaugaaauuaagaucgggcagauuaaugaucugggcguauacagcaaaggaugcggcaacguccaaaaggugaaugggaccguguacggaaacggcgucccacgguuugacuaucuuugucacuuggcaucuagaaaggagguuaucgugaggaaaugcuucgacaaugauuaccaggcuuguaaguuccugcagucccccgccucauaucgcuuagaagaggacagugguacgguaacagugauagauuacaaaaagauucucgggaccaucaaaaugaaggccauccugggagacgucaaguauaaaacuuuugcugauaacguggacauuaccgcagaaggcagcugcacagguuguaucaauugcuucgagaacauacacugugagcuuacucugcauaccacaauugaagccuccugcccuaucaagucuucguguacgguuuuucacgaucggauucuagugacccccaaugagcauaaauacgcgcucaaggucgugugcacugaaaaaccaggcaacacacugaccaucaagguuugcaauacuaagauagaggcuagcauggccuugguggacgcaaaaccuauuaucgaacuggcccccgucgaucagacagcuuauauccgagagaaggacgagcguuguaaaaccuggaugugcagaguaagggaugaaggguuacaagugauucucgagccauucaagaaccuguuuggaucauacaucggcauuuucuacacguuuauaaucuccauuguugcacuucuggugaucaucuauauuuugcucccgauauguuucaaacugcgcgacacucuacggaagcacgaagacgccuacaagagagagaugaaaaucagguga

SEQ ID NO: 11029 - RNA, 4326 nt, Artificial Sequence
  derived and/or modified CDS sequence (opt3) from LACV(LACV/06/NY(1)-M (06MS2900303))__GU206118.1__GP
augaucuacauucuggugcucauagccgucaccgcugcaagccccguuuaucagagaugcuuccaagacggcgccaucgugaagcagaacccuuccaaagaggcgguaacagaagugugucuuaaggaugacgucucuaugauuaaaacugaggcuagguacauccggaaugccacggggguguuuucaaacaauguugcaauucgcaaguggcuggugagugauuggcacgacugccgaccgaaaaagaucgucggaggucauauaaacgugaucgaaguaggcgaugacuugagcuuacacaccgaguccuauguuuguucugccgauugcacaauugggguggacaaggaaacugcucagguccgucugcagaccgauacaaccaaucauuucgagaucgcaggaacuacagugaaaucgggcugguuuaagucaaccacguacauuacucuagaccaaaccugugagcaccucaaagugagcugcgguccaaagaguauccaguuccaugccuguuuuaaccagcacauguccugcgucagauuccugcacaggacaauacuucccgggucuauugcuaauagcaucugucagaacauugaaaucaucauucugguuacuuuggcccuccugauauuuauccugcucuccauuuuaucaaaaaccuauaucugcuaccugcuuaugccuguguucauaccaauugcguauguauacggagugaucuacaauaagaguuguaagaaaugcaaguugugcggccuggucuaucaucccuuuacagaguguggcacccacugcguguguggggcacgguacgauacgagcgaccgcaugaaacuacauagagccucuggacucugcccugguuauaagucccugagggcugcccggguuauguguaaaucaaagggcccagcaagcauccuuaguauuaucacugcugugcuggucuugacauucgugacccccauuaacucuaugguacucggggaauccaaagagguuuuugagcuggaagaguuaccugaugacaugcuggaaauggcccuccgcauaaauuucuacuauuuuacuugcauccuuaacuacgcggugagcuggucgcuggucauuaucggauugcuaacaggccuccuguucaagcgauaucaacacaaguuccugaauaucuacgccauguacugugaggaaugcgacauguaucacgauaaaucuggucuuaagagacauggggacuuuaccaacaaauguaggcagugcacguguggacaguacgaggaugcaaccggccugaugacacaccggaagacuuauaauugcuuggugcaguacaaagcuaaguggauuaugaacuuccucauaaucuauauuuuucuggucuuaaucaaggacuccgccauuaucgugcaagcugccggcaccgauuucucaaguugccuggagacagaaagcauaaacuggaauuguacugggccauuucuaaaccucggaaauugccagaaacagcaaaagaaagagccguacgcaaacaucgccgcucagcugaagggucuuaaagcgauuuccguuuuggacauccccaugauuaccgaaaucccugaugacauagcaucugcccugcguuauauugaggaacgcgaggcuuuccaugugcagcucacagccgaguacgcaaugcugaccagauacugugauuauuacacucaguuuagcgacaauucaggcuauagucaaacgacauggaggguauaccuucggucccacgauuucgaagccugcaucauguauccaaaccagcauuuuugucgaugcgucaagaauggggagaaguguucuagcucaaacugggacuucgcuaauggaaugaaagacuacuauaguggcaagcaggccaaauuugauaaggaccugaacuuggcacucaccgcgcugcaccacgcuuuccgcgguacuagcuccgccuacauugcaaccauguuaucuaaaaagucgaaugaugaccugaucgccuacacaaacaagauaaaaaccaaguuucccgggaaugcucuacucaaagccaucauugauuauaucgcauacaugaagggccugccuggaauggcuaacuucaaacaugacgaguucugggaugagcuuuuguauaagccaacucccacaaaagccccgaaucuggcgagaggcagggaaagcuccuacaacuuuaagcucgccauuucaaguaagucuaucaaaacgugcaagaacgugaaagacguugcuugucugagcccucgguccggggcaauauaugccucaauuaucgcuugcggagagcccaaugguccaagcguguaccgcaagccuuuaaacggcgucuuccagucuuccaccgaucaaaguauguauugucugcuugacagccacugcuuggaggaauuugaggccaucucucaggaagaacucgaugcagugaaaaaguccaagugcugggagauugaauacucagacaucaaaccccugcaggagagugaugggacuaagagcuguagaaugaaagacucgggaaauugcaacguagcgacaaauagguggccagugauucagugugaaaacgacaaguucuacuauuccgagcuacaaaaagauuacgacaagacccaggauauaggccauuauugccugucucccgguuguacaacuguucguuacccuaucaauccaaagcacauuagcaacugcaauuggcaggucucacggaguuccaucgccaaaauugacgugcacaacaucgaagauauagagcaguauaagaaagcuaucacccaaaagcuccagacgucucugagccuuuuuaaauacgccaagaccaagaauuugccgcauauuaaacccaucuauaaguacauuacaaucgaggggacugaaaccgcagagggcauagaauccgcuuacauugagucagaagugccugcccuggcaggaacaagcaucggcuucaaaaucaacaguaaggaggggaaacacuuacucgacgucauugccuauguuaagucugcuuccuacagcucgguguauacuaaacuguacucaaccggaccaacgucugguauaaauacaaagcaugaugagcuuuguaccggccccugcccugcgaacaucaaucaccaggugggguggcugacuuuugccaaggaacgaacaaguuccuggggaugugaggaguucggcugcuuggcaguaagcgacgguugugucuuugggucuugccaagauauuaucaaagaagaacucagcguguauagaaaggagaccgaggaaguuacugacguggagcugugccuaaccuucuccgauaaaacauacuguacgaaccugaacccagucacccccauuaucacugaccucuuugaagugcaguucaagacaguugagaccuauucacugccgaggauaguggcuguacagaaucaugagaucaaaauuggccagaucaacgaucuuggagucuacaguaagggcugcgggaaugugcaaaaggugaacggaacagucuacggcaaugguguuccucgcuuugacuauuugugucaccuggccagccggaaagaagugauuguaagaaagugcuucgacaacgauuaccaggccuguaaauucuuacagucuccagcuuccuauaggcucgaggaagacucagggacugugaccgucaucgauuacaagaaaauacugggaacgauuaagaugaaggcaauccuuggcgacgugaaauauaagacauuugccgauaauguugacaucaccgcggaggguaguugcacuggcuguauuaacugcuucgaaaauauccacugugagcugacccuacauacaacuauagaggcuagcugccccauuaaauccucuuguaccguguuucacgaucgcauccucgucacaccuaacgaacauaaguacgcccugaaagugguuugcacggagaagcccgggaauaccuugacuauuaaggugugcaacacaaaaaucgaagcaucgauggcccuggucgacgcuaagccaauaauugaguuagcaccuguagaucagaccgccuauauccgagaaaaagacgagcgguguaagacuuggaugugccgugugagagaugagggacuccaaguuauccuggaacccuucaaaaaucuuuuuggcagcuacauugggaucuucuacacauuuauuauaucaaucgugacccuguuggucauuaucuauauccuccugccaauuuguuucaaggugagggacacgcuacgcaagcacgaggacgcguacaaacgggaaaugaagauaagauga

SEQ ID NO: 11030 - RNA, 4326 nt, Artificial Sequence
  derived and/or modified CDS sequence (opt3) from LACV(LACV/06/NY(2)-M (06MS350140))__GU206109.1__GP
augaucuacauucuggugcucauagccgucaccgcugcaagccccguuuaucagagaugcuuccaagacggcgccaucgugaagcagaacccuuccaaagaggcgguaacagaagugugucuuaaggaugacgucucuaugauuaaaacugaggcuagguacauccggaaugccacggggguguuuucaaacaauguugcaauucgcaaguggcuggugagugauuggcacgacugccgaccgaaaaagaucgucggaggucauauaaacgugaucgaaguaggcgaugacuugagcuuacacaccgaguccuauguuuguucugccgauugcacaauugggguggacaaggaaacugcucagguccgucugcagaccgauacaaccaaucauuucgagaucgcaggaacuacagugaaaucgggcugguuuaagucaaccacguacauuacucuagaccaaaccugugagcaccucaaagugagcugcgguccaaagaguauccaguuccaugccuguuuuaaccagcacauguccugcgucagauuccugcacaggacaauacuucccgggucuauugcuaauagcaucugucagaacauugaaaucaucauucugguuacuuuggcccuccugauauuuauccugcucuccauuuuaucaaaaaccuauaucugcuaccugcuuaugccuguguucauaccaauugcguauguauacggagugaucuacaauaagaguuguaagaaaugcaaguugugcggccuggucuaucaucccuuuacagaguguggcacccacugcguguguggggcacgguacgauacgagcgaccgcaugaaacuacauagagccucuggacucugcccugguuauaagucccugagggcugcccggguuauguguaaaucaaagggcccagcaagcauccuuaguauuaucacugcugugcuggucuugacauucgugacccccauuaacucuaugguacucggggaauccaaagagguuuuugagcuggaagaguuaccugaugacaugcuggaaauggcccuccgcauaaauuucuacuauuuuacuugcauccuuaacuacgcggugagcuggucgcuggucauuaucggauugcuaacaggccuccuguucaagcgauaucaacacaaguuccugaauaucuacgccauguacugugaggaaugcgacauguaucacgauaaaucuggucuuaagagacauggggacuuuaccaacaaauguaggcagugcacguguggacaguacgaggaugcaaccggccugaugacacaccggaagacuuauaauugcuuggugcaguacaaagcuaaguggauuaugaacuuccucauaaucuauauuuuucuggucuuaaucaaggacuccgccauuaucgugcaagcugccggcaccgauuucucaaguugccuggagacagaaagcauaaacuggaauuguacugggccauuucuaaaccucggaaauugccagaaacagcaaaagaaagagccguacgcaaacaucgccgcucagcugaagggucuuaaagcgauuuccguuuuggacauccccaugauuaccgaaaucccugaugacauagcaucugcccugcguuauauugaggaacgcgaggcuuuccaugugcagcucacagccgaguacgcaaugcugaccagauacugugauuauuacacucaguuuagcgacaauucaggcuauagucaaacgacauggaggguauaccuucggucccacgauuucgaagccugcaucauguauccaaaccagcauuuuugucgaugcgucaagaauggggagaaguguucuagcucaaacugggacuucgcuaaugaaaugaaagacuacuauaguggaaagcaggccaaauuugauaaggaccugaacuuggcacucaccgcgcugcaccacgcuuuccgcggcacuagcuccgccuacauugcaaccauguuaucuaaaaagucgaaugaugaccugaucgccuacacaaacaagauaaaaaccaaguuucccgguaaugcucuacucaaagccaucauugauuauaucgcauacaugaaggggcugccuggcauggcuaacuucaaacaugacgaguucugggaugaacuuuuguauaagccaacucccacaaaagccccgaaucuggcgagaggaagggagagcuccuacaacuuuaagcucgccauuucaaguaagucuaucaaaacgugcaagaacgugaaagacguugcuugucugagcccucgguccggcgcaauauaugccucaauuaucgcuugcggggagcccaauggaccaagcguguaccgcaagccuuuaaacggugucuuccagucuuccaccgaucaaaguauguauugucugcuugacagccacugcuuggaagaguuugaagccaucucucaggaggagcucgaugcagugaaaaaguccaagugcugggaaauugaguaccccgacaucaaaccacugcaggaaucagauggcacuaagaguuguagaaugaaagacagcgggaauugcaacguagcgacaaauagguggcccgugauucagugugagaacgacaaguucuacuauucggaacuacaaaaagauuacgacaagacccaggauauaggacauuauugccuguccccuggcuguacaacuguucguuacccaaucaauccgaagcacauuucuaacugcaauuggcaggucagccggucaaguaucgccaaaauugacgugcacaacaucgaggauauagagcaguauaagaaagcuaucacccaaaagcuccagacgucccugucucuuuuuaaauacgccaagaccaagaauuugccccauauuaaaccuaucuauaaguacauuacaaucgaagguacugagaccgcagaagggauagagagcgcuuacauugaauccgaggugccagcccuggcaggcacaucaaucggauucaaaaucaacagcaaggagggcaaacacuuacucgacgucauugccuauguuaagagugcuucuuacuccagcguguauacuaaacuguacucgaccgggcccacgucaggaauaaauacaaagcaugaugaacuuuguaccgguccuugcccagcgaacaucaaucaccaggugggcuggcugacuuuugccaaggagcgaacaucuaguugggggugugaagaguucggaugcuuggcaguauccgacggcugugucuuugguagcugccaagauauuaucaaagaggaacucucuguguauagaaaggagaccgaagagguuacugacguggaacugugccuaaccuucagcgauaaaacauacuguacgaaccugaaccccgucaccccgauuaucacugaccucuuugaggugcaguucaagacaguugagaccuauucccugccuaggauaguggcuguacagaaucaugaaaucaaaauugggcagaucaacgaucuuggcgucuacucaaagggaugcggcaaugugcaaaaggugaacgggacagucuacggaaauggcguuccacgcuuugacuauuugugucaccuggccagucggaaagaggugauuguaagaaagugcuucgacaacgauuaccaggccuguaaauucuuacagagccccgcuucuuauaggcucgaagaggacuccgguacugugaccgucaucgauuacaagaaaauacuggggacgauuaagaugaaggcaauccuuggagacgugaaauauaagacauuugccgauaauguugacaucaccgcggaaggcucaugcacugguuguauuaacugcuucgagaauauccacugugagcugacccuacauacaacuauagaagcuaguugcccuauuaaaagcuccuguaccguguuucacgaucgcauccucgucacacccaacgagcauaaguacgcccugaaagugguuugcacggaaaagccaggcaauaccuugacuauuaaggugugcaacacaaaaaucgaggcaucuauggcccuggucgacgcuaagccuauaauugaauuagcacccguagaucagaccgccuauauccgagagaaagacgagcgguguaagacuuggaugugccgugugagagaugaagggcuccaaguuauccuggagccauucaaaaaucuuuuuggaucguacauuggcaucuucuacacauuuauuauaagcaucgugacccuguuggucauuaucuauauccuccugccgauuuguuucaagcuaagggacacgcugcgcaagcacgaagacgcguacaaacgggagaugaagauaagauga

SEQ ID NO: 11031 - RNA, 4326 nt, Artificial Sequence
  derived and/or modified CDS sequence (opt3) from LACV(LACV/06/NY(3)-M (06MS270036))__GU206121.1__GP
augaucuacauucuggugcucauagccgucaccgcugcaagccccguuuaucagagaugcuuccaagacggcgccaucgugaagcagaacccuuccaaagaggcgguaacagaagugugucuuaaggaugacgucucuaugauuaaaacugaggcuagguacauccggaaugccacggggguguuuucaaacaauguugcaauucgcaaguggcuggugagugauuggcacgacugccgaccgaaaaagaucgucggaggucauauaaacgugaucgaaguaggcgaugacuugagcuuacacaccgaguccuauguuuguucugccgauugcacaauugggguggacaaggaaacugcucagguccgucugcagaccgauacaaccaaucauuucgagaucgcaggaacuacagugaaaucgggcugguuuaagucaaccacguacauuacucuagaccaaaccugugagcaccucaaagugagcugcgguccaaagaguauccaguuccaugccuguuuuaaccagcacauguccugcgucagauuccugcacaggacaauacuucccgggucuauugcuaauagcaucugucagaacauugaaaucaucauucugguuacuuuggcccuccugauauuuauccugcucuccauuuuaucaaaaaccuauaucugcuaccugcuuaugccuguguucauaccaauugcguauguauacggagugaucuacaauaagaguuguaagaaaugcaaguugugcggccuggucuaucaucccuuuacagaguguggcacccacugcguguguggggcacgguacgauacgagcgaccgcaugaaacuacauagagccucuggacucugcccugguuauaagucccugagggcugcccggguuauguguaaaucaaagggcccagcaagcauccuuaguauuaucacugcugugcuggucuugacauucgugacccccauuaacucuaugguacucggggaauccaaagagguuuuugagcuggaagaguuaccugaugacaugcuggaaauggcccuccgcauaaauuucuacuauuuuacuugcauccuuaacuacgcggugagcuggucgcuggucauuaucggauugcuaacaggccuccuguucaagcgauaucaacacaaguuccugaauaucuacgccauguacugugaggaaugcgacauguaucacgauaaaucuggucuuaagagacauggggacuuuaccaacaaauguaggcagugcacguguggacaguacgaggaugcaaccggccugaugacacaccggaagacuuauaauugcuuggugcaguacaaagcuaaguggauuaugaacuuccucauaaucuauauuuuucuggucuuaaucaaggacuccgccauuaucgugcaagcugccggcaccgauuucucaaguugccuggagacagaaagcauaaacuggaauuguacugggccauuucuaaaccucggaaauugccagaaacagcaaaagaaagagccguacgcaaacaucgccgcucagcugaagggucuuaaagcgauuuccguuuuggacauccccaugauuaccgaaaucccugaugacauagcaucugcccugcguuauauugaggaacgcgaggcuuuccaugugcagcucacagccgaguacgcaaugcugaccagauacugugauuauuacacucaguuuagcgacaauucaggcuauagucaaacgacauggaggguauaccuucggucccacgauuucgaagccugcaucauguauccaaaccagcauuuuugucgaugcgucaagaauggggagaaguguucuagcucaaacugggacuucgcuaauggaaugaaagacuacuauaguggcaagcaggccaaauuugauaaggaccugaacuuggcacucaccgcgcugcaccacgcuuuccgcgguacuagcuccgccuacauugcaaccauguuaucuaaaaagucgaaugaugaccugaucgccuacacaaacaagauaaaaaccaaguuucccgggaaugcucuacucaaagccaucauugauuauaucgcauacaugaagggccugccuggaauggcuaacuucaaacaugacgaguucugggaugagcuuuuguauaagccaacucccacaaaagccccgaaucuggcgagaggcagggaaagcuccuacaacuuuaagcucgccauuucaaguaagucuaucaaaacgugcaagaacgugaaagacguugcuugucugagcccucgguccggggcaauauaugccucaauuaucgcuugcggagagcccaaugguccaagcguguaccgcaagccuuuaaacggcgucuuccagucuuccaccgaucaaaguauguauugucugcuugacagccacugcuuggaggaauuugaggccaucucucaggaagaacucgaugcagugaaaaaguccaagugcugggagauugaauacucagacaucaaaccccugcaggagagugaugggacuaagagcuguagaaugaaagacucgggaaauugcaacguagcgacaaauagguggccagugauucagugugaaaacgacaaguucuacuauuccgagcuacaaaaagauuacgacaagacccaggauauaggccauuauugccugucucccgguuguacaacuguucguuacccuaucaauccaaagcacauuagcaacugcaauuggcaggucucacggaguuccaucgccaaaauugacgugcacaacaucgaagauauagagcaguauaagaaagcuaucacccaaaagcuccagacgucucugagccuuuuuaaauacgccaagaccaagaauuugccgcauauuaaacccaucuauaaguacauuacaaucgaggggacugaaaccgcagagggcauagaauccgcuuacauugagucagaagugccugcccuggcaggaacaagcaucggcuucaaaaucaacaguaaggaggggaaacacuuacucgacgucauugccuauguuaagucugcuuccuacagcucgguguauacuaaacuguacucaaccggaccaacgucugguauaaauacaaagcaugaugagcuuuguaccggccccugcccugcgaacaucaaucaccaggugggguggcugacuuuugccaaggaacgaacaaguuccuggggaugugaggaguucggcugcuuggcaguaagcgacgguugugucuuugggucuugccaagauauuaucaaagaagaacucagcguguauagaaaggagaccgaggaaguuacugacguggagcugugccuaaccuucuccgauaaaacauacuguacgaaccugaacccagucacccccauuaucacugaccucuuugaagugcaguucaagacaguugagaccuauucacugccgaggauaguggcuguacagaaucaugagaucaaaauuggccagaucaacgaucuuggagucuacaguaagggcugcgggaaugugcaaaaggugaacggaacagucuacggcaaugguguuccucgcuuugacuauuugugucaccuggccagccggaaagaagugauuguaagaaagugcuucgacaacgauuaccaggccuguaaauucuuacagucuccagcuuccuauaggcucgaggaagacucagggacugugaccgucaucgauuacaagaaaauacugggaacgauuaagaugaaggcaauccuuggcgacgugaaauauaagacauuugccgauaauguugacaucaccgcggaggguaguugcacuggcuguauuaacugcuucgaaaauauccacugugagcugacccuacauacaacuauagaggcuagcugccccauuaaauccucuuguaccguguuucacgaucgcauccucgucacaccuaacgaacauaaguacgcccugaaagugguuugcacggagaagcccgggaauaccuugacuauuaaggugugcaacacaaaaaucgaagcaucgauggcccuggucgacgcuaagccaauaauugaguuagcaccuguagaucagaccgccuauauccgagaaaaagacgagcgguguaagacuuggaugugccgugugagagaugagggacuccaaguuauccuggaacccuucaaaaaucuuuuuggcagcuacauugggaucuucuacacauuuauuauaucaaucgugacccuguuggucauuaucuauauccuccugccaauuuguuucaagcuaagggacacgcugcgcaagcacgaggacgcguacaaacgggaaaugaagauaagauga

SEQ ID NO: 11032 - RNA, 4326 nt, Artificial Sequence
  derived and/or modified CDS sequence (opt3) from LACV(LACV/65/OH-M (W17258))__GU206124.1__GP
augaucaggauucuggugcucauagccgucaccgcugcaaaccccguuuaccagagaugcuuccaagacggcgccaucgugaagcagaauccuagcaaagaggcgguaacagaagugugucuuaaggaugacgucuccaugauuaaaacugaggcucgguauauccgcaacgccacggggguguuuucuaauaacguugcaauucgaaaguggcuggugucagauuggcacgacugccguccgaaaaagaucauaggaggucauaucaaugucauugaagugggcgaugacuugaguuuacacaccgagagcuacguauguuccgccgauugcacaaucgggguugacaaggaaacugcucaggugagacugcagaccgauacaaccaaccauuucgagauugcaggaacuacagucaaaucuggcugguuuaagucgaccacguauaucacucuagaccaaaccugugagcaccucaaagugucaugcgguccaaagagcgugcaguuccaugccuguuuuaaucagcacaugaguugcgucagguuccugcaccggacaguucuucccggguccauagcuaacucuauuugucagaauaucgaaauuaucauccuggugacuuugacccuccugauuuuuauacugcucagcaucuuauccaaaacauacauuugcuaucugcuuaugccuaucuucauaccaauugccuacguauauggaaucaucuacaacaagucauguaagaaaugcaaguugugcggccugguguaccaucccuuuaccgaguguggcacgcacugcgucuguggggcgcgcuaugauacaagugacagaaugaaacuacauagggcaagcggacucugcccugguuacaagucucugcgggccgcucgcgugauguguaaauccaagggcccagccucaauucuuagcaucauuacugcaguucugguguugaccuucgucacucccauaaauaguauggugcucggggaaucuaaagagacauuugagcuggaagaguuaccugaugacaugcuggaaauggcuucccgaaucgacagcuauuacuuuaccugcauucucaacuaugccguaucguggggacuuguuaucaucggccuguugacgggucuacuguucaagaaguaccaacacagauuccucaauguguaugcgauguacugugaggaaugcgauauguaccacgacaaaucugggcugaagaggcauggagauuucaccaacaaaugucggcagugcacauguggccaguaugaggacgccacuggccuuauggcacaccguaagaccuacaauugccugguccaguauaaagcuaaguggaugaugaacuuuuugauuauauacaucuuccucauucugaucaaggauuccgccauugugguccaagcugccgggacagacuuuacuaccugcuuagagacagaaaacaucaauuggaacuguaccggaccauuccugaaucuagguaacugccagaaacagcaaaagaaagagccguauacuaauauagcaacgcagcucaagggccugaaagccaucucagugcuugauauucccaucauuacagggaucccugacgauauagcuggagcguugcgcuacauugaagagaaggaagacuuucauguucagcugaccaucgaguaugcaaugcucaguaaguacugugauuacuauacucaguucagcgacaacuccggcuacucucaaaccacauggagaguguaucugaggagccacgacuuugaggccugcauucuuuacccaaaucagcauuucugucggugcgucaaaaacggugaaaaguguucaaguuccaauugggauuuugcuaacgagaugaaagacuucuauagcgggaagcagaccaaauuugauaaggaccugaauuuggcccucacugcacugcaccacgccuuccgaggcacaucuucagcuuacaucgccacgauguuaaguaagaaaagcaacgaugaccugauagcauauaccaauaagaucaaaacuaaguuucccggaaacgcgcuacucaaagcuauuaucgauuacauugccuacaugaagucccugccuggcauggcaaauuucaaauaugacgaguucugggaugaacuuuuguacaagccaaaccccgccaaggcuucuaaccuggcccgcgggaaagaaucgagcuauaauuuuaagcucgcaaucuccucaaaaaguauaaagacaugcaaaaacguaaaggacguggcuugucugucuccgagaagcggagccauuuacgcguccaucaucgccugcggugagccuaauggccccucaguuuauaggaagccaagcgggggaguguuccagucuuccaccgaucggaguauuuacuguuuacuggacagccauugccuugaggaauuugaggcuaucucucaagaagaguuggaugcagucaaaaaguccaaaugcugggagauugaauauccugacgugaagccccuccaggagggcgacgguacaaaaucaugucgcaugaaggauagugggaacugcaauguagccacuaacagauggccagugauacagugugaaaaugacaaguucuacuacagcgagcugcagaaagauuaugacaagacccaagauaucggccacuacugccuaucgcccggauguacgaccguuagguauccuauuaacccaaaacauaucuccaauugcaacuggcaggucucucguagcucaauugcuaagaucgacgugcacaauauagaagauaucgagcaguacaaaaaggccauuacacagaagcugcaaaccagucucucccuguuuaaauaugcaaagacuaaaaaccuuccgcacaucaagcccauuuacaaauauaucacaauagagggcacugaaaccgcggaggggauugaaucugccuacaucgagagcgaagugccugcuuuggccggaacguccaucgguuucaagauuaauucaaaagagggcaagcaucuguuagacgucauagcauacguuaagagcgcuaguuauucuuccguguacgccaaacucuauagcacagggccaaccucgggaaucaacacuaagcacgaugagcuguguacaggccccugcccugcaaauauuaaccaucagguggguuggcuuaccuuugcccgggaacgaacuucaucuugggggugugaggaguucggcugccuggcuguaagugacggaugugucuuuggcuccugccaggauaucauuaaagaagaauugagcguguacagaaaggagaccgaggaaguuacagacguggagcucugccugacguucucugauaaaaccuauuguacuaaccuaaauccagucacacccaucauaaccgaccuguuugaagugcaauucaagacaguugagacuuacagccucccgaggaucguggcgguacagaaccacgagauuaagaucgggcagauuaaugaccugggagucuauuccaaaggcugcgguaacgugcagaaggugaaugggaccgucuacggaaacggcguuccucgcuuugauuaccuuugucauuuggccucacggaaagaagugaucguaagaaagugcuucgacaaugauuaucaagcauguaaauuccugcagaguccagcuagcuacagguuagaggaagacucugguacggugacaauaauugauuauaagaagauccucggcaccaucaaaaugaaggccauucugggggacgucaaauacaagacuuuugccgauuccguggacaucaccgcugagggaucaugcacaggcuguauaaacugcuucgaaaauauucacugugagcuuacucugcacaccacaaucgaggcaaguugccccauuaaaagcuccuguacgguuuuucaugaucgcauccuagugaccccuaacgaacacaaguaugcccucaagauggucugcacugagaaacccgggaauacacugaccauaaaggugugcaacacuaaaauugaagcgucuauggcuuugguugacgccaagccaaucaucgagcuggcaccuguggaucagacagccuacauucgagaaaaagacgagcgguguaagaccuggaugugccgugucagagacgagggauuacagguaauccucgaacccuucaagaaucuguuuggcucguauauugguauauucuacacguuuaucauuagcaucguggcacuucugguuaucauuuacguguugcucccaauauguuucaaacugagggauacucuacgcaagcaugaggacgcuuauaaacgggaaaugaagaucagauga

SEQ ID NO: 11033 - RNA, 4326 nt, Artificial Sequence
  derived and/or modified CDS sequence (opt3) from LACV(LACV/67/NY-M (67-8109))__GU206115.1__GP
augaucugcauucuggugcucauaaccgucgccgcugcaagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuuuaguaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaccaucuacaauaagaguugcaagaaaugcaaguuguguggccugguguaccaucccuuuacggagugcggcacucacugugucugcggggcgcgguaugauacaagcgaccgcaugaaacuacauagagcaucuggacucuguccugguuacaagucccugagggccgcucgggugaugugcaaaucaaagggcccagccagcauccuuaguauuaucaccgcaguucugguguugacuuucgucacacccauuaacucuauggugcucggggaauccaaagagaccuuugagcuggaagauuuaccugacgacaugcuggagauggcuagccgcauaaauucguauuaccucacguguauccuuaacuaugccguaucuuggggacugguuauuaucggcuugcuaaucggucuccuguucaagaaguaccaacaccgauuucugaauguguaugcgauguacugcgaagagugugauauguaccacgacaaauccgggcuuaagagacauggagauuucaccaacaaaugcaggcaguguacaugcggccaguaugaagacgccgcaggccugauggcucaccggaagacuuacaauugcuugguccaguauaaagccaaguggaugaugaacuuccucauuauauacaucuuucugauuuuaaucaaggauucagcuauugugguccaagccgcagggaccgacuucacaacuugucuggagaccgagaguaucaacuggaauugcacaggaccauuucuaaaccucgguaauugucagaaacagcaaaagaaagaaccguauaccaacauagccacucagcugaagggccuuaaagcuaucagcguguuggauguucccauuaucacggggauuccugacgauaucgcgggagcacugcguuacauagaggaaaaggaggacuuccaugugcagcucacaauugaauaugccaugcuguccaaguacugcgauuacuauacccaguuuucugacaauagcggcuacucacaaacuaccuggcgcguauaucuuagaagucacgacuucgaggcuuguauccuguacccaaaccagcauuuuuguaggugcgucaaaaauggugagaagugcuccagcucuaaccgggauuucgccaaugaaaugaaagacuauuacucagggaagcagacaaaauuugauaaggacuugaaccucgcacugaccgccuuacaccacgcuuuccgaggcacuucaagcgccuauauugcaacaaugcuguccaagaaaucuaaugaugaccuaaucgcguacacgaacaagauaaaaaccaaguuucccggaaaugcucuccugaaagccaucauugauuacaucgcauauaugaagucgcuuccuggcauggccaacuucaaauacgacgaguuuugggaugaauugcuguauaagccaaaucccgcuaaggccagcaaccucgcacgcgggaaagaguccucauacaacuucaagcuggcuauuaguucuaaaagcaucaagacuuguaaaaaugugaaggacguugccugcuuauccccgagaucaggagcgauauaugccagcauuaucgcuuguggugaaccuaacggccccucuguguacaggaagccauccgggggagucuuccagaguagcacagaucaaucuaucuauugccugcuugacucccauugcuuggaggaguuugaagcaauuggccaggaggaacucgaugccgugaaaaagucaaaauguugggagaucgaguacccugacguaaagcugauucaggaaggugacgggaccaaaaguugccggaugaaggauagcggcaauuguaacguggcuacaaaucgcuggcccguuauacagugcgagaacgacaaguucuacuauucggaacuacaaaaagauuacgacaagacucaggauaucggacacuauugucuguccccaggcugcaccacggucagauaccccauuaauccuaaacauaucucuaacuguaauuggcaagugagcaggucaaguauugccaagaucgacgugcacaacauagaggauaucgaacaguauaaaaaggcaauuacccagaagcuccagacaucccugucucuuuuuaaauacgcgaagacuaaaaauuugccacacaucaagccgauuuauaaauacaucaccauagaggggacagagacugccgaaggaauugagagcgcuuacaucgaauccgagguccccgcccuggcagguaccucaaucggcuucaagauuaacagcaaagaagggaagcauuuacucgacguuauagcuuaugugaagagugccucuuacuccagcguguauacgaaacuguacucgacaggaccuaccucaggcaucaauacuaagcacgaugagcuuugcacagguccaugucccgcaaacauuaaucaucagguaggguggcugaccuuugcccgugagcggacuucuaguuggggcugcgaagaguucggauguuuggcugucuccgacggcugcguguuugggagcugccaagauaucauuaaagaggaacucucuguuuaucgaaaggaaaccgaggaggugacagacgucgaacugugucuaacguucagcgauaaaaccuacugcacuaaccugaacccugugacaccaaucauaaccgaccucuuugagguucaguucaagacaguggaaacuuauucccugcccagaaucguagcgguccagaaucacgagauuaagaucggacagauuaacgaccuuggcguguacucaaaagguugugggaaugugcaaaaggucaacggaaccaucuacggcaaugguguuccgagguuugauuauuugugccaucuggccagucgcaaagaggugauaguacggaaguguuucgacaacgauuaccaggcaugcaaauuuuuacagagcccugcuucuuauagacucgaagaggacuccggcacggugacaauuaucgauuacaagaagauccuggggaccauuaaaaugaaggccauccuuggagacgucaaauauaagacuuucgccgauucaguggacauaaccgcugaaggcaguuguacagggugcauuaauuguuucgagaacauccacugcgaacugacucuacacaccacaauugaggcaagcuguccaaucaaauccucuugcacgguuuuucaugauaggauacucgugacccccaaugagcacaaguacgcccugaagauggucugcacugaaaaaccuggaaacacauugaccauuaagguguguaauacuaaaaucgaggcgucgauggcucugguugacgccaagcccaucauugaauuagcaccaguggaucagacagccuauauccgcgagaaagacgaacgaugcaagaccuggaugugucggguccgugacgagggccuccaaguaauucuggagccuuucaagaaccuuuuugguagcuacauagggaucuucuacacguuuauuaucucaaucguggcucuguugguuauuauauaugugcuccugcccaucugcuucaaacuaagagauacucugaggaagcaugaagacgcauacaaacgcgagaugaagauucgguga

SEQ ID NO: 11034 - RNA, 4326 nt, Artificial Sequence
  derived and/or modified CDS sequence (opt3) from LACV(LACV/74/NY-M (74-32813))__GU206142.1__GP
augaucagaaugcuggugcucauugucguuaccgccgcuagccccguguaccagaggugcuuccaagacggcgcaauaguaaagcagaacccuuccaaagaggccgugacagaagucugucuuaaggaugacgugucuaugaucaaaacugaggcgcgguauguuaagaaugcuacggggguguuuucaaacaaugucgccauucgcaaauggcuggugagugauuggcacgacugccgaccaaagaagaucguaggaggucauauuaacguuaucgaagugggcgaugacuugagcuuacacaccgaguccuacgucuguucugcagauugcacaauagggguggacaaagaaacugcccaggugcgucugcagaccgauacaaccaaucauuucgagaucgcuggaacuacagucaagucgggcugguuuaaaucaaccacguauauuacucuagaccaaaccugugagcaccucaagguuagcugcgguccgaaaagugugcaguuccaugcauguuuuaaccagcacauguccugcguaagauuccugcacaggacaauccuucccgggucuauugccaauagcaucugucagaacauagaaauuaucauucuggugacuuugacccuccugaucuuuauccugcucuccauuuuaucaaagacauacauaugcuaucugcuuaugccuaucuucauuccaaucgcuuacauguauggagucauauacaauaagaguuguaaaaagugcaaauugugcggccugguguaccaucccuuuaccgaguguggcacgcacugcguuuguggggcccgguaugauacuagcgaccgcaugaagcuacauagagcgucuggacucugcccugguuacaaaucccugagggcagcccgggugauguguaagucaaaaggcccagcuagcauucuuaguaucaucacagccguccugguguugaccuucguaacucccauuaacucuaugguucucggggaauccaaggagacauuugagcuggaagaguuaccugaugacaugcuggaaauggcacuccgcaucaauagcuauuacuuuaccugcauucuuaacuaugcugugucguggggacugauaaucgccggcuugcuagucggucugauuuuuaagaaauaccaacaccgauuccucaauaucuaugcgauguacugugaggaaugcaacauguaccacgacaagucugggcugaaaagacauggagauuucacgaauaaguguaggcagugcaccuguggccaguaugaggacgccacaggccuuaucacucaccggaaaaccuacaacugccuggugcaguauaaggcaaaguggaugaugaacuuuuugauuauauacaucuuccucauucugaucaaagauuccgcuauugucgugcaagccacagggacugacuuuaccacaugcuuagagaccgaaucaaucaauuggaacuguacuggaccauuccugaaucuagguaacugccagaagcagcagaaaaaggagccguauacgaauauagcuacacaacucaaaggccugaaggccaucaguguucuugauauucccaucauuaccagcaucccugacgauauagcaggggccuugcguuacauugaagagaaggaagacuuucaugugcagcugacuaccgaguaugcuaugcucuccaaauacugugauuacuauacacaguucucugacaacagcggauacucacaaaccacuuggcgcguauaucugagaagucacgauuuugaggcgugcauccuuuacccaaaucagcauuucuguaagugcgucaaaaacggcgaaaaguguuccagcucuaauugggacuuugcaaacgagaugaaaaauuauuacucagguaagcaggccaaguucgacaaagaucugaacuuggcucucacagcccugcaccacgcauuuagggggacgaguagcgccuauauugcugccauguuauccaagaaaucuaaugacgaucugaucgcauacaccaacaagauaaaagcgaaguuccccggcaaugcucuacucaaagccaucauugacuacaucgcauauaugaagggacugccugaaauggccaacuuuaaguacgaugaguucugggacgaacuuuuguauaaaccaaaccccgcuaaggccucgaaucuggcacggggcaaagagagcuccuacaacuucaagcucgcuauuucaaguaaaucuaucaagacuugcaagaaugugaaagauguugccugucugagcccgcgauccggggcgauauauucaagcauuaucgccugcggagagccuaacggucccucuguguaccgcaagccauccggcggggucuuucagaguagcacagacagaucuaucuauuguuuacuggauucccauugccuugaagaguucgaagcuauuucacaagaggaguuggacgcagugaaaaagaguaaaugcugggaaaucgaguacccugauguaaggccccuccaggaaagcgacggagccaagucgugucggaugaaggauuccggcaauugcaacguggcuaccaaucgcuggccaguuaugcagugugagaacgacaaauuuuacuauucugaacugcagaaggacuacgauaaaacacaagacauuggucacuauugccuaagccccggguguacuaccauaagauacccuaucaauccaaagcauauuucaaacugcaauuggcaggucaguagguccucuaucgccaaaauugaugugcacaacguggaggacaucgagcaguauaagaaggcaauaacgcagaaacugcaaaccagccucucccuguucaaguacgcgaaaacaaagaaucuuccgcacaucaaacccauuuauaaguacaucacuauugaaggcaccgagacagccgaaggaaucgagucagcuuacauagaaagcgaggucccugccuuggcaggcaccaguguuggguuuaaaauuaacucuaaggagggaaagcaucuguuagaugugaucgcuuaugugaaauccgccagcuacucgucaguauaugcaaagcucuacucuacugguccaacgaguggcaucaauacaaaacacgacgaacuguguaccgggcccugcccugccaacauuaaccaucaggucggauggcuuacuuucgcucgugagcggacauccagcuggggcugugaagaguuugguugccuggcggugucugauggguguguuuucggcagcugccaggacauaaucaaggaagaguuguccguguaucgaaaagagaccgaagaggucacuaauguggaacucugccugaccuuuucagauaagacauacuguacgaaccuaaauccaguuacccccauuaucacugaccuguucgaggugcaauuuaagacaguagagaccuauagucucccgagaauugucgccgugcagaaccacgaaaucaaaauaggacagaucaaugaucugggcguguacagcaaggggugcggaaacguccagaaaguuaauggcacaguguacgguaacgggguaccuagguucgacuaucuuugucauuuggcaucucgcaaggaggugauuguccggaaaugcuuugauaaugacuaccaggcuuguaaguuccugcaauccccagccucauauagauuagaagaggacaguggaacugugaccaucauugauuacaagaaaauccucggcacgauaaagaugaaagccauucugggugacguuaaguauaaaacauucgcugauagcguggacaucaccgcagaaggcuccugcgccggguguaucaacugcuuugagaauauucacugugagcuuacucugcacaccacaaucgaagcgucuugccccauaaagucgagcuguacugucuuccaugauaggauucuagugaccccuaacgagcacaaguacgcucucaaaaugguuugcacagaaaagcccggaaauacgcugaccaucaaagugugcaacacucgcauugaggccucaauggcauuggucgacgccaagccaaucauagaacuggcuccuguagaucagacagcauauauucgagagaaagacgagcgguguaagaccuggaugugccgugugagagaugaaggcuuacagguuauccucgagcccuuuaagaaucuguucggguccuacaucggaauuuucuacacuuucaucauuaguauaaucgcccuucuggugauuaucuaugucuugcucccaaucuguuuuaaacugagggacacacuacgcaagcaugaugacgcguacaaacgggaaaugaagauuagauga

SEQ ID NO: 11035 - RNA, 4326 nt, Artificial Sequence
  derived and/or modified CDS sequence (opt3) from LACV(LACV/93/MO-H)__GU206139.1__GP
augaucugcauucuggugcucauaaccgucgccgcugcaagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguauuuucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgggugaugugcaaaucaaagggcccagccagcauucuuaguaucauuacagcaguucugguguugaccuucgucacucccauaaacucuauggugcucggggaauccaaagagacauuugagcuggaagauuuaccugacgacaugcuggagauggcuagccgcaucaauucguauuaccucaccuguauucuuaacuaugccguaucuuggggacugguuaucaucggcuugcuaauuggucuccuguucaagaaguaccaacaccgauuucugaauauauaugcgauguacugcgaagagugugauauguaccacgacaaauccgggcuuaagagacauggagauuucacgaacaaaugcaggcaguguaccugcggccaguaugaagacgccgcaggccugauggcucaccggaagacauacaauugcuuggugcaguauaaagccaaguggaugaugaacuuccucaucauuuacaucuuucugauuuuaaucaaggauucagcuauagucgugcaagccgcagggacugacuucaccacaugucuggagacugagaguaucaacuggaauugcaccggaccauuucuaaaccucgguaauugucagaaacagcaaaagaaagaaccguauacaaacauugccacccagcugaagggccuuaaagcuaucagcgucuuggaugugcccauuaucacugggauaccugacgauauugcgggagcacugcguuacaucgaggaaaaggaggacuuccauguucagcucacgauugaauaugccaugcuguccaaguacugcgauuacuauacacaguuuucugacaauagcggcuacucacaaaccacuuggcgcguguaucuuagaagucacgacuucgaggcuuguauccuguacccaaaccagcauuuuuguaggugcguuaaaaauggugagaagugcuccagcucuaacuggggguucgccaaugaaaugaaagauuauuacucaggcaagcagaccaaauuugacaaggauuugaaccucgcacugacagccuuacaccacgcuuuccggggaaccaguagcgccuauauggcaacuaugcuguccaagaaaucuaaugacgaucuaauagcguacacaaacaagaucaaaacgaaguuucccggcaaugcucuccugaaagccauuaucgacuacauugcauauaugaagucgcuuccugggauggccaacuucaaauacgaugaguuuugggacgaauugcuguauaagccaaaucccgcuaaggccagcaaccucgcacgaggaaaagaguccucauacaacuucaagcuggcuaucaguucuaaaagcauaaagaccuguaaaaaugucaaggauguggccugcuuauccccgcgcucaggugcgauuuaugccagcaucaucgcuuguggcgaaccuaacgggcccucuguuuacagaaagccauccggaggcguguuccagaguagcacugacaggucuauuuauugccugcuugauucccauugcuuggaggaguuugaagcaaucggucaagaggaacucgacgccgucaaaaagucaaaauguugggagauugaguacccugaugugaagcugauacaggaaggggacggcacaaaaaguugccggaugaaggacagcggaaauuguaacguagcuaccaaucgcuggcccgugauccagugcgauaacgacaaguucuacuauucggagcuacagaaagauuacgacaagacacaagauauuggccacuauugucuguccccagggugcacuaccguuagauaccccaucaauccuaaacauauuucuaacuguaauuggcaggucagcaggucaaguaucgccaagauagacgugcacaacaucgaagauauugagcaguauaaaaaggcaaucacgcagaagcuccaaaccucccugucucuuuuuaaauacgcgaagacuaaaaauuugccacacauuaagccgaucuauaaauacauaacaauugaaggaaccgagacagccgaggguaucgaaagcgcuuacaucgaguccgaagugcccgcccuggcaggcacuucaauuggguucaagauaaacagcaaagagggaaagcauuuacucgacgucaucgcuuauguuaagagugccucuuacuccagcguguauaccaaacuguacucgacgggcccuacaucagguauuaauaccaagcacgaugaacuuugcacugggccaugucccgcaaacaucaaucaucaggacggcuggcugacauuugcccgugagcggaccucuaguuggggaugcgaggaguucggcuguuuggcuguguccgaugggugcguauuuggaagcugccaggacauuaucaaagaagaacucucugucuaucgaaaggagacugaagaggugaccgauguugagcugugucuaacauucagcgacaaaacguacugcaccaaccugaacccugugacuccaauaaucacagaccucuuugaaguccaauucaagaccguggagacauauucccugcccagaauuguugcggugcagaaucacgaaaucaagauuggccagaucaacgaucuugguguauacucaaaaggguguggaaauguccagaaggugaacggcacuauauacgguaauggcgugccgagguuugacuauuugugccaucuggccagucgcaaagaggucauuguucggaaguguuucgauaacgacuaccaagcaugcaaauuuuuacagagcccugcuucuuauagacucgaggaagauuccgggaccgugacgaucaucgacuacaagaagauucugggaacaaucaaaaugaaggccauacuuggcgauguaaaauauaagaccuucgccgacucaguggauauuacugcugaggggaguuguaccggaugcaucaauuguuucgaaaacauucacugcgagcugacacuacacacuaccaucgaagcaagcuguccaauaaaauccucuugcacagucuuucaugacaggauucucgugacgcccaaugagcacaaguacgcccugaagguugugugcaccgagaaaccuggcaacacuuugacaaucgaagucuguaauaccaagaucgaggcgucgauggcucugguggaugccaaacccauuaucgaauuagcaccaguugaccagacuacauauauucgcgagaaggacgaacgaugcaaaaccuggaugugucgggugcgugaugagggucuccaggucauacuggagccuuucaagaaccuuuuugggagcuacaucggaauuuucuacacguuuaucaucucaauuguagcccuguuggugauaaucuauguucuccugcccauuugcuucaagcuaagagacacucugaggaaacaugaagaugcuuacaagcgcgagaugaaaauccgguga

SEQ ID NO: 11036 - RNA, 4326 nt, Artificial Sequence
  derived and/or modified CDS sequence (opt3) from LACV(LACV/95/OH-H (CCH-MB96))__GU206136.1__GP
augaucagaauacuggugcucauagccgucaccgcugcaagccccguuuaccagaggugcuuccaagacggcgccaucgugaagcagaacccuuccaaagaggcgguaacagaagugugucuuaaggaugacgucucuaugauuaaaacugaggcucgguauauccgcaaugccacggggguguuuucaaacaauguugcaauucgaaaguggcuggugagugauuggcacgacugccguccgaaaaagaucauaggaggucauaucaacgucauugaagugggcgaugacuugagcuuacacaccgaguccuacguauguucugccgauugcacaaucgggguugacaaggaaacugcucaggugagacugcagaccgauacaaccaaucauuucgagauugcaggaacuacagucaaaucgggcugguuuaagucaaccacguauaucacucuagaccaaaccugugagcaccucaaagugagcugcgguccaaagagugugcaguuccaugccuguuuuaaccagcacauguccugcgucagguuccugcaccggacaauacuucccgggucuauugcuaauagcaucugucagaacauugaaaucaucauucugguuacuuugacccuccugauauuuauccugcucuccauuuuaucaaaaacauacaucugcuaucugcuuaugccuauauucauuccaaucgccuacguguauggaaucauuuacaauaagaguuguaagaaaugcaaguugugcggccugguauaccaucccuuuaccgaguguggcacgcacugcguguguggggcgcgcuaugauacuagcgacagaaugaaacuacauagggcaucuggacucugcccugguuacaagucccugcgggccgcucgcgucauguguaaaucaaagggcccagccagcauccuuaguaugauuacagcagugcugguuuugaccuucgugacucccauaaacucuaugguccucggggaauccaaagagacauuugagcuggaagaguuaccugaugacaugcuggaaauggugagccgaaucaauucguauuacuucacuugcauucucaacuaugcuguaucuuggggacuuaucaucauuggccuguugacgggucuacuguuuaagaaguaccaacacagauuccucaauguuuaugccauguacugugaggaaugcgacauguaccacgauaaauccgggcugaagaggcauggagacuucaccaacaaaugucggcagugcacauguggccaguaugaggaugcggccggccuuauggcacaccguaagacuuacaauugccuggugcaguauaaagcuaaguggaugaugaacuuuuugauaaucuacauuuuccucauccugauuaaggacucagccaucgucgugcaagcugccgggaccgauuuuacaacuugcuuagagaccgaaaguauaaacuggaauuguacaggaccauuccugaaccuagguaauugccagaaacagcaaaagaaagagccguauaccaacaucgcaacucagcucaagggccugaaagccauuagcguccuugacauccccauuaucacggggauaccugaugacauugcuggagcguugcgcuacaucgaagagagagaagauuuucaugugcagcugacaauugaguaugcaaugcucuccaaguacugugacuacuauacccaguucucugauaauagcggcuacucacaaacuaccuggaggguuuaucugcggagucacgacuuugaggccugcauccuuuacccaaaccagcauuucugucgaugcgugaagaauggugaaaaauguuccagcucuaacuggggguuugcuaaugagaugaaggacuucuauucaggcaaacagacaaaguuugauaaagaccugaacuuggcccucaccgcacugcaccacgccuuccgcggaaccaguagcgcuuacauagccacaguauuauccaagaagucuaaugaugaccugaucgcauauacgaacaaaauuaagaccaaauuucccggcaaugcgcuacucaaggcuaucauugauuacaucgccuacaugaaaucgcugccugggauggcaaacuucaaguaugacgaguucugggaugaacuuuuguacaaaccaaaucccgccaaggcuagcaaccuggccagaggaaaggaauccucauauaacuuuaaacucgcaauaaguucuaagagcauuaaaacuugcaagaaugucaaagacguggcuugucuguccccgaggucaggugccaucuacgcgagcaucauugccugcggcgagccuucugggcccuccguuuaucggaagccaccuggaggcguguuccagaguagcacagaucgcucuaucuacuguuuacuggacucccauugccuugaggaauuugaggcuauuucacaagaagaguuggaugcagucaagaaaaguaagugcugggagauagaauaucccgacgugaaaccacuccaggagagcgaugguaccaagucguguagaaugaaagacuccgggaacugcaauguagccacaaacagguggcccgugauccagugugaaaaugacaaguucuacuacucugagcugcagaaggauuaugacaaaacucaagauauuggccacuacugccuaagcccuggauguaccacgguucguuauccaaucaacccgaagcauauuucaaauugcaacuggcaggucagucgguccucuaucgcuaaaauagacgugcacaauaucgaagauauugagcaguacaagaaagccaucacccagaagcugcaaacaagccucucccuguuuaaguaugcaaaaacuaagaaccuuccccacauuaaaccuaucuacaaguauauaaccauugagggcacagaaacugcggaggggaucgaaucagccuacaucgagagcgaagugccagcuuuggccggaaccaguauugguuucaaaauaaauucuaaggagggcaaacaucuguuagacgucaucgcauacguuaaguccgcuagcuauucgucaguguacacgaagcucuauucuacagggcccaccaguggaauuaacacuaaacacgaugagcuguguacaggcccuugcccagccaauaucaaccaucagguggguuggcuuaccuuugcacgagaaagaacuuccagcugggggugugaggaguucggcugccuggccguaucugacggaugugucuuuggcagcugccaggauauuaucaaggaagaauuguccguguacaggaaagagaccgaggaaguuacagacguggagcucugccugacguucucagauaagaccuauuguacuaaucuaaaccccgucacaccgauaaucaccgaccuguuugaagugcaauucaaaacaguugagacuuacagucucccucgcauuguggcuguacagaaccacgagaucaagauugggcagaucaaugaucugggagucuauagccggggcugcgguaacgugcagaaggugaaugggaccgucuacggaaacggcguuccaagauuugacuaccuuugucauuuggcgucuaggaaagaagugauaguacgcaagugcuucgacaaugauuaucaagccuguaaauuccugcagucccccgcaucauaccgauuagaggaagacagugguacggugacaauuaucgauuauaagaaaauccucggcaccauuaagaugaaggcuauccugggggacgucaaauacaagacuuuugccgauagcguggacauaaccgccgagggauccugcacaggcuguauuaacugcuucgaaaauauccacugugagcuuacucugcacaccacaauugaggcuucuugcccuaucaaaucgagcuguacgguuuuucaugaucggauucuagugacccccaacgaacacaaguaugcacucaaaauggucugcacugagaagccagggaauacacugaccauuaaggugugcaacacuaaaaucgaagccucaauggcguugguugacgcuaagccuaucauugagcuggcccccguggaucagacagcauacauccgugaaaaagacgagagauguaagaccuggaugugcaggguccgcgaugagggauuacagguaauucucgaaccauucaaaaaucuguuuggcuccuauauagguaucuucuacacguuuauuaucaguaucguggcccuucugguuauuauauacguguugcucccgaucuguuucaagcugcgggacacucuaagaaagcaugaggacgcuuauaaaagggaaaugaagauucgauga

SEQ ID NO: 11037 - RNA, 4326 nt, Artificial Sequence
  derived and/or modified CDS sequence (opt3) from LACV(LACV/95/WV-H)__GU206133.1__GP
augaucugcauucuggugcucauaaccgucgccgcugcaagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuuuaguaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaccaucuacaauaagaguugcaagaaaugcaaguuguguggccugguguaccaucccuuuacggagugcggcacucacugugucugcggggcgcgguaugauacaagcgaccgcaugaaacuacauagagcaucuggacucuguccugguuacaagucccugagggccgcucgggugaugugcaaaucaaagggcccagccagcauccuuaguauuaucaccgcaguucugguguugacuuucgucacacccauuaacucuauggugcucggggaauccaaagagaccuuugagcuggaagauuuaccugacgacaugcuggagauggcuagccgcauaaauucguauuaccucacguguauccuuaacuaugccguaucuuggggacugguuauuaucggcuugcuaaucggucuccuguucaagaaguaccaacaccgauuucugaauguguaugcgauguacugcgaagagugugauauguaccacgacaaauccgggcuuaagagacauggagauuucaccaacaaaugcaggcaguguacaugcggccaguaugaagacgccgcaggccugauggcucaccggaagacuuacaauugcuugguccaguauaaagccaaguggaugaugaacuuccucauuauauacaucuuucugauuuuaaucaaggauucagcuauugugguccaagccgcagggaccgacuucacaacuugucuggagaccgagaguaucaacuggaauugcacaggaccauuucuaaaccucgguaauugucagaaacagcaaaagaaagaaccguauaccaacauagccacucagcugaagggccuuaaagcuaucagcguguuggauguucccauuaucacggggauuccugacgauaucgcgggagcacugcguuacauagaggaaaaggaggacuuccaugugcagcucacaauugaauaugccaugcuguccaaguacugcgauuacuauacccaguuuucugacaauagcggcuacucacaaacuaccuggcgcguauaucuuagaagucacgacuucgaggcuuguauccuguacccaaaccagcauuuuuguaggugcgucaaaaauggugagaagugcuccagcucuaacugggauuucgccaaugaaaugaaagacuauuacucagggaagcagacaaaauuugauaaggacuugaaccucgcacugaccgccuuacaccacgcuuuccggggcacuucaagcgccuauauugcaacaaugcuguccaagaaaucuaaugaugaccuaaucgcguacacgaacaagauaaaaaccaaguuucccggaaaugcucuccugaaagccaucauugauuacaucgcauauaugaagucgcuuccuggcauggccaacuucaaauacgacgaguuuugggaugaauugcuguauaagccaaaucccgcuaaggccagcaaccucgcacgagggaaagaguccucauacaacuucaagcuggcuauuaguucuaaaagcaucaagacuuguaaaaaugugaaggacguugccugcuuauccccgcgcucaggagcgauauaugccagcauuaucgcuuguggugaaccuaacggccccucuguguacagaaagccauccgggggagucuuccagaguagcacagaucaaucuaucuauugccugcuugacucccauugcuuggaggaguuugaagcaauuggccaggaggaacucgaugccgugaaaaagucaaaauguugggagaucgaguacccugacguaaagcugauucaggaaggugacgggaccaaaaguugcaggaugaaggauagcggcaauuguaacguggcuacaaaucgguggcccguuauacagugcgagaacgacaaguucuacuauucggaacuacaaaaagauuacgacaagacucaggauaucggacacuauugucuguccccaggcugcaccacgguccgcuaccccauuaauccuaaacauaucucuaacuguaauuggcaagugagcagaucaaguauugccaagaucgacgugcacaacauagaggauaucgaacaguauaaaaaggcaauuacccagaagcuccagacaucccugucucuuuuuaaauacgcgaagacuaaaaauuugccacacaucaagccgauuuauaaauacaucaccauagaggggacagagacugccgaaggaauugagagcgcuuacaucgaauccgagguccccgcccuggcagguaccucaaucggcuucaagauuaacagcaaagaagggaagcauuuacucgacguuauagcuuaugugaagagugccucuuacuccagcguguauacgaaacuguacucgacaggaccuaccucaggcaucaauacuaagcacgaugagcuuugcacagguccaugucccgcaaacauuaaucaucagguaggguggcugaccuuugccagggagcguacuucuaguuggggcugcgaagaguucggauguuuggcugucuccgacggcugcguguuugggagcugccaagauaucauuaaagaggaacucucuguuuaucggaaggaaaccgaggaggugacagacgucgaacugugucuaacguucagcgauaaaaccuacugcacuaaccugaacccugugacaccaaucauaaccgaccucuuugagguucaguucaagacaguggaaacuuauucccugccccgaaucguagcgguccagaaucacgagauuaagaucggacagauuaacgaccuuggcguguacucaaaagguugugggaaugugcaaaaggucaacggaaccaucuacggcaaugguguuccgagauuugauuauuugugccaucuggccaguaggaaagaggugauaguacgcaaguguuucgacaacgauuaccaggcaugcaaauuuuuacagagcccugcuucuuaucggcucgaagaggacuccggcacggugacaauuaucgauuacaagaagauccuggggaccauuaaaaugaaggccauccuuggagacgucaaauauaagacuuucgccgauucaguggacauaaccgcugaaggcaguuguacagggugcauuaauuguuucgagaacauccacugcgaacugacucuacacaccacaauugaggcaagcuguccaaucaaauccucuugcacgguuuuucaugauagaauacucgugacccccaaugagcacaaguacgcccugaagauggucugcacugaaaaaccuggaaacacauugaccauuaagguguguaauacuaaaaucgaggcgucgauggcucugguugacgccaagcccaucauugaauuagcaccaguggaucagacagccuauaucagggagaaagacgaacgcugcaagaccuggaugugucgaguccgggacgagggccuccaaguaauucuggagccuuucaagaaccuuuuugguagcuacauagggaucuucuacacguuuauuaucucaaucguggcucuguugguuauuauauaugugcuccugcccaucugcuucaaacuacgugauacucugagaaagcaugaagacgcauacaaaagggagaugaagauucgcuga

SEQ ID NO: 11038 - RNA, 4326 nt, Artificial Sequence
  derived and/or modified CDS sequence (opt3) from LACV(LACV/96/WV-M (WV96-3955))__GU206145.1__GP
augaucuacauucuggugcucauagccgucaccgcugcaagccccguuuaucagagaugcuuccaagacggcgccaucgugaagcagaacccuuccaaagaggcgguaacagaagugugucuuaaggaugacgucucuaugauuaaaacugaggcuagguacauccggaaugccacggggguguuuucaaacaauguugcaauucgcaaguggcuggugagugauuggcacgacugccgaccaaagaagaucaccggaggucauauaaacgucaucgaagugggcgaugacuugagcuuacacacagaguccuauguauguucugccgauugcacuauugggguugacaaggaaaccgcucaggugcgucugcagacagauaccacuaaucauuucgagaucgcaggaacaaccgucaaaucgggcugguuuaagucaacgacuuacauuacccuagaccaaacaugugagcaccucaaagugagcugcgguccgaagagugugcaguuccaugccuguuuuaaccagcacauguccugcgucagauuccugcacaggacuauccuucccgggucuauagcuaauagcauuugucagaacaucgaaauuaucauccugguuaccuugacacuccugauuuuuauacugcucuccaucuuaucaaaaaccuauauuugcuaccugcuuaugccuaucuucauaccaauugccuauguguacggaaucaucuacaauaagaguuguaagaaaugcaaguugugcggccugguauaucaucccuuuacggaguguggcacucacugcguguguggggcgcgguacgauacaagcgaccgcaugaaacuacauagagcaucuggacucugcccugguuauaagucccugagggccgcucgggucauguguaaaucaaagggcccagccagcauucuuaguaucauuaccgcagugcugguuuugacuuucgugacacccauaaacucuaugguccucggggaauccaaagagguguuugagcuggaagaguuaccugaugacaugcuggaaauggcucuccgcaucaauagcuacuauuucacuugcauucuuaacuacgccguaucguggggacugaucaucauuggcuugcuaacgggucugcucuuuaagaaguaucaacaccgauuccugaauauauacgcgauguacugugaggaaugcgacauguaucacgauaaaucugggcuuaagagacauggagacuucaccaacaaauguaggcagugcacauguggccaguacgaggaugccgcaggccugaugacucaccggaagaccuauaauugcuugguucaguacaaagcuaaguggaucaugaacuuucucauuguguauaucuuccugauuuuaaucaaggacuccgccauaaucguccgugcugccgggacagauuuuucaaguugccuggagacugaaauuaucaacuggaauuguaccggaccauuccuaaaccucgguaauugccaacgccagcagaaaaaggagccguacgcaaacauugccgcucaacugaaaggccuuaaggcgaucagcguguuggacauacccaugauuacagaaaucccugaugacauugcauccgcccugagauauaucgaggaaagggaggcuuuucauguccagcucaccgccgaguacgcaaugcugucucgguacugugauuauuacacucaguucagcgacaauucaggguauagucagacgacauggcgaguguaccuucgcucccacgauuuugaagccugcauacuguauccaaaccaacauuucuguagaugcguuaaaaauggagagaaguguagcucugcuaacugggacuuugccaaugaaaugaaggacuacuauucaggcaaacaggcaaaguucgauaaagacuugaaccucgcgcugaccgcuaugcaccacgccuuuagggguaccaguagcgcauacauggccgcuauguuauccaagaaaucuaaugaugaccugaucaccuacacaaacaagcuaaagaccaaauuccccgggaaugcccuccugaaggcaauuaucgauuauauugcuuacaugaaaggccuuccuggaauggccaacuuuaagcaugacgaguucugggaugaauugcuguauaaaccaacucccacaaaggcgccgaaucucgcccggggccgcgagucgagcuacaacuucgagcuggcuaucuccucaaaaaguauaaagacgugcaagaacgugaaagacguagcauguuuaucuccuagaagcggggccauuuaugcuuccaucaucgccugcggagaacccaaugguccaucagucuacaggaagccuagcggcgggguguuucagucuuccaccgaucagaguauguauugucugcuugacagccacugcuuggaggaguucgaagcaauuucucaagaggaacucgaugcgguuaaaaaguccaaaugcugggagaucgaauaccccgacgugaagcugcuacaggagaacgauggaacuaagucaugucguaugaaagacaguggcaauugcaacgucgccacaaaucgguggccagugauucagugugaaaacgacaaguuuuacuauagcgagcugcagaaagauuacgacaagacccaagauauaggucauuauugccucucgcccgggugugcuacaauccgauacccuauuaauccaaaacacaucuccaacugcaauuggcagguaucuagaagcucaauugccaagaucgacgugcacaacauagaggauaucgaacaguauaagaaagcaauuacucagaagcugcaaaccagucuuuccuuguucaaauacgcuaagacgaaaaaucugccgcauaucaagcccauuuauaaguacaucaccauagagggcacagaaacugccgagggaauugaaucugcauacaucgagagcgagguuccugccuuagcuggcaccuccaucggguuuaaaauuaacucaaaggaaggaaaacaccuccuggacgucauagcguaugugaaaagcgccaguuacucuuccguguauacaaaacuuuacagcacugguccaaccucgggcgucaauacgaagcaugaugagcuguguacagggcccugcccugcaaacaucaaucaccagguuggaugguugaccuucgcuagggaacgcacuucaucuuggggcugugaggaauuugguugccucgccgugagugacggguguguguucggcuccugccaggauauuaucaaagaggagcugagcguauaucggaaggaaacagaggaagucaccgacguggagcuaugccugacuuuuucugauaagaccuacuguacaaaccucaacccaguuacgcccauuaucaccgaccuguucgaggugcaauuuaaaacugucgaaacauauagccuuccgagaauaguggccguucagaaucaugagaucaagauuggacagaucaacgauuugggcguguacuccaaagggugcggaaauguacagaaggucaacggcaccauuuacgguaauggggugccuagguucgacuaucugugucacuuagcuucacgcaaagaagugaucguccgaaagugcuuugacaacgauuaccaagcauguaaguuccuccagaguccagccagcuaucggcuggaggaagacucuggaacaguuacuauaauugauuacaaaaagauccuuggcaccaucaaaaugaaggcgauucugggugacgugaaauauaagacguucgcugauaauguagacaucacagccgagggcuccugcaccggguguauaaacugcuuugagaauauucacugugaacuaacucuccauaccacaaucgaggcaucaugccccauuaagaguagcuguacuguguuccacgaucguauccuggucaccccuaacgaacauaaauacgccuugaaggugguuugcacagagaaacccggaaauacgcugaccauaaaggugugcaacacuaaaauugaagcugcaauggccuuagucgacgcgaagccaaucaucgagcucgcuccuguggaucagacagccuauauuagagagaaggacgaaagguguaaaaccuggaugugccgcguucgggaugagggccuucaggugauccuggaacccuuuaagaaucuguucggguccuacauuggaauauuuuacacuuucaucauuucuaucgucgcauugcucguaaucauuuauauacugcuaccaaucuguuuuaaacugagagacacacuuaggaagcacgaggacgccuacaaacgagaaaugaagauucgcuga

SEQ ID NO: 11039 - RNA, 4326 nt, Artificial Sequence
  derived and/or modified CDS sequence (opt3) from LACV(LACV/97/NC-M (NC97-7306))__GU206127.1__GP
augaucaggauucuggugcucauagccgucaccgcugcaagccccguuuaccagagaugcuuccaagacggcgccaucgugaagcagaacccuuccaaagaggcgguaacagaagugugucuuaaggaugacgucucuaugauuaaaacugaggcucgguauauccgcaaugccacggggguguuuucaaacaauguugcaauucgaaaguggcuggugagugauuggcacgacugccguccgaaaaagaucauaggaggucauaucaacgucauugaagugggcgaugacuugagcuuacacaccgaguccuacguauguucugccgauugcacaaucgggguugacaaggaaacugcucaggugagacugcagaccgauacaaccaaucauuucgagauugcaggaacuacagucaaaucgggcugguuuaagucaaccacguauaucacucuagaccaaaccugugagcaccucaaagugagcugcgguccaaagagugugcaguuccaugccuguuuuaaccagcacauguccugcgucagguuccugcaccggacaauacuucccgggucuauugcuaauagcaucugucagaacauugaaaucaucauucugguuacuuugacccuccugauauuuauccugcucuccauuuuaucaaaaacauacaucugcuaucugcuuaugccuauauucauuccaaucgccuacguguauggaaucauuuacaauaagaguuguaagaaaugcaaguugugcggccugguauaccaucccuuuaccgaguguggcacgcacugcguguguggggcgcgcuaugauacuagcgacagaaugaaacuacauagggcaucuggacucugcccugguuacaagucccugcgggccgcucgcgucauguguaaaucaaagggcccagccagcauccuuaguaugauuacagcagugcugguuuugaccuucgugacucccauaaacucuaugguccucggggaauccaaagagacauuugagcuggaagaguuaccugaugacaugcuggaaauggugagccgaaucaauucguauuacuucacuugcauucucaacuaugcuguaucuuggggacuuaucaucauuggccuguugacgggucuacuguuuaagaaguaccaacacagauuccucaauguuuaugccauguacugugaggaaugcgacauguaccacgauaaauccgggcugaagaggcauggagacuucaccaacaaaugucggcagugcacauguggccaguaugaggaugcggccggccuuauggcacaccguaagacuuacaauugccuggugcaguauaaagcuaaguggaugaugaacuuuuugauaaucuacauuuuccucauccugauuaaggacucagccaucgucgugcaagcugccgggaccgauuuuacaacuugcuuagagaccgaaaguauaaacuggaauuguacaggaccauuccugaaccuagguaauugccagaaacagcaaaagaaagagccguauaccaacaucgcaacucagcucaagggccugaaagccauuagcguccuugacauccccauuaucacggggauaccugaugacauugcuggagcguugcgcuacaucgaagagagagaagauuuucaugugcagcugacaauugaguaugcaaugcucuccaaguacugugacuacuauacccaguucucugauaauagcggcuacucacaaacuaccuggaggguuuaucugcggagucacgacuuugaggccugcauccuuuacccaaaccagcauuucugucgaugcgugaagaauggugaaaaauguuccagcucuaacugggacuuugcuaaugagaugaaggauuucuauucagggaaacagacaaaguuugacaaagaucugaacuuggcccucaccgcacugcaccacgccuuccgcggcaccaguagcguauacauagcuacaauguuauccaagaagucuaaugacgaucugaucgccuauacgaacaaaauuaagaccaaauuucccggaaaugcacuacucaaggcgaucauugacuacaucgcuuacaugaaaucgcugccuggcauggccaacuucaaguaugaugaguucugggacgaacuuuuguacaaaccaaaucccgcaaaggccagcaaccuggcuagagggaaggaauccucauauaacuuuaaacucgccauaaguucuaagagcauuaaaacuugcaagaaugucaaagauguggcaugucuguccccgaggucaggagcuaucuacgccagcaucauugcgugcggugagccuaacggccccucuguuuaucggaagccaccugggggaguguuccaguccaguacagaccgcagcaucuacuguuuacuggauucucauugccuugaggaauuugaggccauuucccaagaagaguuggacgcugucaagaaaucaaagugcugggagauagaauaucccgaugugaaaccacuccaggagagugacggcaccaagagcuguagaaugaaagacucggguaauugcaacguagcaacaaauagguggcccgugauccagugugaaaacgauaaguucuacuacuccgagcugcagaaggacuaugauaaaacucaagacauugggcacuacugccuaucuccuggcuguaccacgguucguuauccaaucaauccgaagcauauuagcaacugcaauuggcaggucucacggaguuccaucgccaaaauagaugugcacaacaucgaagacauugagcaguacaagaaagcuaucacccagaagcugcaaacaucucucagccuguuuaaguaugccaaaacuaagaaucuuccccacauuaaaccuaucuacaaguauauaaccauugagggaacagaaacugcagagggcaucgaauccgcguacaucgagucagaagugccagccuuggcugggaccagcauuggauucaaaauaaacaguaaggaggguaaacaucuguuagaugucaucgccuacguuaagucugcauccuauagcucgguguacacgaagcucuauucaacaggccccaccucugggauuaauacuaaacacgacgagcuguguacaggaccuugcccagcuaacaucaaucaucaggugggcuggcuuaccuuugcccgagaaagaaccaguuccugggguugugaggaguucgggugccuggcaguaagcgauggcugugucuuuggaucuugccaggacauuaucaaggaagaauugagcguguacaggaaagagacugaggaaguuacagauguggagcucugccugacguucuccgacaagaccuauuguacuaaccuaaaccccgucacaccgauaaucaccgaucuguuugaagugcaauucaaaacaguugagacuuacucacucccucgcauuguggccguacagaaucacgagaucaagauuggccagaucaacgaccugggggucuauaguaaggcuugcggaaaugugcagaaagugaacggcaccgucuacgguaaugggguuccacgguuugacuaccuuugucauuuggcgagcagaaaggaagugauaguaaggaaaugcuucgauaacgacuaucaagccuguaaguuccugcagucucccgcauccuaccgcuuagaggaagauucaggaacggugacaauuaucgacuauaaaaagauccucggcaccauuaagaugaaagcuauccugggugaugucaaguacaaaacuuuugccgacaguguggauauaaccgccgagggcagcugcacaggguguauuaauugcuucgaaaacauccacugugagcuuacucugcacaccacaauugaggcuuccugcccuaucaagucuucguguacgguuuuucaugaccgaauacucgugacccccaaugaacacaaauaugcacuaaagauggucugcacugagcggccaggaaacacacugaccauuaaggugugcaauacuaaaaucgaagccagcauggcguugguugaugcuaagccuaucauugagcuggcccccguggaccagacagcauacauccgugaaaaagaugagagauguaagaccuggaugugcaggguccgcgacgagggcuuacagguaauucucgaaccauucaaaaaccuguuugggucauauauaggaaucuucuacacguuuauuaucuccaucguggcccuucugguuauuauauacguguugcucccgaucuguuucaagcugcgggacacucuaagaaagcaugaggaugcuuauaaaagggaaaugaagauucgauga

SEQ ID NO: 11040 - RNA, 4326 nt, Artificial Sequence
  derived and/or modified CDS sequence (opt3) from LACV(LACV/human/1960)__EF485031.1__GP
augaucugcauucuggugcucauaaccgucgccgcugcaagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuuuaguaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaccaucuacaauaagaguugcaagaaaugcaaguuguguggccugguguaccaucccuuuacggagugcggcacucacugugucugcggggcgcgguaugauacaagcgaccgcaugaaacuacauagagcaucuggacucuguccugguuacaagucccugagggccgcucgggugaugugcaaaucaaagggcccagccagcauccuuaguauuaucaccgcaguucugguguugacuuucgucacacccauuaacucuauggugcucggggaauccaaagagaccuuugagcuggaagauuuaccugacgacaugcuggagauggcuagccgcauaaauucguauuaccucacguguauccuuaacuaugccguaucuuggggacugguuauuaucggcuugcuaaucggucuccuguucaagaaguaccaacaccgauuucugaauguguaugcgauguacugcgaagagugugauauguaccacgacaaauccgggcuuaagggacauggcgauuucaccaacaaaugcagacaguguacaugcggccaguaugaagacgccgcagggcugauggcucacaggaagacuuacaauugcuugguccaguauaaagccaaguggaugaugaacuuccucauuauauacaucuuucugauuuuaaucaaggauucagcuauugugguccaagccgcaggaaccgacuucacaacuugucuggagaccgagaguaucaacuggaauugcacagguccauuucuaaaccucggcaauugucagaaacagcaaaagaaagaaccguauaccaacauagccacucagcugaaggggcuuaaagcuaucagcguguuggauguucccauuaucacgggcauuccugacgauaucgcgggagcacugcgguacauagaggaaaaggaggacuuccaugugcagcucacaauugaauaugccaugcuguccaaguacugcgauuacuauacccaguuuucugacaauagcgguuacucacaaacuaccuggcguguauaucuucgcagucacgacuucgaggcuuguauccuguacccaaaccagcauuuuugcagaugugucaaaaauggggagaagugcuccagcucuaacugggauuucgccaaugaaaugaaagacuauuacucaggcaagcagacaaaauuugauaaggacuugaaccucgcacugaccgccuuacaccacgcuuucaggggaacuucaagcgccuauauugcaacaaugcuguccaagaaaucuaaugaugaccuaaucgcguacacgaacaagauaaaaaccaaguuucccggcgaugcucuccugaaagccaucauugacuacaucgcauauaugaagucgcuuccugggauggccaauuucaaauacgaugaguuuugggacgaauugcuguauaagccaaaccccgcuaaggccagcaaucucgcacggggaaaagaguccucauacaacuucaagcuggcuauuaguucuaaaagcaucaagacuuguaaaaacgugaaggauguugccugcuuauccccgcgaucaggugcgauauaugccagcauuaucgcuuguggcgaaccuaaugggcccucuguguaccgcaagccauccggaggcgucuuccagaguagcacagaccaaucuaucuauugccugcuugauucccauugcuuggaggaguuugaagcaauuggucaggaggaacucgacgccgugaaaaagucaaaauguugggagaucgaguacccugacguaaagcugauucaggaaggggauggcaccaaaaguugcagaaugaaggacagcggaaacuguaauguggcuacaaacagguggcccguuauacagugcgagaaugauaaguucuacuauucggaacuacaaaaagacuacgauaagacucaggacaucggccacuauugucuguccccagggugcaccacgguccgguaccccauuaacccuaaacauaucucuaauuguaacuggcaagugagccgcucaaguauugccaagaucgaugugcacaauauagaggacaucgaacaguauaaaaaggcaauuacccagaagcuccagacaucccugucucuuuuuaaauacgcgaagacuaaaaacuugccacacaucaagccgauuuauaaauacaucaccauagagggaacagagacugccgaagguauugagagcgcuuacaucgaauccgagguccccgcccuggcaggcaccucaaucggguucaagauuaauagcaaagaaggaaagcauuuacucgauguuauagcuuaugugaagagugccucuuacuccagcguguauacgaaacuguacucgacaggcccuaccucagguaucaacacuaagcacgacgagcuuugcacagggccaugucccgcaaauauuaaccaucagguaggcuggcugaccuuugccagagagaggacuucuaguuggggaugcgaagaguucggcuguuuggcugucuccgaugggugcguguuuggaagcugccaagacaucauuaaagaggaacucucuguuuaucguaaggaaaccgaggaggugacagaugucgaacugugucuaacguucagcgacaaaaccuacugcacuaaucugaacccugugacaccaaucauaaccgaccucuuugagguucaguucaagacaguggaaacuuauucccugccccggaucguagcgguccagaaccacgagauuaagaucggccagauuaaugaucuugguguguacucaaaaggguguggaaacgugcaaaaggucaauggcaccaucuacgguaacggcguuccgcgauuugacuauuugugccaucuggccaguagaaaagaggugauaguaaggaaguguuucgauaaugacuaccaggcaugcaaauuuuuacagagcccugcuucuuaucgccucgaagaggauuccgggacggugacaauuaucgacuacaagaagauccugggaaccauuaaaaugaaggccauccuuggcgaugucaaauauaagacuuucgccgacucaguggauauaaccgcugaagggaguuguacaggaugcauuaacuguuucgagaauauccacugcgaacugacucuacacaccacaauugaggcaagcuguccaaucaaauccucuugcacgguuuuucaugaccggauacucgugacccccaacgagcacaaguacgcccugaagauggucugcacugaaaaaccuggcaauacauugaccauuaagguguguaacacuaaaaucgaggcgucgauggcucugguugaugccaagcccaucauugaauuagcaccaguggaccagacagccuauaucagagagaaagacgaaaggugcaagaccuggaugugucgcguccgagaugagggucuccaaguaauucuggagccuuucaagaaucuuuuugggagcuacauaggaaucuucuacacguuuauuaucucaaucguggcucuguugguuauuauauaugugcuccugcccaucugcuucaaacuacgggacacucugcguaagcaugaagaugcauacaaaagagagaugaagauuagguga

SEQ ID NO: 11041 - RNA, 4326 nt, Artificial Sequence
  derived and/or modified CDS sequence (opt3) from LACV(LACV/mosquito/1978)__EF485037.1__GP
augaucaggauucuggugcucauagccgucaccgcugcaagccccguuuaccagagaugcuuccaagacggcgccaucgugaagcagaacccuuccaaagaggcgguaacagaagugugucuuaaggaugacgucucuaugauuaaaacugaggcucgguaugugcgcaaugccacggggguuuucucaaacaauguggcaauccgaaaguggcuggucagugauuggcacgacugccguccgaaaaagauuaucggaggucauauaaacgugaucgaaguaagcgaugacuuguccuuacacaccgagucuuacguuuguucggccgauugcacaauuggcguggacaaggaaacugcucaggucagacugcagaccgauacaaccaaucauuucgagaucgcagggacuacagugaaaucaggaugguuuaagagcaccacguauauuacucuagaccaaaccugugagcaccucaaagugaguugcggcccaaaguccguccaguuccaugccuguuuuaaccagcacaugucuugcguuagguuccugcaccggacaauccuucccgguagcauagcuaauuccauuugucagaacaucgaaauuaucauccuggugacuuugacccuccugauuuuuauacugcucucaaucuuaaguaaaacauacauuugcuaucugcuuaugccuaucuucauaccaauugccuacauguaugggaucaucuacaauaagagcuguaagaaaugcaaguugugcggacugguauaccaucccuuuaccgaguguggcacgcacugcguguguggcgcgcgcuaugauacuucugacagaaugaaacuacauagggcauccgggcucugcccuggauacaagucacugcgggccgcucgcgucauguguaaaagcaaggguccagccaguauucuuucuaucauuacagcagugcugguuuugaccuucgugacucccauaaacuccaugguccucggcgaaagcaaagagacauuugagcuggaagaguuaccugaugacaugcuggaaauggcuucgcgaaucaauucuuauuacuuuaccugcauucucaacuaugccguguccugggggcuuguaaucaucggacuguugacgggccuacuguuuaagaaguaccaacacagauuccucaauauuuaugcgauguacugugaggaaugcgacauguaccacgauaaaucaggucugaagaggcauggggacuucaccaacaaaugucggcagugcacauguggacaguaugaggaugccgcaggccuuauggcucaccguaagacuuacaauugccugguucaguauaaagccaaguggaugaugaacuuuuugauaaucuacauuuuccucauccugauuaaggacagugcuaucgugguccaagccgcaggcaccgauuuuacaacuugcuuagagaccgaaagcauagacuggaacuguacagggccauuccugaaucuaggaaacugccagaaacagcaaaagaaagagccguauaccaauaucgccacucagcucaagggucugaaagcuauuuccgugcuugauauccccauuaucacgcgcauaccugacgauauugcgggcgcauugagauacaucgaagagagggaagacuuucauguccagcugacaaccgaguaugccaugcucucuaaguacugugauuacuauacucaguucagcgacaacucaggguacagucaaaccacauggcggguguaucugcgaucccacgacuuugaggcuugcauucuuuacccaaaucagaacuucugucgcugcguuaagaauggagaaaaauguaguucuucaaacugggauuuugccaaugagaugaaggacuauuaccccggcaaacaggcaaaguucgauaaagaccugaacuuggcccucaccgcucugcaucacgccuuuagagguacuagcagcgcauauaucgcgacaauguuauccaagaagucuaaugaugaccugauagcuuacacgaacaaaaucaagaccaaauucccugggaaugcccuacucaaggcaauuaucgauuacauugccuauaugaaaucgcugccaggcauggcuaacuuuaaguacgacgaguucugggaugaacuuuuguauaaacccaauccggccaaggcaagcaaccuggcuaggggaaaggaauccucauacaacuucaaacucgccaucaguucuaagagcauaaaaacuugcaagaaugugaaagacguagcgugucuguccccucggucaggcgccauuuaugcuagcaucaucgcaugcggggagcccaacggaccaucugucuaccgcaagccuuccgguggcguguuucagaguagcacagauagaucuauuuauuguuuacuggacucccacugccuugaggaguucgaagccaucucacaagaagaguuggaugcuguuaagaaaaguaagugcugggagauugaauacagcgacgugaaaccccuccaggaggggaauggaaccaagucguguaggaugaaagacuccggcaacugcaaugucgccacaaaccguuggccagugauacagugugaaaaugauaaguuuuacuauucugagcugcagaaggacuacgauaaaacucaagacaucggucauuauugccuaagccccggguguaccacgguacgguacccuauuaacccaaagcacaucucaaauugcaacuggcaagugagucgauccucuauugcaaaaaucgauguucauaauauagaagacaucgagcaguauaagaaagcgauuacccagaagcugcagacaagccucucccuguucaaguacgccaaaacuaagaaccuuccgcacaucaaacccauuuauaaguacaucaccauagagggcacagaaacugcugagggaauugaaucagccuacaucgagagcgaagucccugcauuggcuggcaccaguaucggguuuaaaauuaauucuaaggagggaaaacaccuguuagaugugauagccuaugugaaguccgcaagcuacucgucagucuaugccaagcucuacucuacggguccaacaaguggcaucaacaccaaacaugacgagcuguguacugggcccugcccugcuaauauuaaccaccagguuggauggcuuacauucgcgaaggaaagaaccuccagcuggggcugugaggaauuugguugccuggccgugucugauggguguguguucggcagcugccaggacaucauuaaagaggaauuguccguauauaggaaggagacugaggaagucaccgauguggagcucugccugacauuuucagacaaaacguacuguaccaaccuaaauccaguuacucccaucauaacagaucuguucgaagugcaauuuaagaccgucgagacauauagucucccgcgcaucguggcaguucagaaccaugagauuaagaucggacagauuaaugaccugggcguguacagcaaagggugcggaaacguacagaaggucaauggcacuguguacgguaacggggugccucgguucgacuaucuuugucacuuggcuucuagaaaagaagucaucguuaggaagugcuuugauaaugacuaccaagccuguaaauuccugcaguccccagccucauaucgcuuagaggaagauaguggaaccgugacgauaauugacuacaagaagauccucggcacaaucaaaaugaaggcuauucugggugauguaaaauauaagaccuucgcagacagcguggauaucacugccgagggcuccugcaccggguguauaaacugcuuugaaaauauucauugugagcuuacacugcacacuaccaucgaggcgucuugccccauuaaaucgagcuguacagucuuccacgaccgaauccuagugacgccuaacgaacauaaguacgcucucaagaugguuugcaccgagaaacccggaaauacucugacaauaaaggugugcaacaccaaaauugaagccucaauggcauuggucgaugccaagccaaucaucgagcuggcuccuguggaccagacugcauauauucgggaaaaagaugagcguuguaagacauggaugugcagaguuagggacgagggcuuacaggugauccucgaacccuuuaagaaucuguucggguccuacauuggaauauuuuacaccuucaucauuaguaucgucgcccuucuggcgaucauuuauguauugcucccaauauguuuuaaacugcgcgacacgcuacggaagcacgaggaugcuuacaaaagagaaaugaagaucagguga

SEQ ID NO: 11042 - RNA, 4326 nt, Artificial Sequence; identical to SEQ ID NO: 11011
  derived and/or modified CDS sequence (opt3) from LACV__KP271111.1__GP

SEQ ID NO: 11043 - RNA, 4263 nt, Artificial Sequence
  derived and/or modified CDS sequence (opt3) from OROV(BeAn19992)__NC_005775.1__GP
auggccaaccugaucauuauaagcauggugcucggcgucgcuuacgggcacccccuuuccaccucucagaucggagacagaugcuucgccgguggcaaucuguuuaaggagaugaacuugucaguuggguuaggagaaauuugugugaaagaugacaucaguauuguaaagagcacaacuguguucuccaaaaauaagccugcacuggaggcgacgaccaaauuuuauaggucuuucaucgucaaggauuggucggaaugcaacccagugcuagacaaguuuggcaauuucaugguucucucaguggaugacaacggucauauaaucccgaaaauguacacaugucgggcugccugcgauauucgccugaauaaggacaacgcagagaucauucuuagcaguacuaaacugaaucacuuugaaaucgucgggaccacauccaccucuggaugguucaagaacacuauaacaaauaacuuggagcauaccugugagcacgugacgguaaauugcggccaaaaauccguuaaguuucaugccuguuuccgacagcaccguggcugcauuagauuuuucaaggggacuuauaugcccuacuccaugaucgaagcuaugugugugaacauugagcucaucauccugacccuguauauuuuugcagccauaaucuucgcucucauuaucacaaaaucauacgucgccuauuuacugcuuccuuuguucuacccagugacuugguuuuacggaaagguguauaaaaagauaaauaguugccccaacugucugcuagcgagccacccuuucaccucuugcccaaaauuuugcauuugugguuccagguucucaugcacagaagcacucaagguccaucggaugggcaaagauugucugggguacaagagccuuaguaaggcccgccagaugugcaaaucuaaguccuggagcuuuaccgcugccauccugacgggauugauccucauggaguucauuucgcccaucgcaggcgagagaauguauaaacuggaagaguuagcugacgaauuuauuaagcugacugagcagguuaacauacucgaaagggagauggaggugcuuaaacaaucuaucauuguaauguucgccaucauccugguguugcuacuguuugaaaauaugauuuucaaccggcucuuucgcauauucuaccgauccuguucaaugugcggucugauccacuauagaccugggcuuaagauugaucugacaaagaccaauagguguggaaguugcaucuguggcuuugacgagcagcagagcuccggcuucgaauacgagauuuucuugaaagauaugcauguccagaaggaaucuugcaaauuuagcccacgggugaaccacuuccguaauaucaaggcgcuccuguuugccuuaguuauaugugcaacuaucuauacaguguacgcugacgaggacugccugucaaaagauauuaagaucaccuaccaagagcuacacaacugcauugggccgaagaucaugggagacacgugugucaguaaauccgaacucuauagcgaucuguucucuaagaaucuugugaccgaguacgacaaaaaguauuuugaacccgauacaguaaacgaccaguucaauaaaauagaguuugcccaggaugcucaucgcaugauuuugcuggaaagaauccucuacaagacugagugcgagaugcugucacuuaagaaaaacagugguccuuauaauguugccuggaggaccuaccugaagaaccacaauauugacuuguguagccggcauaacuauaaaaugaucugccaguguauaaauacacacuccaugugcaacaacacugauaucgacuacaauaaggaaauugagaccuacuauaaaucuaacgcagccgcuuaccgagcggaucucaauacaaucauggacacccugaagacugcauuccgcggcuuaacgaaagugcugauugaaaacuauaucgagaaggacgauucggacgcccuaaaggcucucuuuagcaauauaacagauuccguccaagacaacuaccagaugauugggauccugaaauucgccucaaaacuuuuggauaucaaucugggaagaaguaccaggucugcacaucacagcauuaugacuaacgagaucccaaaauccaaucccuuuaccgacuauucauacagcaaccucaauauuaaggaauguaugucuccugagucccugaaaugcuucaagaagcggggcaguacaccacacaccaaccauuuacuguguaaaauagauaauaaguauaaagccuuugacuggcccgaaaucgagacuauucagaagggucaaaaacuuugcuugggggauagccacuguaaccucgaauuuacagcuaucacggccgacaagauuaugucucugaccaauugcuacaaggaguccuucacugcacagccggcggauaugcaggcuggcaucaaaaagugcucagccgacgagauaggagaauguacaacccuagaggauaaaacauggccuaucauuuucugcggcgggaaguacuauuacagugacagcaaagaacaugcaaaggacggaucgaucaacaacuauugucugacuaauaagugcuccgagcagcgcuuccccauucacgaaaacugguuuaaaaaguguaauugggauaaaacccacaaggaguucucuacgaugagacaaaucaacuacaaugacauaaccagcuauaggaaagccauugagucagaaaucgguacagaucucaugacucaucacuacaagccaaccaaaaaccugccucauguggucccccguuaucacaguaucgacgugcagggcacagaguccacugaagggauuauaaauggauuuauccagaacaccauuccagcuaucucuggccuugguguuggguaccauuugaauuuccagagcaaccaacuguuugauauugugaucuucguaaagaaggccgucuacaaagcacaguaucagaaggcuuacacgacaggccccuccauaucaaucaauauugagcacaacgaacggugcaccggacacuguccugagaaaaucccagccaaggagggcugguuaacuuuuagcaaagaacauacaaguucuugggggugcgaggaauauggaugucucgcgauugacaccgguugccuguacggcuccugucaggaugugauccgaccggagcuugacguuuauaagaagauagggagcgaggugucgcugauugaaaucugcaucacuuugccccacgagaccuacugcaaugauauggacauucucgaaccuaucauaggagauaaacugucagccucuuuccaaaacacacagacgaaucagcuaccaacccugauugcuuauaagaaaggcaagaucuacacuggucagauuaacgacaucgggaacacagcacuccaauguggcaguauacaggucauuaauggauccaccaucggcacagggagccccaaauuugauuacaucugccaugccaugagaaggaaggacgugauuguacgcaaguguuucaacgacaauuaucagucuugcacucggcuggagaaaagaaacgaucuuaucccuuacaggaagggagacgugauugaaguuagcaaaaccggcuccaauaugggucaaaugacguucaagauagaguugggggauaucaacuauaaaauuuuuacaaagucaaucgaccugcagaugaguggaaucugugcuggcugcauugauugugccgaggguauaagcugcucuaucaaugcagaagucccagcggagaccgugugucacugcaagacuaacugugaagacuucauuaauaacaucguguuuagcccccagauuaaaaauuacaacaucaagguccauugcaaaucaaagguugagaaaauaaccgcccacaucugcggccgcgauauugacuuacagcucacaaucaagccguauaaucaaaagauugaucugagucagcuugacgaaagcaacuacauccgagaggaggaucugcagugugggacuuggcuaugcaaagugcagaaggaaggaauagacauuaucuucaaaggccucuuuuccgggcugggacgguauuggaccauuuugaucuacucuauaaucggcgugguaauuaucgucauucugguguacaucuuacucccuauaggucgucugcuuaaggcuuuccugauuagacacgagaucgaauaugccauggagcaaaagaucaaguga

SEQ ID NO: 11044 - RNA, 4263 nt, Artificial Sequence
  derived and/or modified CDS sequence (opt3) from OROV(BeH759021)__KP691607.1__GP
auggccaaccugaucauuauaagcauggugcucuccgucgcuuacggccacccccuuucuaccucacagaucggggacagaugcuucgcaggagguaaucuguuuaaggagaugaacuugaguguuggcuuaggggaaauuugugugaaagaugacaucagcauuguaaaguccacaacuguguucucuaaaaauaggccugcccuggaggcgacgaccaaguuuuaucggucguucaucgucaaagauuggucagaaugcaacccagugcuagacaaguuuggaaauuucaugguucucagcguggaugacaacggccauauaaugccgaagauguacacaugucgcgcugccugcgauauccgacugaauaaagacaacgcagagauuauccuuaguuccacuaagcugaaucacuuugaaauugucgguaccacaucuaccagcgggugguucaaaaacacuaucacaaauaacuuggagcauaccugugagcacgugacgguaaauugcggacaaaaguccguuaaauuucaugccuguuuccgucagcacagaggcugcauaagguuuuucaagggcacuuauaugcccuacucaaugauugaagcuaugugugugaacaucgagcucauuauccugacccuguauaucuuugcagccauuauauucgcucucaucauuacaaagaguuacgucgccuauuuacugcuuccuuuguucuacccagugacuugguuuuacgggaaaguguauaagaaaaucaauagcugccccaacugucugcuagcgucucacccuuucaccuccugcccaaagauaugcauuuguggaucacgguuuagcugcacagaagcacucaaaguccaucgcauggguaaggauugucugggcuacaaaagucuuucuaaggccagacagaugugcaaguccaaaagcuggucguucaccgcugccauccugacgggguugauccucauggaguuuauuucucccaucgcaggagagaggauguauaagcuggaagaguuagcugacgaguucauuaaacugacugaacagguuaacauacucgaacgggagauggaggugcuuaagcaauccaucauuguaauguuugccaucauccugguguugcuacuguucgaaaauaugauuuuuaaccgccucuucucaauauuuuaccgaaguuguagcaugugcggccugauccacuauagaccuggucuuaaaauugaucugacaaagaccaauaaguguggguccugcaucuguggauucaacgagcagcagucuagcggcuuugaauacgagauuuucuugaaagacaugcauauccagaaggaaucaugcaaauucaguccaagggucaaucacuuucggaacauaaaggcgcuccuguucgccuuagugaucugugcaacuauuuauacaguuuacgcugaugaggacugccuguccaaagacaucaagauuaccuaccaagagcuacacaauugcaucggcccgaagauaauggggaacacgugugugagcaaaaaugaacucuauucugaucuguuuucaaagaaccuugucaccgaguacgacaaaaaguauuucgaacccgauacagugaaugaccaguuuaacaaaauugaguucgcccaggaugcucaucguaugaucuugcuggaacgcauucucuacaagacugagugcgagaugcugagucuuaagaaaaauagcggaccuuauaacguagccuggagaaccuaccugaagaaucacaacaucgacuuguguuccaggcauaacuauaaaaugauaugccaguguaucaauacacacucuaugugcaagaacacugauauugacuacaauaaagaaaucgagaccuacuauaagucgaacgcagccgcuuaccgggcggaucucaauacaauuauggacacccugaaaacugcauuucgagguuuaacgaagguucugaucgaaaacuauauagagaaggaugacagcgacgcccuaaaagcucucuucuccaauauuacagauucagugcaagacaacuaccagaugaucggcauccugaaguuugccaguaaacuuuuggauauuaaucuggggcgcucuaccagaagcgcacaucacuccaucaugacuaacgagauuccaaagucaaaucccuucaccgacuauagcuacucuaacgucaauauaaaagaauguauguccccugagagucucaagugcuuuaagaaaagggauagcacaccacacaccaaccaucuguuauguaagaucgacucuaaauauaaggccuucgauuggcccgaaauugagacuauccagaaaggacaaaagcugugccuuggcgacucccacuguaauuuggaauuuacagcuauuacggccgauaagaucaugucacucaccaacugcuacaaagagaguuucacugcacagccggcggacaugcagacagguauaaagaaaugcagcgcugaugagaucggggaauguaccacacuggaggacaagacuuggccuauuguguucugcggcggaaaauacuauuacucggauuccaaggaacaugccaaggacggcucuaucaacaauuauugucuaaccaacaaaugcagcgagcagcgguuucccauucacgaaaauugguucaagaaauguaacugggacaagacgcacaaagaguuuucaaccaugcgccaaaucaauuacaacgauauaacaaguuauagaaaggcaauugaguccgaaaucgggucugaccugaugacucaucacuacaaaccaaccaagaaucucccucaugucgugcccagguaucacagcaucgauguucagggaacagaguccacugaagguauuauaaacggcuucauccagaauaccauuccagccaucucagggcugggagugggcuaccaucuuaacuuuaaggguaaucaguuguucgacauuguaaucuuugucaaaaaggcuguguacaaagcccaauaucagaaggcauacacgacagggcccagcauaaguaucaacauugagcacaaugaacguugcaccggccacuguccugagaaaaucccagcuaaggagggauggcugacuuucucuaaggaacauacauccagcuggggcugcgaggaauauggguguuuagccauugauaccggaugccucuacgguucgugucaggacguuauccggccggagcuggauguguauaaaaagauaggcucagaggucucucuuauugaaaucugcaucacucugccccacgagaccuacugcaacgacauggauauuuuggaaccuaucauaggggacaaacucagugcguccuuucagaauacacaaacgaaccagcugccaacccuaauugccuauaagaaaggaaagaucuacacuggccagauuaacgauaucgguaauacagcucugcagugugggagcauacaagugauuaacggcucuaccaucggaacaggcagccccaaguucgacuacaucugccaugcaaugcgaagaaaagauguaauugugaggaaguguuuuaaugacaacuaucaguccugcacucgccucgagaaacggaaugaccugaucccuuacagaaagggggauguuauugaagucucaaaaaccggaaguaacaugggccagaugacguucaagauagagcuuggugacgugaauuauaagaucuucacaaaaagcauugauuugcaaaugucugggaucugugccggaugcaucgacugugcugagggcauuuccugcucaauaaacgccgaagugccagcagagaccgucugucacugcaagacuaauugugaagauuuuaucaacaauauuguuuucaguccccagaucaaaaacuacaauauuaaggugcauugcaaaagcaagguggagaagaucauagcgcacaucugcgguagggacauugaucugcaguuaaccguaaaaccguauaaccagaagaucgaccucucccaacuggaugaaucuaauuacauucgcgaggaggaccuucaguguggcacauggcugugcaaaguccagaaggaagggguggauaucauauuuaaaggacuauucucgggccucgggcgauauuggacuauucugaucuacagcauuaucggaguugugauaaucgucauuuugguguacauccuguuaccuauuggccggcuccugaaggccuuucuuauccgucacgagauagaauaugcuauggagcagaaaauuaaguga

SEQ ID NO: 11045 - RNA, 4263 nt, Artificial Sequence
  derived and/or modified CDS sequence (opt3) from OROV(BeH759022)__KP691610.1__GP
auggccaaccugaucauuauaagcauggcucucuccguggcauacggccacccccuuucuaccucacagaucggggacagaugcuucgccggagguaaucuguuuaaggagaugaacuugagugucggcuuaggggaaauuuguguuaaagaugacaucagcauugugaaguccacaacuguauucucuaaaaauaggccugcgcuggaggcuacgaccaaguuuuaucggucguucaucgugaaagauuggucagaaugcaacccaguccuagacaaguuuggaaauuucauggugcucagcguugaugacaacggccauauaaugccgaagauguacacaugucgcgccgcaugcgauauccgacugaauaaagacaacgccgagauuauccuuaguuccacuaagcugaaucacuuugaaauuguggguaccacaucuaccagcgggugguucaaaaacacuaucacaaauaacuuggagcauaccugugagcacgucacggugaauugcggacaaaaguccguaaaauuucaugcuuguuuccgucagcacagaggcugcauaagguuuuucaagggcacuuauaugcccuacucaaugauugaagcaauguguguuaacaucgagcucauuauccugacccuguauaucuuugccgcuauuauauucgcccucaucauuacaaagaguuacguggcguauuuacugcuuccuuuguucuacccagucacuugguuuuacgggaaaguguauaagaaaaucaauagcugccccaacugucugcuagcaucucacccuuucaccuccugcccaaagauaugcauuuguggaucacgguuuagcugcacagaagcccucaaagugcaucgcauggguaaggauugucugggcuacaaaagucuuucuaaggcuagacagaugugcaaguccaaaagcuggucguucaccgccgcaauccugacgggguugauccucauggaguuuauuucucccaucgcuggagagaggauguauaagcuggaagaguuagccgacgaguucauuaaacugacugaacaggucaacauacucgaacgggagauggagguucuuaagcaauccaucauugugauguuugcgaucauccugguauugcuacuguucgaaaauaugauuuuuaaccgccucuucucaauauuuuaccgaaguuguagcaugugcggccugauccacuauagaccuggucuuaaaauugaucugacaaagaccaauaaguguggguccugcaucuguggauucaacgagcagcagucuagcggcuuugaauacgagauuuucuugaaagacaugcauauccagaaggaaucaugcaaauucaguccaagggugaaucacuuucggaacauaaaggcccuccuguucgcauuagucaucugugcuacuauuuauacaguguacgccgaugaggacugccuguccaaagacaucaagauuaccuaccaagagcuacacaauugcaucggcccgaagauaauggggaacacguguguuagcaaaaaugaacucuauucugaucuguuuucaaagaaccuugugaccgaguacgacaaaaaguauuucgaacccgauacagucaaugaccaguuuaacaaaauugaguucgcucaggaugcccaucguaugaucuugcuggaacgcauucucuacaagacugagugcgagaugcugagucuuaagaaaaauagcggaccuuauaacguggcauggagaaccuaccugaagaaucacaacaucgacuuguguuccaggcauaacuauaaaaugauaugccaguguaucaauacacacucuaugugcaagaacacugauauugacuacaauaaagaaaucgagaccuacuauaagucgaacgccgcugcguaccgggcagaucucaauacaauuauggacacccugaaaacugccuuucgagguuuaacgaagguacugaucgaaaacuauauagagaaggaugacagcgacgcucuaaaagcccucuucuccaauauuacagauucaguucaagacaacuaccagaugaucggcauccugaaguuugcaaguaaacuuuuggauauuaaucuggggcgcucuaccagaagcgcccaucacuccaucaugacuaacgagauuccaaagucaaaucccuucaccgacuauagcuacucuaacgugaauauaaaagaauguauguccccugagagucucaagugcuuuaagaaaagggauagcacaccacacaccaaccaucuguuauguaagaucgacucuaaauauaaggcuuucgauuggcccgaaauugagacuauccagaaaggacaaaagcugugccuuggcgacucccacuguaauuuggaauuuacagccauuacggcagauaagaucaugucacucaccaacugcuacaaagagaguuucacugcgcagccggcugacaugcagacagguauaaagaaaugcagcgccgaugagaucggggaauguaccacacuggaggacaagacuuggccuauugucuucugcggcggaaaauacuauuacucggauuccaaggaacaugcaaaggacggcucuaucaacaauuauugucuaaccaacaaaugcagcgagcagcgguuucccauucacgaaaauugguucaagaaauguaacugggacaagacgcacaaagaguuuucaaccaugcgccaaaucaauuacaacgauauaacaaguuauagaaaggccauugaguccgaaaucgggucugaccugaugacucaucacuacaaaccaaccaagaaucucccucaugugguccccagguaucacagcaucgaugugcagggaacagaguccacugaagguauuauaaacggcuucauccagaauaccauuccagcuaucucagggcugggaguuggcuaccaucuuaacuuuaaggguaaucaguuguucgacauugugaucuuugucaaaaaggccguauacaaagcacaauaucagaaggcuuacacgacagggcccagcauaaguaucaacauugagcacaaugaacguugcaccggccacuguccugagaaaaucccagccaaggagggauggcugacuuucucuaaggaacauacauccagcuggggcugcgaggaauauggguguuuagcgauugauaccggaugccucuacgguucgugucaggacgugauccggccggagcuggauguuuauaaaaagauaggcucagaggugucucuuauugaaaucugcaucacucugccccacgagaccuacugcaacgacauggauauuuuggaaccuaucauaggggacaaacucagugccuccuuucagaauacacaaacgaaccagcugccaacccuaauugcuuauaagaaaggaaagaucuacacuggccagauuaacgauaucgguaauacagcacugcagugugggagcauacaagucauuaacggcucuaccaucggaacaggcagccccaaguucgacuacaucugccaugccaugcgaagaaaagaugugauuguaaggaaguguuuuaaugacaacuaucaguccugcacucgccucgagaaacggaaugaccugaucccuuacagaaagggggaugugauugaaguuucaaaaaccggaaguaacaugggccagaugacguucaagauagagcuuggugacgucaauuauaagaucuucacaaaaagcauugauuugcaaaugucugggaucugugcuggaugcaucgacugugccgagggcauuuccugcucaauaaacgcagaagugccagcggagaccgugugucacugcaagacuaauugugaagauuuuaucaacaauauugucuucaguccccagaucaaaaacuacaauauuaagguucauugcaaaagcaagguggagaagaucauagcccacaucugcgguagggacauugaucugcaguuaaccgugaaaccguauaaccagaagaucgaccucucccaacuggaugaaucuaauuacauucgcgaggaggaccuucaguguggcacauggcugugcaaaguacagaaggaaggggucgauaucauauuuaaaggacuauucucgggccucgggcgauauuggacuauucugaucuacagcauuaucggagugguuauaaucgugauuuuggucuacauccuguuaccuauuggccggcuccugaaggcuuuucuuauccgucacgagauagaauaugccauggagcagaaaauuaaguga

SEQ ID NO: 11046 - RNA, 4263 nt, Artificial Sequence
  derived and/or modified CDS sequence (opt3) from OROV(BeH759040)__KP691616.1__GP
auggccaaccugaucauuauaagcaugauccucuccguggcuuacggccacccccuuucuaccucacagauuggggacagaugcuucgcaggagguaaucuguuuaaggagaugaacuugagugucggcuuaggggaaaucuguguuaaagaugacauuagcaucgugaaguccacaacuguauucucuaaaaauaggccugcccuggaggcgacgaccaaguuuuaucggucguucauagugaaagauuggucagaaugcaacccaguccuagacaaguuuggaaauuucauggugcucagcguugaugacaacggccauaucaugccgaagauguacacaugucgcgcugccugcgauauucgacugaauaaagacaacgcagagaucauucuuaguuccacuaagcugaaucacuuugaaaucguggguaccacaucuaccagcgggugguucaaaaacacuauaacaaauaacuuggagcauaccugugagcacgucacggugaauugcggacaaaaguccguaaaauuucaugccuguuuccgucagcacagaggcugcauuagguuuuucaagggcacuuauaugcccuacucaaugaucgaagcuauguguguuaacauugagcucaucauccugacccuguauauuuuugcagccauaaucuucgcucucauuaucacaaagaguuacguggccuauuuacugcuuccuuuguucuacccagucacuugguuuuacgggaaaguguauaagaaaauaaauagcugccccaacugucugcuagcgucucacccuuucaccuccugcccaaagauuugcaucuguggaucacgguuuagcugcacagaagcacucaaagugcaucgcauggguaaggauugucugggcuacaaaagucuuucuaaggccagacagaugugcaaguccaaaagcuggucguucaccgcugccauccugacgggguugauucucauggaguuuaucucucccauugcaggagagaggauguauaagcuggaagaguuagcugacgaguucauaaaacugacugaacaggucaacauccucgaacgggagauggagguucuuaagcaauccauuaucgugauguuugccaucauucugguauugcuacuguucgaaaauaugauauuuaaccgccucuucucaaucuuuuaccgaaguuguagcaugugcggccugauucacuauagaccuggucuuaaaaucgaucugacaaagaccaauaaguguggguccugcauuuguggauucaacgagcagcagucuagcggcuuugaauacgagaucuucuugaaagacaugcauauacagaaggaaucaugcaaauucaguccaagggugaaucacuuucggaacaucaaggcgcuccuguucgccuuagucauuugugcaacuaucuauacaguguacgcugaugaggacugccuguccaaagacauuaagaucaccuaccaagagcuacacaauugcauaggcccgaagauuauggggaacacguguguuagcaaaaaugaacucuauucugaucuguuuucaaagaaccuugugaccgaguacgacaaaaaguauuucgaacccgauacagucaaugaccaguuuaacaaaaucgaguucgcccaggaugcucaucguaugauuuugcuggaacgcauccucuacaagacugagugcgagaugcugagucuuaagaaaaauagcggaccuuauaacguggccuggagaaccuaccugaagaaucacaacauagacuuguguuccaggcauaacuauaaaaugaucugccaguguauuaauacacacucuaugugcaagaacacugauaucgacuacaauaaagaaauugagaccuacuauaagucgaacgcagccgcuuaccgggcggaucucaauacaaucauggacacccugaaaacugcauuucgagguuuaacgaagguacugauagaaaacuauauugagaaggaugacagcgacgcccuaaaagcucucuucuccaauaucacagauucaguucaagacaacuaccagaugaucggcauucugaaguuugccaguaaacuuuuggauaucaaucuggggcgcucuaccagaagcgcacaucacuccauuaugacuaacgagauaccaaagucaaaucccuucaccgacuauagcuacucuaacgugaauaucaaagaauguauguccccugagagucucaagugcuuuaagaaaagggauagcacaccacacaccaaccaucuguuauguaagauugacucuaaauauaaggccuucgauuggcccgaaaucgagacuauucagaaaggacaaaagcugugccuuggcgacucccacuguaauuuggaauuuacagcuaucacggccgauaagauaaugucacucaccaacugcuacaaagagaguuucacugcacagccggcggacaugcagacagguaucaagaaaugcagcgcugaugagauuggggaauguaccacacuggaggacaagacuuggccuaucgucuucugcggcggaaaauacuauuacucggauuccaaggaacaugccaaggacggcucuauuaacaauuauugucuaaccaacaaaugcagcgagcagcgguuucccauccacgaaaauugguucaagaaauguaacugggacaagacgcacaaagaguuuucaaccaugcgccaaauaaauuacaacgauauuacaaguuauagaaaggcaaucgaguccgaaaucgggucugaccugaugacucaucacuacaaaccaaccaagaaucucccucaugugguccccagguaucacagcauugaugugcagggaacagaguccacugaagguauaaucaacggcuucauucagaauaccaucccagccauuucagggcugggaguuggcuaccaucuuaacuuuaaggguaaucaguuguucgacaucgugauauuugucaaaaaggcuguauacaaagcccaauaucagaaggcauacacgacagggcccagcaucaguauuaacaucgagcacaaugaacguugcaccggccacuguccugagaaaauuccagcuaaggagggauggcugacuuucucuaaggaacauacauccagcuggggcugcgaggaauauggguguuuagccaucgauaccggaugccucuacgguucgugucaggacgugauacggccggagcuggauguuuauaaaaagauuggcucagaggugucucuuaucgaaaucugcauuacucugccccacgagaccuacugcaacgacauggauaucuuggaaccuauaauuggggacaaacucagugcguccuuucagaauacacaaacgaaccagcugccaacccuaaucgccuauaagaaaggaaagauuuacacuggccagaucaacgauauagguaauacagcucugcagugugggagcauucaagucaucaacggcucuaccaucggaacaggcagccccaaguucgacuacauuugccaugcaaugcgaagaaaagaugugaucguaaggaaguguuuuaaugacaacuaucaguccugcacucgccucgagaaacggaaugaccugauuccuuacagaaagggggaugugauagaaguuucaaaaaccggaaguaacaugggccagaugacguucaagaucgagcuuggugacgucaauuauaagauuuucacaaaaagcaucgauuugcaaaugucugggaucugugccggaugcauugacugugcugagggcauauccugcucaaucaacgccgaagugccagcagagaccgugugucacugcaagacuaauugugaagauuuuauuaacaauaucgucuucaguccccagauuaaaaacuacaauaucaagguucauugcaaaagcaagguggagaagauaaucgcgcacauuugcgguagggacaucgaucugcaguuaaccgugaaaccguauaaccagaagauugaccucucccaacuggaugaaucuaauuacauccgcgaggaggaccuucaguguggcacauggcugugcaaaguacagaaggaaggggucgauauaauuuuuaaaggacuauucucgggccucgggcgauauuggacuauccugauuuacagcaucauaggagugguuaucauugugaucuuggucuacauucuguuaccuaucggccggcuccugaaggccuuucuuauacgucacgagauugaauaugcuauggagcagaaaaucaaguga

SEQ ID NO: 11047 - RNA, 4263 nt, Artificial Sequence
  derived and/or modified CDS sequence (opt3) from OROV(BeH759146)__KP691631.1__GP
auggccaaccugaucauuauaagcauggugcucuccgucgcuuacggccacccccuuucuaccucacagaucggggacagaugcuucgcaggagguaaucuguuuaaggagaugaacuugaguguuggcuuaggggaaauuugugugaaagaugacaucagcauuguaaaguccacaacuguguucucuaaaaauaggccugcccuggaggcgacgaccaaguuuuaucggucguucaucgucaaagauuggucagaaugcaacccagugcuagacaaguuuggaaauuucaugguucucagcguggaugacaacggccauauaaugccgaagauguacacaugucgcgcugccugcgauauccgacugaauaaagacaacgcagagauuauccuuaguuccacuaagcugaaucacuuugaaauugucgguaccacaucuaccagcgggugguucaaaaacacuaucacaaauaacuuggagcauaccugugagcacgugacgguaaauugcugucaaaaguccguuaaauuucaugccugcuuccgucagcacagaggauguauaagguuuuucaagggcacuuauaugcccuacucaaugauugaagcuaugugcgugaacaucgagcucauuauccugacccuguauaucuuugcagccauuauauucgcucucaucauuacaaagaguuacgucgccuauuuacugcuuccuuuguucuacccagugacuugguuuuacggcaaaguguauaagaaaaucaauagcugucccaacugccugcuagcgucucacccuuucaccuccugcccaaagauauguauuugcgggucacgguuuagcuguacagaagcacucaaaguccaucgcaugggaaaggauugccuggguuacaaaagucuuucuaaggccagacagauguguaaguccaaaagcuggucguucaccgcugccauccugacgggcuugauccucauggaguuuauuucucccaucgcaggggagaggauguauaagcuggaagaguuagcugacgaguucauuaaacugacugaacagguuaacauacucgaacgggagauggaggugcuuaagcaauccaucauuguaauguuugccaucauccugguguugcuacuguucgaaaauaugauuuuuaaccgccucuucucaauauuuuaccgaaguugcagcauguguggacugauccacuauagaccuggccuuaaaauugaucugacaaagaccaauaagugcgguuccuguaucugcggguucaacgagcagcagucuagcggauuugaauacgagauuuucuugaaagacaugcauauccagaaggaaucauguaaauucaguccaagggucaaucacuuucggaacauaaaggcgcuccuguucgccuuagugaucugcgcaacuauuuauacaguuuacgcugaugaggacugccuguccaaagacaucaagauuaccuaccaagagcuacacaauuguaucggcccgaagauaaugggcaacacgugcgugagcaaaaaugaacucuauucugaucuguuuucaaagaaccuugucaccgaguacgacaaaaaguauuucgaacccgauacagugaaugaccaguuuaacaaaauugaguucgcccaggaugcucaucguaugaucuugcuggaacgcauucucuacaagacugagugugagaugcugagucuuaagaaaaauagcgggccuuauaacguagccuggagaaccuaccugaagaaucacaacaucgacuugugcuccaggcauaacuauaaaaugauaugucagugcaucaauacacacucuauguguaagaacacugauauugacuacaauaaagaaaucgagaccuacuauaagucgaacgcagccgcuuaccgggcggaucucaauauuaucauggacacacugaaaaccgcauuucgaggauuaacuaagguucugauagaaaacuauauugagaaggaugacagcgacgcccuaaaagcucucuucuccaauaucacggauucagugcaagacaacuaccagaugaucgguauucugaaguuugccaguaaacuuuuggauaucaaucugggccgcucuacaagaagcgcacaucacuccauuaugaccaacgagauaccaaagucaaaucccuucacugacuauagcuacucuaacgucaauaucaaagaaugcauguccccugagagucucaaguguuuuaagaaaagggauagcaccccacacacaaaccaucuguuaugcaagauugacucuaaauauaaggccuucgauuggcccgaaaucgagaccauucagaaagggcaaaagcugugucuuggagacucccacugcaauuuggaauuuacugcuaucacagccgauaagauaaugucacucacgaacugcuacaaagagaguuucaccgcacagccggcggacaugcagacuggcaucaagaaauguagcgcugaugagauuggugaaugcacaacccuggaggacaagacauggccuaucguguucugugggggcaaauacuauuacucggauuccaaggaacaugccaaggacggaucuauuaacaauuauugccuaacuaacaaauguagcgagcagcgguuucccauccacgaaaauugguucaagaaaugcaacugggacaagacccacaaagaguuuucaacgaugcgccaaauaaauuacaacgauauuaccaguuauagaaaggcaaucgaguccgaaaucggcucugaccugaugacacaucacuacaaaccaacuaagaaucucccucaugucgugcccagguaucacagcauugauguucaggggaccgaguccacagaaggaauaaucaacgguuucauucagaauacuaucccagccauuucaggccugggggugggauaccaucuuaacuuuaagggcaaucaguuguucgacaucguaauauuugucaaaaaggcuguguacaaagcccaauaucagaaggcauacaccacgggucccagcaucaguauuaacaucgagcacaaugaacguuguacagggcacugcccugagaaaauuccagcuaaggagggcuggcugaccuucucuaaggaacauacuuccagcuggggaugugaggaauauguuugcuuagccaucgauacaggcugucucuacgggucgugccaggacgugauacggccggagcuggaugucuauaaaaagauuggaucagaggugucucuuaucgaaaucugcauuacccugccccacgagacuuacuguaacgacauggauaucuuggaaccuauaauuggugacaaacucagugcguccuuucagaauacccaaacaaaccagcugccaacgcuaaucgccuauaagaaaggcaagauuuacaccgggcagaucaacgauauaggaaauacugcucugcagugcggcagcauucaaguaaucaacgguucuacaaucgggaccggcagccccaaguucgacuacauuugucaugcaaugcgaagaaaagaugugaucguuaggaagugcuuuaaugacaacuaucaguccuguacacgccucgagaaacggaaugaccugauuccuuacagaaagggagaugucauagaagugucaaaaacuggcaguaacauggggcagaugaccuucaagaucgagcuuggagacgugaauuauaagauuuucacgaaaagcaucgauuugcaaaugucuggcaucugcgccgguuguauugacugcgcugaggggauauccuguucaaucaacgccgaagucccagcagagacaguuugccacuguaagaccaauugcgaagauuuuauuaacaauaucguguucaguccccagauuaaaaacuacaauaucaaggugcauugcaaaagcaagguagagaagauaaucgcgcacauuuguggaagggacaucgaucugcaguuaacugucaaaccguauaaccagaagauugaccucucccaacuggaugaaucuaauuacauccgcgaggaggaccuucagugcggcaccuggcuguguaaagugcagaaggaagguguugauauaauuuuuaaaggccuauucucggggcucggacgauauuggacaauccugauuuacagcaucauaggcguggucaucauugugaucuugguuuacauucuguuaccuaucgggcggcuccugaaggccuuucuuauacgucacgagauugaauaugcuauggagcagaaaaucaaguga

SEQ ID NO: 11048 - RNA, 4263 nt, Artificial Sequence
  derived and/or modified CDS sequence (opt3) from OROV(BeH759620)__KP691622.1__GP
auggccaaccugaucauuauaagcauggugcucuccgucgcuuacggccacccccuuucuaccucacagaucggggacagaugcuucgcaggagguaaucuguuuaaggagaugaacuugaguguuggcuuaggggaaauuugugugaaagaugacaucagcauuguaaaguccacaacuguguucucuaaaaauaggccugcccuggaggcgacgaccaaguuuuaucggucguucaucgucaaagauuggucagaaugcaacccagugcuagacaaguuuggaaauuucaugguucucagcguggaugacaacggccauauaaugccgaagauguacacaugucgcgcugccugcgauauccgacugaauaaagacaacgcagagauuauccuuaguuccacuaagcugaaucacuuugaaauugucgguaccacaucuaccagcgggugguucaaaaacacuaucacaaauaacuuggagcauaccugugagcacgugacgguaaauugcggacaaaaguccauaaaauuucaugccuguuuccgucagcacagaggcugcauuagguuuuucaagggcacuuauaugcccuacucaaugaucgaagcuauguguguuaacauugagcucaucauccugacccuguauauuuuugcagccauaaucuucgcucucauuaucacaaagaguuacguggccuauuuacugcuuccuuuguucuacccagucacuugguuuuacgggaaaguguauaagaaaauaaauagcugccccaacugucugcuagcgucucacccuuucaccuccugcccaaagauuugcaucuguggaucacgguuuagcugcacagaagcacucaaagugcaucgcauggguaaggauugucugggcuacaaaagucuuucuaaggccagacagaugugcaaguccaaaagcuggucguucaccgcugccauccugacgggguugauucucauggaguuuaucucucccauugcaggagagaggauguauaagcuggaagaguuagcugacgaguucauaaaacugacugaacaggucaacauccucgaacgggagauggagguucuuaagcaauccauuaucgugauguuugccaucauucugguauugcuacuguucgaaaauaugauauuuaaccgccucuucucaaucuuuuaccgaaguuguagcaugugcggccugauucacuauagaccuggucuuaaaaucgaucugacaaagaccaauaaguguggguccugcauuuguggauucaacgagcagcagucuagcggcuuugaauacgagaucuucuugaaagacaugcauauacagaaggaaucaugcaaauucaguccaagggugaaucacuuucggaacaucaaggcgcuccuguucgccuuagucauuugugcaacuaucuauacaguguacgcugaugaggacugccuguccaaagacauuaagaucaccuaccaagagcuacacaauugcauaggcccgaagauuauggggaacacguguguuagcaaaaaugaacucuauucugaucuguuuucaaagaaccuugugaccgaguacgacaaaaaguauuucgaacccgauacagucaaugaccaguuuaacaaaaucgaguucgcccaggauagucaucguaugauuuugcuggaacgcauccucuacaagacugagugcgagaugcugagccuuaagaaaaauuccggaccuuauaacguggcuuggagaaccuaccugaagaaucacaacauagacuuguguucuaggcauaacuauaaaaugaucugccaguguauuaauacacacucgaugugcaagaacacugauaucgacuacaauaaagaaauugagaccuacuauaagagcaacgccgcagccuaccgggcugaucucaauacaaucauggacacccugaaaacugcguuucgagguuuaacgaagguacugauagaaaacuauauugagaaggaugacuccgacgcacuaaaagcccucuucucaaauaucacagauaguguucaagacaacuaccagaugaucggcauucugaaguuugcuucuaaacuuuuggauaucaaucuggggcgcagcaccagauccgcccaucacucaauuaugacuaacgagauaccaaagagcaaucccuucaccgacuauucuuacuccaacgugaauaucaaagaauguaugaguccugagagccucaagugcuuuaagaaaagggauucuacaccacacaccaaccaucuguuauguaagauugacuccaaauauaaggcauucgauuggcccgaaaucgagacuauucagaaaggacaaaagcugugccuuggcgacucacacuguaauuuggaauuuacagccaucacggcugauaagauaaugagucucaccaacugcuacaaagagagcuucacugcccagccggcagacaugcagacagguaucaagaaaugcucggcggaugagauuggggaauguaccacacuggaggacaagacuuggccuaucgucuucugcggcggaaaauacuauuacuccgauucuaaggaacaugcuaaggacggcagcauuaacaauuauugucuaaccaacaaaugcucagagcagcgguuucccauccacgaaaauugguucaagaaauguaacugggacaagacgcacaaagaguuuaguaccaugcgccaaauaaauuacaacgauauuacauccuauagaaaggccaucgagucugaaaucgggagcgaccugaugacucaucacuacaaaccaaccaagaaucucccucaugugguccccagguaucacuccauugaugugcagggaacagagucaacugaagguauaaucaacggcuucauucagaauaccaucccagcaauuagcgggcugggaguuggcuaccaucuuaacuuuaaggguaaucaguuguucgacaucgugauauuugucaaaaaggccguauacaaagcucaauaucagaaggccuacacgacagggcccaguaucucuauuaacaucgagcacaaugaacguugcaccggccacuguccugagaaaauuccagcaaaggagggauggcugacuuucuccaaggaacauacaagcucguggggcugcgaggaauauggguguuuagcuaucgauaccggaugccucuacgguucaugucaggacgugauacggccggagcuggauguuuauaaaaagauuggcucugaggugagucuuaucgaaaucugcauuacucugccccacgagaccuacugcaacgacauggauaucuuggaaccuauaauuggggacaaacucuccgccagcuuucagaauacacaaacgaaccagcugccaacccuaaucgcguauaagaaaggaaagauuuacacuggccagaucaacgauauagguaauacagcccugcagugugggucuauucaagucaucaacggcagcaccaucggaacaggcucccccaaguucgacuacauuugccaugcuaugcgaagaaaagaugugaucguaaggaaguguuuuaaugacaacuaucagucaugcacucgccucgagaaacggaaugaccugauuccuuacagaaagggggaugugauagaaguuaguaaaaccggaagcaacaugggccagaugacguucaagaucgagcuuggugacgucaauuauaagauuuucacaaaaucuaucgauuugcaaauguccgggaucugugcaggaugcauugacugugccgagggcauaucaugcaguaucaacgcugaagugccagccgagaccgugugucacugcaagacuaauugugaagauuuuauuaacaauaucgucuucagcccccagauuaaaaacuacaauaucaagguucauugcaaauccaagguggagaagauaaucgcacacauuugcgguagggacaucgaucugcaguuaaccgugaaaccguauaaccagaagauugaccucucucaacuggaugaaucgaauuacauccgcgaggaggaccuucaguguggcacauggcugugcaaaguacagaaggaaggggucgauauaauuuuuaaaggacuauucagcggccucgggcgauauuggacuauccugauuuacucaaucauaggagugguuaucauugugaucuuggucuacauucuguuaccuaucggccggcuccugaaggcguuucuuauacgucacgagauugaauaugccauggagcagaaaaucaaguga

SEQ ID NO: 11049 - RNA, 4263 nt, Artificial Sequence
  derived and/or modified CDS sequence (opt3) from OROV(BeAn19991)__KP052851.1__GP
auggccaaccugaucauuauaagcauggugcucggcgucgcuuacgggcacccccuuuccaccucucagaucggagacagaugcuucgccgguggcaaucuguuuaaggagaugaacuugucaguuggguuaggagaaauuugugugaaagaugacaucaguauuguaaagagcacaacuguguucuccaaaaauaagccugcacuggaggcgacgaccaaauuuuauaggucuuucaucgucaaggauuggucggaaugcaacccagugcuagacaaguuuggcaauuucaugguucucucaguggaugacaacggucauauaaucccgaaaauguacacaugucgggcugccugcgauauucgccugaauaaggacaacgcagagaucauucuuagcaguacuaaacugaaucacuuugaaaucgucgggaccacauccaccucuggaugguucaagaacacuauaacaaauaacuuggagcauaccugugagcacgugacgguaaauugcggccagaaaagcguuaaguuucaugccuguuuccgacaacaccguggcugcauuagauuuuucaaggggacuuauaugcccuacuccaugaucgaagcuaugugugugaacauugagcucaucauccugacccuguauauuuuugcagccauaaucuucgcucucauuaucacaaaaucauacgucgccuauuuacugcuuccuuuguucuacccagugacuugguuuuacggaaagguguauaaaaagauaaauaguugccccaacugucugcuagcgagccacccuuucaccucuugcccaaaaauuugcaucugugguuccagguuuucaugcacagaagcacucaagguccaucggaugggcaaagauugucugggguacaagagccuuaguaaggcccgccagaugugcaaaucuaaguccuggagcuucaccgcugccauccugacgggauugauucucauggaguuuaucucgcccauugcaggcgagagaauguauaaacuggaagaguuagcugacgaguucauaaagcugacugaacagguuaacauccucgaaagggagauggaggugcuuaaacaaucuauuaucguaauguuugccaucauucugguguugcuacuguucgaaaauaugauauuuaacagacucuuccgcaucuuuuaccgauccuguucaaugugcggucugauucacuauagaccugggcuuaagaucgaucugacaaagaccaauagguguggaaguugcauuuguggcuucgacgagcagcagagcuccggcuuugaauacgagaucuucuugaaagauaugcauguccagaaggaaucuugcaaauucagcccacgggugaaccacuuucguaauauaaaggcgcuccuguucgccuuaguuaucugugcaacuauuuauacaguguacgcugacgaggacugccugucaaaagauaucaagauuaccuaccaagagcuacacaacugcaucgggccgaagauaaugggagacacgugugucaguaaauccgaacucuauagcgaucuguuuucuaagaaucuugugaccgaguacgacaaaaaguauuucgaacccgauacaguaaacgaccaguuuaauaaaauugaguucgcccaggaugcucaucgcaugaucuugcuggaacggauucucuacaagacugagugcgagaugcugucacuuaagaaaaacagugguccuuauaauguugccuggaggaccuacuuuaagaaccacaauaucgaccuguguagccggcauaacuauaaaaugauaugccaguguaucaauacacacuccaugugcaagaacacugauauugacuacaacaaagaaaucgagaccuacuauaagucuaaugcagccgcuuaccgagcggauuugaacacaauuauggacacccucaaaacugcauuccgcggccugacgaagguguuaaucgaaaauuauauagagaaggacgauucggacgcccugaaagcucuauuuagcaacauuacagauuccguccaagacaauuaccagaugaucgggauccucaaguucgccucaaaacugcuugauauuaacuugggaagaaguaccaggucugcacaucacagcaucaugacuaaugagauuccaaaguccaaccccuuuaccgacuauucauacagcaaucugaacauaaaagaauguaugucuccugagucccucaagugcuucaagaaacgggauaguacaccacacaccaaucaucuguuauguaagaucgacaacaaauauaaggccuuugauuggcccgaaauugagacuauccagaaaggccaaaagcugugccuuggugacagccacuguaauuuggaguucacagcuauuacggccgauaagaucaugucucucaccaacugcuacaaagaauccuucacugcacagccggcggacaugcaggcugggauaaagaaaugcucagccgaugagaucggcgaauguacaacccuggaggacaagacauggccuauuaucuuuugcggaggcaaauacuauuacagugacagcaaggaacaugcaaaggaugggucgauuaauaacuauugucuaacuaacaaaugcuccgagcagcgcuuccccauccacgaaaauugguuuaagaaauguaacugggacaagacccacaaagaguucucuacgaugagacaaauaaauuacaacgauauuaccagcuauaggaaggccaucgagucagaaaucggaacagaccugaugacucaucacuacaaaccaaccaagaaucucccucauguggucccccguuaucacaguauugaugugcaggguacagaguccacugaaggcauaaucaacggguuuauucagaauaccaucccagcuauuucuggacugggcguugguuaccaucuuaacuucaaggggaaucaguuguuugacaucgugauauucgucaaaaaggccguauacaaagcacaauaucagaaggcuuacacgacaggccccagcaucuccauuaacaucgagcacaaugaacggugcaccggacacuguccugagaaaauuccagccaaggagggcuggcugacuuuuucaaaggaacauacaagcaguugggggugcgaggaauauggauguuuagcgaucgauaccgguugccucuacggcucuugucaggacgugauacgaccggagcuggauguuuauaaaaagauuggguccgaggugagccuuaucgaaaucugcauuacucugccccacgagaccuacugcaacgacauggauaucuuggaaccuauaauuggagacaaacucucggccucauuccagaauacacaaacgaaccagcugccaacccuaaucgcuuauaagaaaggcaagauuuacacuggucagaucaaugauauagggaacacagcacugcaguguggcucuauucaagucaucaacggaaguaccaucggcacagggucccccaaguuugacuacauuugccaugccaugagaaggaaagacgugaucguacgcaaguguuucaaugauaacuaucagagcugcacucggcucgagaaaagaaaugaccugauuccuuacaggaagggagaugugauagaaguuucuaaaaccggcagcaacaugggucagaugacguucaagaucgagcuuggggacauuaauuauaagaucuuuacaaaauccaucgauuugcaaaugucaggaauuugugcuggcugcauagacugugccgaggguaucaguugcagcauuaacgcagaagucccagcggagaccgugugucacugcaagacuaauugugaagauuucaucaacaauauuguguuuucuccccagaucaaaaacuacaauauaaagguccauugcaaauccaagguugagaagaucaccgcccacauuugcggccgcgacaucgaucugcaguuaacaauuaaaccguauaaccagaagaucgaccucucacaacuggaugaaaguaauuacauacgagaggaggaccuucagugugggacuuggcugugcaaagugcagaaggaaggaauugacaucauuuucaaaggccuauuuagcgggcucggacgguauuggaccauccugauauacuccaucauuggcgugguaaucauugucaucuugguguacauacuguuaccuauuggucgucuccugaaggcuuuccuuaucagacacgagaucgaauaugccauggagcagaaaauuaaguga

SEQ ID NO: 11050 - RNA, 4263 nt, Artificial Sequence
  derived and/or modified CDS sequence (opt3) from OROV(Tr9760)__AF312381.2__GP
auggccaaccugaucauuauaagcauggugcucuccaucgcuuacggccacccccuuucuaccucacagauuggggacagaugcuucgcaggagguaaucuguuuaaggagaugaacuugagugucggcuuaggggaaaucuguguuaaagaugacauuagcaucgugaaguccacaacuguauucucuaaaaauaagcuggcccuagaggcgacgaccaaauuuuauaggucguucauagugaaggauuggucagaaugcaacccuguccucgacaaguuuggaaauuucauggugcugagcguugaugacaacggccauacaaucccaaaaauguacacuugucgggcugccugcgauauucgccuuaauaaggacaacgcagagaucauucugaguuccaccaaauugaaucacuuugaaaucguggguacaaccucuacuagcgggugguucaagaacacaauaaccaauaaccucgagcauacgugugagcacgucacugugaauugcggacaaaaauccguaaaguuucaugccuguuuccgacagcaccguggcugcguuagauuuuucaagggcaccuauaugccgcacucaaugauugaagcuaugugugugaacaucgagcugauuauccugacacucuacaucuuugcagccauuauauucgcuuuaaucauuacuaaaaguuaugucgccuaccugcuuuugccccuguucuauccugcgaccugguuuuacgggaagguguacaaaaagaucaauagcugcccaaacugucuacucgcaucucaucccuucacauccugcccuaaaauaugcauuuguggaucaagguuuagcugcaccgaagcccugaaggugcaccggauggguaaagauugucuuggcuauaagagucugucuaaggcucgccagaugugcaaauccaagagcuggucguucacggccgcaaucuugacugggcucauccugauggaguuuauuucuccaaucgcuggagagagaauguacaaauuagaggaacuggccgacgaguucauuaagcucacagaacaggucaacauacuugaaagggagauggagguucugaaacaauccaucauugugauguuugcgaucaucuugguacuacuccuguucgaaaauaugauuuuuaaccggcuguuccgcauauuuuaucgaucauguaguaugugcggccuuauccauuacagacccggucugaagauugauuugaccaagacuaauaggugugggagcugcaucuguggauucgacgagcagcaguccucuggcuuugaauaugagauuuuccucacagauaugcacgugcagaaagaaagcugcaaguucucaccucgggucaaccacuuucguaauaccaaagcccuguuauucgcacuggugaucugugcuacgauauacaccguuuaugccgacgaggacugccuaaguaaggauaucaaaauuacauaccaagagcuccauaacugcaucggcccaaagauuaugggggacacuuguguguccaagagcgaacuguacucugaucuuuuuaguaaaaauuuggucaccgaguaugacaagaaauacuucgaaccggauacagugaacgaccaguuuaauaagaucgaguucgcucaggaugcccaccgcaugauacugcucgaaaggauucuguauaaaacugagugcgagaugcuuagucugaagaagaacagcggacccuacaauguagcauggagaacccauuugaaaaaccacaauaucgaccucuguucccggcauaacuauaagaugauuugccaguguaucaaugcccacucuaugugcaaaaacacagauauagacuacaacaaggaaaucgagaccuauuacaaaucgaaugcugcggcauaccgagccggucugaacacuauuauggauacguuaaagacagcuuuucgcggccugaccaaaguucuaaucgaaaauuauauugagaaggacgacagcgaugcccucaaggcacuguucuccaacaucacugacucagugcaagauaauuaccagaugauagggauucuuaaauuugccaguaaguugcuggacaucaaccucggaagaucuaccaggagcgcucaccauuccaucaugacaaaugagauuccuaaaucaaacccauucaccgauuauagcuacucuaaugucaacaucaaggaauguaugucccccgagagucugaaaugcuuuaagaagcgggacagcacuccucacacaaaucauuuacuguguaaaauugauaacaaguauaaagccuucgacuggccagaaauagagacgauccagaagggccaaaaacuuugcuugggugauucucacuguaaucucgaauuuaccgcaauuacugcggaccgcaucaugucccugacaaacugcuacaaggagucauucaccgcucagcccgccgauaugcaggcagggauuaagaaaugcagugccgacgagaucggcgaauguacaacucuagaggauaagaccuggccgauaguguucugcagcggaaaauauuacuacucggacuccaaggaacacgcuaaagacggcucuaucaauaacuauugucugacgaacaagugcagcgagcagagauuuccuauucaugaaaauugguucaagaaauguaacugggauaagacccacaaagaguuuaggcccuacgagacaaauaacuauaaugacaucacuucauaccguaaggccauugaaagugagaucgggaccgaucucaugacacaucacuauaaaccaacuaagaaccugccucaugucgugccccgguaccacuccauagacguucaaggaaccgaaucuacggaggguauuaucaauggcuucauccagaacacaauuccagcaauaagcgggcuugaugugggauaucacuugaauuuuaaaggcaaccagcuguucgacaucguaauuuuugucaagaaggcuguguacaaagcccaguaccaaaaggcguauaccacuggucccuccaucucaauuaauaucgaacauaacgagcgaugcacagggcacuguccugagaaaauaccagccaaggaaggcugguuaaccuucagcaaagagcauacuucaucuuggggaugcgaagaguacggcugucucgcuaucgauaccgggugccuguauggauccugucaggacguuauuagaccggagcuugauguguacaagaagaucgguagcgaagcaucgcugauugagaucugcauaacauugccccacgaaacguauugcaaugacauggauauucucgagccuaucaucggcgacaaacugucagccucuuuucagaacacccagacuaaucaacuaccaacacugauugcuuacaagaaagggaagaucuauaccggacagauaaacgauauuggcaacacagcccuccagugugguaguauccaggucauuaauggguccacuaucggcaccggaagccccaaauucgacuacauaugccaugcaaugaggcgcaaggacgugauuguacggaaguguuuuaacgauaauuaccaaucuugcacgagacuggagaaaaggaacgaccuuaucccuuaucgcaagggcgaugugaucgaaguuagcaaaacaggguccaauaugggacagaugaccuucaagauugaguugggcgacaucaacuacaaaauuuucacuaagucagucgaucugcagaugagugguauaugugcggggugcaucgacugugccgaaggaauuagcugcucuaucaaugcugaggugccagccgaaaccgugugucacugcaagacaaacugugaggauuuuaucaauaacauugucuucucaccccaaaucaaaaauuauaacauaaagguucacugcaaauccaagguggagaaaauuacugcacauaucugcggccgagacauugauuuacagcucaccgugaagccguacaaucagaagaucgaccugagucagcuugaugaaagcaacuauauacgggaggaagaccugcaaugugguacauggcuaugcaaaguacagaaggagggcaucgacauuauguuuaaaggacucuucuccgggcugggccguuacuggacgaucuugauuuauucuaucauaggggucgugauuaucguuauucugguguacaucuuacucccuauaggaagacugcuuaaggcuuuucugaucaggcacgaaauugaguacgccauggaacagaaaaucaaguga

SEQ ID NO: 11051 - RNA, 4263 nt, Artificial Sequence
  derived and/or modified CDS sequence (opt3) from OROV(TRVL-9760)__KC759123.1__GP
auggccaaccugaucauuauaagcauggugcucuccaucgcuuacggccacccccuuucuaccucacagauuggggacagaugcuucgcaggagguaaucuguuuaaggagaugaacuugagugucggcuuaggggaaaucuguguuaaagaugacauuagcaucgugaaguccacaacuguauucucuaaaaauaagcuggcccuagaggcgacgaccaaauuuuauaggucguucauagugaaggauuggucagaaugcaacccuguccucgacaaguuuggaaauuucauggugcugagcguugaugacaacggccauaucauuccaaaaauguacacaugucgggcugccugcgauauccgccuuaauaaggacaacgcagagauuauccugaguuccacuaaauugaaucacuuugaaauaguggguaccacaucuaccagcgggugguucaagaacacuauuacaaauaaccucgagcauaccugugagcacgucacggugaauugcggacaaaaauccguaaaguuucaugccuguuuccgacagcaccguggcugcaucagauuuuucaagggcacuuauaugccguacucaaugauugaagcuauguguguuaacaucgagcugaucauucugacccucuauauauuugcagccaucauuuucgcuuuaaucauaacaaaaaguuacguggccuaucugcuuuugccccuguucuacccugcgacuugguuuuacgggaaggucuauaaaaagauuaauagcugcccaaacugucuacucgcaucucaccccuucaccuccugcccuaaaaucugcaucuguggaucaagguuuagcugcacagaagcccugaaggugcaucggauggguaaagauugucuuggcuacaagagucugucuaaggcucgccagaugugcaaauccaagagcuggucguucaccgccgcaauuuugacggggcucauccugauggaguuuauuucuccaauagcuggagagagaauguauaaauuagaggagcuggccgcggaauuuaucaagcucacugaacaggugaacauucuugaaagggagauggagguccugaaacaauccaucaucguuauguuugccauuauauuggugcuacuucucuucgaaaauaugaucuuuaaccggcuguuccgcauuuucuaccgaucauguaguaugugcggccuuauccacuauagacccggucugaagauugacuugacaaagaccaauaggugugggagcugcaucuguggauucgaugagcagcaguccucuggcuuugaauacgagauauuccucaaagacaugcauguacagaaggaaagcugcaaauucucaccucgggugaaccacuuucguaauacuaaggcacuguuauucgcucuggucaucugugccacaauuuauaccguguacgcugaugaggacugccuaaguaaagacaucaagauuacguaccaagagcuccacaacugcaucggcccaaagauaaugggggauaccuguguuuccaaaagcgaacuguauucugaccuguuuucaaagaauuuggugacagaguacgauaaaaaguauuucgaaccggacacugucaacgaucaguuuaauaaaauugaguucgcccaggacgcacaucgcaugauccugcucgaaaggauucuguacaagaccgagugcgagaugcuuagucugaagaaaaacagcggacccuauaauguggccuggagaacauacuugaagaaccacaauaucgaucucuguucccggcauaacuauaaaaugauaugccaguguaucaaugcucacucuaugugcaagaacacugacauugauuacaacaaagaaaucgagaccuacuauaagucgaaugcggcagccuaccgagcugaccugaacacaauuauggauaccuuaaaaacugccuuucgcggucugacgaagguacuaaucgaaaauuauauagagaaggacgacagcgaugcacucaaagcccuguucuccaacauuacagacucaguucaagauaauuaccagaugaucggcauccuuaaguuugcuaguaaauugcuggacauuaaccucgggagaucuaccaggagcgcccaucacuccaucaugacuaaugagauuccuaagucaaacccauucaccgauuauagcuacucuaaugugaacauaaaagaauguaugucccccgagagucugaagugcuuuaagaaacgggacagcacaccucacaccaaucauuuacuguguaagaucgauaacaaauauaaggcauucgacuggccagaaauugagacuauccagaaaggacaaaaacuuugcuugggcgauucucacuguaaucucgaauuuacagcgauuacggcugaccgcaucaugucccugaccaacugcuacaaggagucauucacugcccagcccgcagauaugcaggccgguauaaagaagugcagugcugacgagaucggggaauguacaacccuagaggauaaaacauggccgauugucuucugcagcggcaaguacuauuacucggacuccaaagaacaugccaaggacggaucuaucaauaacuauugucugacuaacaagugcagcgagcagagauuuccuauucacgaaaauugguucaaaaaguguaacugggauaaaacccacaaggaguuuucaacgaugaggcaaaucaauuacaacgacauaaccaguuaucguaaagcaauugaguccgaaaucggcacagaucucaugacucaucacuacaagcccaccaaaaaucugccacauguggucccucgguaucacucuaucgacgugcaggggacagagagcacugaaggaauuauaaacgguuucauccagaauaccauucccgcuaucuccggccuugggguuggauaccauuugaacuuuaagggcaaucagcuguucgauauugugaucuuuguaaagaaagccgucuacaaggcgcaauaucagaaagccuacacgacagguccaucaauaagcaucaacauugagcacaaugaacgaugcaccgggcacugucccgagaagaucccugcuaaagagggcugguuaacuuucaguaaggaacauacaucuuccuggggaugcgaggaauauggcugucucgcaauugacaccgggugccuguacggaagcugucaggaugugaucagaccagagcuugacguuuauaagaaaauagguucggaggccucacugauugaaaucugcaucacuuugccgcacgagaccuacugcaacgauauggacauucucgaacccaucauaggcgauaagcugucugcuaguuuucagaauacacaaacgaaccagcuaccuacccugauugccuauaaaaaggggaaaaucuacacuggacagauuaaugacaucggcaacacagcacuccagugugguuccauacaagugauuaacgggagcaccaucggcacaggaucuccaaaguucgauuacaucugccaugcgaugaggcgcaaggacgucauugugcggaaauguuuuaaugacaacuaucagagcugcacuagacuggagaagaggaaugaucuuauccccuaccgcaaaggcgacguaauugaaguguccaagaccgggucaaacaugggacagaugacguucaaaauagaguugggcgauaucaauuauaagauuuucacaaagaguguugaccugcaaaugagcgguaucugugccgggugcaucgauugugcugagggaauuucuugcuccauaaacgccgaagucccugcagagaccgugugucacugcaaaacuaauugugaagacuuuaucaacaauauuguguucucaccacagaucaagaacuacaauauuaaaguccauugcaagaguaaaguugagaagaucaccgcucacauaugcggccgagauaucgacuuacagcucacagugaagcccuauaaccagaaaauugaucugagccaacuugacgaauccaauuacauccgggaggaggaucugcagugugguacuuggcuaugcaaggugcagaaagaaggcauugacaucauguuuaagggacucuucucugggcugggccguuauuggaccauauugauuuacucgaucauugggguagucaucauagugauccugguuuacauuuuacucccgaucggaagacugcuuaaagccuuucugauuaggcacgagaucgaauaugcaauggagcagaagauaaaauga

SEQ ID NO: 11052 - RNA, 4263 nt, Artificial Sequence
  derived and/or modified CDS sequence (opt3) from OROV(TVP-19244/DEI-216)__KP795073.1__GP
auggccaaccugaucauuauaagcaugauccucggcauugcuuacgggcacccccuuuccaccucucagaucggagacagaugcuucgcugguggcauucuguuuaaggagaugaauuugucagugggguuaggagaaaucugugucaaagaugacauaaguaucguuaagagcacaacugccuucuccaaaaacgcgcuggcucuagaggccacgaccaaguuuuauaggucuuucauugugaaagauuggucggaaugcaauccuguacucgacaaguuuggcaacuucauggugcugaaugucgaugacaacggucaucuugugccaaagauguacacaugucgggcagccugcgauauccgccugaauaaagacaacgcugagauuaucuugucaagcacuaagcucaaucacuuugaaauaguugggaccacaaguaccuccggaugguucaaaaacacuauuacaaauaaccuggagcauaccugugagcacgugacggucaauugcggccaaaagucugugaaauuucaugcauguuuccgacagcaccguggcugcaucagauuuuucaaggggacuuauaugccguacagcaugauugaagccauguguguaaacaucgagcugaucauucucaccuuauauauauuugcugccaucauuuucgcgcugaucauaacaaaguccuacauugcauaucuuuugcugccccuauucuacccuguuacuuggcucuacggaaaaguguauaagaggaucaauucaugcccaaacugucugcuugccagucaccccuuuaccagcugcccuaaaaucugcauuugugguucucgguucuccugcacagaagcucugaagguccaucgcaugggcaaagauuguuugggguacaagucacucagcaaagccagacagaugugcaagaguaagucuugguccuuuaccgcagcuauccugacgggauuaauucugauggaguucgugagcccaauagccggcgagaggauguauaaacucgaagaacuugcggacgauuacaucgaacugacugaacaggugaacauuuuggguaaggaaaucaaaauccuaaagcaaucgauuauagucaugcuggccaucauucucauccugcuucugucugagaauauuaucuuuaacuauuuguucuccacacucuaccggucauguaguaugugcgggcugauacacuaucgccccggauuaaaaguugacagcaccaagacuaauaaguguggcuccugcaucuguggcuuugaugagcagcagucuagcggguucgaauacgagguguuucugaaagacaugcauguacagcgagaaucaugcaaguucggaccuagagugaaccacuuuaggaauacaaaaauucuacucuucaccgucgcaaucuguacgaguuuuuacaccguguaugcugacgaggauugccuguccaagaacauucggaucacauaccaagaacuucacaauugcauagguccacauauuaugggcgacacuuguaugagcaaaucugaguuguauucagaucugcucaguaagaaccugaucaccgaguacgacaagaaauauuucgaaccggauacaguuaaugaccaguucaacaagauugaguuugcccaggaugcucaccguaugauccuucuggaacgcauauuguacaaaacugagugcgaaaugcucagccugaagaaaaauuccgggcccuauaacguggccuggagaaccuacuuaaagaaucauaacaucgaccuguguucuaggcacaauuacaagaugauuugccaguguaucaacacacauucgaugugcaaaaacaccgauauugacuucaauaaggagaucgagacuuauuacaaagcaaacgccgcugcguaucggagcgauuuuaauacgauaauugacacacuaaagaccgcauuccgaggacucacuaaaguccugaucgaaaacuacaucgagaaggacgauuccgacgcccuuaaagcauuguuuucaaauauuaccgauagugugcaagacaacuaucagaugguaggcguucugaaguucgccucuaagcuccugaauaucagcuuaggucgcacaaccagauccgcacagcacucaauuaugacuaacgaaauaccuaaaagcaauccauuuacagauuacucuuauuccagugugaacaucaaggaguguaugagccccgagucucugaaaugcuucaagaaaagggacuccgccccucacaugaaucaucuuuuguguaagauggauaacaaguacaaggcuuuugacuggccagaaauugagacgguccaaaaagggcagaaacucugccugggcgauucacacuguaaucuagaguucaccgccaucacugcagacaagauuaugagucugacaaacugcuacaaagagagcuuuaccgcgcagcccgcugauaugcagacaggaaucaagaagugcucggccgacgaaauaggcgaguguaucacucucgaggauaaauccuggccgauuguguucugcggggacaaguauuacuauucugacggaaaagaacaugcaaaggaugguagcaucaauaacuacugucuggccaacaaaugcucagagcaacgguuuccuauucacaagaauugguucaagaaauguaacugggacaagacccacaaagaguucacgaccaugcgccagaucaauuauaacgauauaacaaguuacagaaaggcuauugaguccgaaaucggcacugaccuuaugacccaucacuauaaacccacaaagaauuugccacaugucgugccuagguaccacucuaucgauguucaggggacugagagcaccgagggaauuauaaacggcuuuauccagaauacgauucccgccaucuccggucugggggugggcuaccauuuaggauucaaaggcaaccaacucuuugacauuguaaucuucgucaagaaggcaguguauaaagcucaguaccagaagguuuauacaaccgggccaucaauaagcaucaauauugaacacaacgagaaaugcacuggacacugucccgaaaagaucccugccaaagaggguuggcugacauuuaguaaggaacauaccucuuccuggggcugcgaggaguacgggugucuugcgauugauacuggaugccuguauggcagcugucaggacgugauccguccagaauuggauauauacaagaaaauugguucggaggccucacucaucgaaaucugcauuacccugccgcacgagacauauugcaaugacauggauauccuagagcccauaauuggggacaagcugucugcuaguuuccaaaacacgcagaccaaucagcucccuaaccugauggcauacaaaaagggcaaagucuacacuggacagaucaaugaugugggcaacacagcccuucaauguggguccauucagguagugaacggaagcaccaucggcucugguaauccaaaguuugacuauauaugccaugcuaugcggcgaaaggacguuauugucagaaaauguuucaacgauaauuaccagagcugcacaagguugaacccccgcaaugaccugaucccuuaucggaagggggauaucauugaaaucuccaaaacuggaucaaacaugggccaaaugaccuuuaagauugaguuaggugacauaaauuacaaaaucuucacgaagaguguggaucuccagaugagcggcauuugugccgggugcaucgacugugcagaaggaaucucuugcuccauuaacgcggaugugucagccgagacagucugucacugcaagaccaauugugaagacuuuauaaguaacaucguuauuagcccacagaucaaaacuuauaauauuaaggugcauugcaaauccaaggugaaaaagaucaccgcuaacauaugcggcagaaauaucgaucugcagcuuacaguaaagcccuacaaccagaaaauugaccugucucaacuagaugagucgaauuauaucaaggaggaagaccuccagugugggacuuggcugugcaaaguccagaaggagggaauugacaucguguucaaaggcuuguucagcggucuggggaaguacugggccauauuaauuuacucaaucauuggaaucauaguugugauccuccugauuuauguccuucugccgaucggcagguugcucaaagcauuucugauuaagaacgaaaucgaguacaccauggaacaaaagauaaaauga

SEQ ID NO: 11053 - RNA, 4263 nt, Artificial Sequence
  derived and/or modified CDS sequence (opt3) from OROV(TVP-19249/GML-444672)__KP795076.1__GP
auggccaaccugaucauuuucagcauaauccucggcauugcuuacgggcacccccuuuccaccucucagaucggagacagaugcuuugccgguggcucacuguucaaggagaugaauuugagugugggguuaggagaaauuugugucaaagaugacaucagcauaguuaaguccacaacugcauuuucuaaaaacacgcuggcgcuagaggcuaccacaaaguucuauaggucguuuaucgugaaagauuggucagaaugcaauccuguacucgacaagcugggcaacuucauggugcuuaaugucgaugacaacggucaucuggugccacggauguacacuugucgcgccgcaugcgauauucgauugaauaaggacaacgccgagaucauucucagcaguaccaaacugaaucacuuugaaaucguugggacaaccuccacuucuggaugguucaagaacacaauaaccaauaaccuggagcauacgugugagcacgugacugucaauugcggccaaaagagcgugaaguuucaugcuuguuuccgucagcacagaggcugcauuagguuuuucaaagggaccuauaugccguacuccaugaucgaagcaauguguauuaacaucgagcucaucauuuuaacacuguauauauuugccgcuaucauuuucgcccuuaucauaacuaagucauacauugcguauuugcugcuaccccucuucuacccuguaaccuggcuguacggaaagguuuauaaacggaucaauaguugcagcaacugucuucuggcaucucacccauuuacauccugccccaagaucugcauuugugguucacgcuucagcugcaccgaagccuugaaagugcauagaaugggcaaggauugucucggguacaaaagucugucuaaggcuaggcagaugugcaaauccaagagcuggucguuuacggccgcaaucuuaacuggacugauucucauggaguucgucucuccuauagcuggcgagcggauguauaaacuugaggaacuggccgacgauuacaucgaaauggcggagcgcguggguauguuggaaaaagagauuaaggugcuaaaacaguuuacaaucgucaugcugguuaucauucucauacugcuucuguucgagaacaccaucuuuaauuauuuguucaacacucucuaccgauccuguucaaugugcgggcugauucacuauagaccaggauuaaagguggaccugacaaaaaccaauaaguguggcaguugcaucuguggcuuugaugaacaacagagcuccggguucgaguacgaaguauuucuaaaggacaugcauauucagagggagucuugcaaauucggaccccgggugaaccacuuucguaauacgaagauccuccuguucaccauagccaucuguacaucauucuacacugucuaugcagacgaagauugccuuagcaaaaacauuaagaucaccuaccaggaguugcacaauugcauugguccuuauaucaugggcgacacaugugugaguaaauccgagcuguacagcgaucuccugucuaagaaccuuauaacugaauaugacaagaaauacuuugagccagauaccguuaaugaccaauucaacaagauugaauuugcucaggaugcccaucgcaugauccuguuggagaggauucucuauaaaacagaaugcgagaugcugucauuaaagaaaaauagugggccguacaacguggcuuggagaaccuaccugaagaaucacaacaucgaccuauguagccggcauaauuauaagaugauaugccaguguaucaacaugcacuccaugugcaaaaacacugauauugacuucaauaacgagaucgaaacguacuauaaggccaaugcagccgcuuaccgaucugauuuuuauacaauuaucgacacccucaaaacugcguuccgcggacugaccaagguccuuauagagaacuacauugaaaaagacgauucggacgcauugaaggcccuguuuagcaauaucacaaacuccgugcaggauaauuaucaaaugguaggcguucucaaauucgcuucaaagcuguuaaacaucagucuggguagaucuaccaggagcgcccagcauuccauuaugacuaaugagauccccaagucaaacccuuuuacagacuacagcuacucuuccgugaauauuaaagaguguaugaguccagaaagccuuaagugcuucaaaaagcgggauucugucccccacacgaaccacuugcucuguaaaauggacaauaaguauaaggcauuugauuggccugagauagaaaccgugcagaaagggcaaaagcugugccuaggcgacucccauuguaaccuggaguucacugccaucacagcugauaaaauuaugucacucaccaauugcuacaaggaaaguuuuacagcccagccagcagacaugcagacuggaaucaaaaagugcagcgcggaugagauuggcgaguguaucacccuggaagacaaggcuuggcccauagucgugugcggggauaaauauuacuauucggacggaaaggagcacgccaaagacgguuccaucaacaacuacugucuugcaaauaagugcucugaacagcgcuucccgauucauaaaaacugguucaagaaguguaauugggauaaaacgcacaaggaguuuaccacaaugagacaaaucaacuauaaugacauuacuagcuacaggaaagccaucgaaucagagauaggcaccgauuugaugacacaccauuacaagccuacuaaaaaccugccccacguugugccacguuaucauaguauugacguacaggggaccgaguccacggaaggaaucaucaauggcuucauucagaacacaauaccugcuaucucugguuuaggggucggcuaccaccucggauuucggggcaaucagcuguucgauauugugaucuuuguuaagaaagccguguauaaggcacaauaccagaaggucuauaccacugggcccagcauuuccaucaacauagagcauaaugaaaaaugcacaggacacuguccagagaagauccccgcuaaagaagguuggcuuaccuucucaaaggagcacacuagcaguuggggcugcgaggaauacgggugucuggccauugacaccggaugcuuguauggcucuugucaggaugugauccgaccugagcucgacauuuacaaaaagaucgguuccgaagcgagccugauagagauuugcaucacacuaccacaugagacguacugcaacgauauggacauccuggaaccgauuaucggggauaagcucucggccucauuucagaauacccaaacuaaccagcugcccguacuuauggcuuauaaaaagggcaaaguguacacaggacagauaaaugacguuggcaacaccgcauugcagugugggucuauucaagucgugaacggaaguacaaucggcuccgguaauccuaaguucgauuauauuugccacgccaugagaaggaaagacgugaucguccgcaaguguuuuaacgacaauuaccagagcugcacucggcuggaugcuagaaacgacuuaauaccauauaggaagggggauauuaucgagaucucuaaaaccggaagcaauaugggccagaugacguucaagauugaacucggugacaucaacuacaaaauuuuuacaaaguccguugaucugcaaaugucaggcauaugugccgggugcaucgacugugcagagggaauuaguugcagcaucaaugcggaugugucugccgaaaccgugugucauugcaaaacuaacugugaggacuucaucuccaauauuguaauaucaccccagaucaagaccuauaacauuaagguccacugcaaaaguaagguggagaaaaucacagcuaauauuugcggccgcaacaucgaucuucagcugacuguuaagccuuacaaucagaaaauagaccuaagccaacucgaugaauccaacuacaucaaggaggaagaccugcagugugggaccugguugugcaaggugcagaaagagggaauugacaucgucuucaagggccuguuuucugguuuagggaaauauuggacaauucucaucuacucgauaauuggaaucauugugaucguucugcuuauauaugugcuguugccaaucggccgacuccugaaggccuuccuaauuaaaaaugaaaucgaguacacgauggagcagaagauuaaauga

SEQ ID NO: 11054 - RNA, 4263 nt, Artificial Sequence
  derived and/or modified CDS sequence (opt3) from OROV(TVP-19254/GML-480914)__KP795082.1__GP
auggccaaccugaucauuauaagcauggugcucuccgucgcuuacggccacccccuuucuaccucacagaucggggacagaugcuucgcaggagguaaucuguuuaaggagaugaacuugaguguuggcuuaggggaaauuugugugaaagaugacaucagcauuguaaaguccacaacugccuucucuaaaaauaagccugcgcuggaggcuacgaccaaauuuuauaggucguucaucgugaaggauuggucagaaugcaacccaguccuagacaaguuuggaaauuucauggugcucagcguugaugacaacggccauauaaucccgaaaauguacacaugucgggccgcaugcgauauucgccugaauaaggacaacgccgagaucauucuuaguuccacuaaacugaaucacuuugaaaucguggguaccacaucuaccagcgggugguucaagaacacuauaacaaauaacuuggagcauaccugugagcacgucacggugaauugcggacaaaaauccguaaaguuucaugcuuguuuccgacagcaccguggcugcauuagauuuuucaagggcacuuauaugcccuacucaaugaucgaagcaauguguguuaacauugagcucaucauccugacccuguauauuuuugccgcuauaaucuucgcccucauuaucacaaaaaguuacguggcguauuuacugcuuccuuuguucuacccagucacuugguuuuacgggaagguguauaaaaagauaaauagcugccccaacugucugcuagcaucucacccuuucaccuccugcccaaaaauuugcaucuguggaucaagguuuagcugcacagaagcccucaaggugcaucggauggguaaagauugucugggcuacaagagucuuucuaaggcucgccagaugugcaaauccaagagcuggucguucaccgccgcaauccugacgggguugauucucauggaguuuaucucucccauugcuggagagagaauguauaaacuggaagaguuagccgacgaguucauaaagcugacugaacaggucaacauccucgaaagggagauggagguucuuaaacaauccgugauuguaaugcuggcgaucaucuuggugcuacugcucuuugaaaauaugauuuucaaccggcuguuucgcauauucuaccgaucauguaguaugugcggccuuauccacuauagaccuggucugaagauugauuugacaaagaccaauaggugugggagcugcaucuguggauuugacgagcagcaguccucuggcuucgaauacgagauuuuucucaaagauaugcauauccagaaggaaagcugcaaauucucaccacgggucaaccacuuccguaauauaaaggcccuguuauuugcacuggugaucugugcuacuauuuauacaguuuacgccgacgaggacugccuaaguaaaaacaucaagauuaccuaccaagagcuccacaauugcaucggcccgaagauaaugggggauacguguguguccaaaagcgaacuguauucugaccuuuucucaaagaacuuggucaccgaguacgauaaaaaguauuuugaacccgacacaauuaaugaucaguucaacaaaaucgaguuugcucaggacgcccaucgcaugauucugcucgaaagaauccuguacaagacugagugcgagaugcuuagucugaagaaaaauagcggaccuuauaacguggcauggaggaccuacuugaagaaucacaacauagaucucuguucccggcauaauuauaaaaugaucugccaguguauuaacacacacucuaugugcaagaacacugacaucgauuacaauaaagaaauugagaccuacuauaagucgaacgccgcugcguaccgagcagaccugaauacaaucauagauaccuuaaaaacugccuuccgcggucugacgaagguacuaauugaaaacuauaucgagaaggacgacagcgaugcucucaaagcccuguuuuccaauaucacagacucaguucaagauaacuaccagaugauuggcauccuuaaguucgcaaguaaauugcuggacauuaaucucgggagaucuaccaggagcgcccaucacuccauaaugacuaacgagaucccaaagucaaaucccuuuaccgauuauagcuacucuaacgugaauauuaaagaauguauguccccugagagucugaagugcuucaagaaacgggacagcacaccacacaccaaccauuuacuguguaagaucgauaauaaauauaaggcuuuugacuggcccgaaauugagacuauccagaaaggacaaaaacuuugcuugggcgauucucacuguaaccucgaguucacagccauaacggcagacaagaucaugucccugaccaauugcuacaaggaaucauuuacugcgcagccggcugauaugcaggccgguauuaagaaaugcagugcagacgagaucggggaauguacaacccuagaggauaagacauggccuauugucuucugcggcggaaaauacuauuacagcgacucgaaggaacaugccaaggacggcuccaucaacaacuauugucugacuaauaaaugcucugagcagcgcuuccccauacacgaaaacugguuuaagaaauguaauugggauaagacccacaaagaguucagcacgaugaagcaaauuaacuacaaugacaucaccucauauagaaaagcuaucgagagugaaauugggacagaucucaugacucaucacuacaagccaaccaagaaccugccucaugugguccccagguaucacuccauagacgugcagggaacagagucuacugaaggucuuaucaauggcuuuauucagaacaccaucccagccauuagcggguugggaguuggcuaccaucugaauuucaaagguaaccaguuauuugauaucgugauauucguaaagaaagcagucuacaaggcucaauaucagaaagccuacacgacagggcccuccaucucaauuaauaucgagcacaacgaacguugcaccggccacuguccugagaagauuccagcgaaggagggauggcucacuuuuagcaaagaacauacaaguucuuggggcugcgaggaauaugggugucuggccaucgacaccggaugccuuuacgguuccugucaggaugugauacggccggagcuggacguuuauaagaaaauuggcagcgaggugucguugaucgaaaucugcauuacucucccccacgagaccuacugcaaugauauggacauccuggaaccuauaauuggggauaagcuaucagcuucuuuccagaacacacaaacgaaucagcugccaacccucaucgcauauaaaaagggaaagauuuacacuggccagaucaacgacauagguaacacagcccugcagugugggaguauucaagucaucaauggcuccaccaucggaacaggcagccccaaauuugauuacauuugccaugcuaugcgaagaaaggacgugaucguaaggaaauguuucaacgacaauuaucagucuugcacucgccuugagaagcggaacgauuugauuccuuacagaaaaggggacgugauagaaguuagcaagaccggauccaauaugggccagaugacguuuaagaucgagcugggugauauuaacuauaaaaucuucacaaagucaaucgacuuacaaaugagugggauuugugccggaugcauagauugugcagagggcaucagcugcucuauuaaugcggaagucuccgccgagaccgugugucacugcaaaacuaacugugaagacuucaucaauaacauuguguuuucaccacagaucaagaauuacaacauaaaaguccauugcaagaguaagguugagaaaaucauugcucacaucugcgguaaggauauugaccuccagcugaccgugaaacccuauaaucagaagaucgaucuuagccaacuggacgaauccaacuacauaagggaggaggaucuacaguguggcacauggcucugcaaagugcagaaggaagggauugacaucauuuucaaaggacuguuuucuggcuuggggcgcuauuggacuauccugauauacucgaucauuggaguagucaucauugugaucuuaguuuacauacuccugccgauuggccgacuucugaaggccuucuugauccggcacgagaucgaauaugcaauggagcagaagauuaaauga

SEQ ID NO: 11055 - RNA, 4263 nt, Artificial Sequence
  derived and/or modified CDS sequence (opt3) from OROV(TVP-19256/IQE-7894)__KP795085.1__GP
auggccaaccugaucauuauaagcaugauccucggcauugcuuacgggcacccccuuuccaccucucagaucggagacagaugcuucgcugguggcucacuguuuaaggagaugaauuugagugugggguuaggagaaauuugugucaaagaugacaucagcauaguuaaguccacaacugccuucucuaaaaacgcgcuggcucuagaggccacgaccaaguuuuauaggucguucaucgugaaagauuggucagaaugcaauccuguacucgacaaguuuggcaacuucauggugcugaaugucgaugacaacggucaucuugugccaaagauguacacaugucgggcagccugcgauauucgccugaauaaagacaacgcugagguuaucuugagcaguacuaagcucaaucacuuugaaauuguggggaccacauccaccucuggaugguucaaaaacacuaucacaaauaaccuggagcauaccugugagcacgucacggugaauugcggccaaaagagcguaaaauuucaugcauguuuccgacagcaccguggcugcauaagauuuuucaagggggccuauaugccguacuccaugauugaagcuauguguguuaacaucgagcugauuauccucacuuuauauaucuuugccgcgauuauauucgcacugaucauuaccaagucauacaucgccuaucuuuugcugccccuauucuacccugugacauggcucuacggaaaagucuauaagaggauaaauaguugcccaaacugucugcuugcuagccaccccuuuacuucuugcccuaaaauuugcaucugugguucccgguucucaugcaccgaagcccugaaggugcaucgcaugggcaaagauuguuugggguacaagagccucaguaaagcaagacagaugugcaagucuaaguccuggagcuuuacagcugccauccugaccggauuaauucugauggaguucgugucgccaaucgcgggcgagaggauguauaaacucgaagaacuugccgacgauuacauugaacuggcagagcaggucaacauauuggguaaggaaaucaaaauucuaaagcaaucuaucaucguuaugcuggcuauuauacucauccugcuucuguccgagaauauuaucuuuaacuauuuguucaaaacgcucuaccggucauguaguaugugcgggcugauucacuaucgccccggauuaaagguggaccugacuaagacaaauaaauguggcagcugcaucuguggcuuugaugagcagcaguccucuggguucgaauacgagguauuucuaaaggacaugcaugugcagcgagaaagcugcaaauucggaccuagagucaaccacuuuaggaauaccaagauacuccuguucacuaucgccauuuguacaucauuuuacaccguguaugcugacgaggauugccuuaguaaaaacauccggauuacguaccaagaauugcacaauugcaucgguccacauauaaugggcgacaccuguauguccaagagcgagcuguauucugaucuccugucaaagaaccuuauuacagaguacgacaaaaaguauuucgaaccggauacuguuaaugaccaguucaacaaaaucgaguuugcccaggaugcacaccguaugauucuguuggaacgcauccucuacaagaccgagugcgaaaugcugagucugaaaaagaauagcgggcccuauaacguggccuggagaacauacuuaaagaaucauaacauagaccuauguuccaggcacaauuacaaaaugaucugccaguguauuaacacucauucuaugugcaagaacaccgauaucgacuucaauaaagagauugagacauauuacaaggcuaacgcggcagccuaucggucggauuuuaauaccaucauagacacucucaaaacggcuuuccgaggacugacaaagguccuuauugaaaacuacaucgagaaagacgauagcgacgccuugaaggcacuguuuuccaauaucaccgauucagugcaagacaacuaucagaugguaggcguucucaaguucgccaguaaacuguuaaauauuucucugggucgcacuaccagaagcgcucagcacuccaucaugacaaacgaaauuccuaagucaaauccauuuaccgauuacagcuauucuuccgugaacauaaaagaguguaugagucccgagagccuuaagugcuucaaaaagagggacucugucccucacacuaaucauuugcucuguaagauggauaacaaauacaagguguuugacuggccagaaaucgagacaguccaaaaagggcagaagcugugccuaggcgauucccacuguaaucuggaguucacggccauuaccgcagacaaaaucaugucacucacuaacugcuacaaggagaguuuuacagcgcagcccgcugauaugcagaccggaauuaagaaaugcagcgccgacgaaaucggcgaguguauaacacuggaggauaagucguggccgaucguguucugcggggacaaauauuacuauuccgaaggaaaggagcaugcaaaagacgguucuauuaauaacuacugucuugccaacaagugcagcgaacaacgguuuccuauccacaagaauugguugaaaaaguguaacugggauaaaacucacaaggaguucaccacgaugcgcagaauuaauuauaacgacaucaccucauacaggaaagcuauagaaagugagauuggcacagaucugaugacucaucacuauaagcccaccaaaaauuuaccacauguugugccucguuaccacuccaucgacguacaggggacagagucuacugaaggaaucauuaacggcuucauacagaauaccauccccgccauuagcggucucggggucggcuaccaucugggauuuaagggcaaccagcuuuucgauaucgugauuuuuguuaagaaagcaguguauaaggcucaauaccagaaagucuauacgacagggccauccaucucaauaaauaucgagcacaacgaaaagugcaccggacacugucccgagaaaauuccugccaaggaagguuggcugacuuucagcaaggagcauacaaguucuuggggcugcgaggaauacggguguuuggcgaucgacaccggaugccucuauggcuccugucaggaugugauucggccagagcuggacaucuacaaaaagauagguagcgaagccucgcuaauugagaucugcaucacucugccgcacgagaccuauugcaaugauauggacauucucgaacccaucauaggggauaaacugucagcuucuuuucagaacacacaaacgaaucagcuuccuaacuugauggcauacaagaaaggcaagguauacaccggacagauuaaugacgugggcaacacugcccugcagugugggaguauccaaguugucaacggauccacaauuggcagcgguaauccaaaguucgauuauaucugccaugcuaugcgaagaaaagacgugauagugaggaaguguuuuaacgacaauuaccagucuugcacccgcuuagauccccggaacgaccucauuccuuauagaaaaggggauaucgucgagaucagcaagacaggauccaauaugggccagaugacuuucaaaauugaacugggugacaucaacuacaagauuuuuaccaagucaguugaucuucaaaugaguggcauaugugccgggugcaucgacugugcagagggaauuagcugcucuaucaaugcggaugccuccgcugaaacggugugucacugcaaaacaaacugugaggacuucaucucaaauauugugauaaguccacagaucaagaccuauaacauuaaaguacauugcaagagcaaagucgagaagaucacugccaauauuugcggcaggaacaucgaucugcagcuaaccgugaagcccuacaaucagaaaauagaccucucccaacuggaugaaucuaacuauaucaaggaggaagacuugcagugugggacauggcugugcaaaguucagaaggagggaauugacaucguguuuaaaggcuuauucucgggucucgggaaguacugggcaauucugaucuacagcauaauuggagucaucgugguuauucuucugaucuauguguugcucccgauaggccgccugcuaaaagcauuccugaucaagaaugaaauugaguacacuauggagcagaagaucaaauga

SEQ ID NO: 11056 - RNA, 4263 nt, Artificial Sequence
  derived and/or modified CDS sequence (opt3) from OROV(TVP-19257/IQT-1690)__KP795088.1__GP
auggccaaccugaucauuauacccaugauccucggcauugcuuacgggcacccucuuagcaccucccaaaucggagacagaugcuucgcugguggcucucuguuuaaggagaugaauuugucagugggguuaggagaaauuugugucaaagaugacaucaguauaguuaagagcacaacugccuucuccaaaaacgcgcuggcucuagaggccacgaccaaguuuuauaggucuuucaucgugaaagauuggucggaaugcaauccaguacucgacaaguuuggcaacuucauggugcugaaugucgaugacaacggucaucuugugccgaagauguacacaugucgggcagccugcgauauucgccugaauaaagacaacgcugagaucauuuugucaagcacuaagcucaaucacuuugaaaucguugggaccacaaguaccuccggaugguucaaaaacacuauaacaaauaaccuggagcauaccugugagcacgugacggucaauugcggccaacgaucugugaaguuucaugcauguuuccgucagcacagaggcugcauuagguuuuucaaagggacuuauaugcccuacagcaugaucgaagccauguguguaaacauugagcugaucauccucaccuuauauauuuuugcugccauaaucuucgcgcugauuaucacaaaguccuacauagcauaucuuuugcugccucuauucuacccaguuacuuggcucuacggaaagguguauaaacggauuaauucaugccccaacugucugcuugccagucacccuuuuaccagcugcccaaagaucugcaucugugguucucgcuucuccugcacagaagcucugaaaguccauagaaugggcaaggauuguuugggguacaaaucacucagcaaggccaggcagaugugcaaaaguaagucuugguccuuuaccgcagcuauucugacgggauuaauccugauggaguucgugagccccauugccggcgagcggauguauaagcucgaagaacuugcggacgauuacauagaacuggccgaacaggugaacaucuuggguaaagaaauuaagauccuaaaacaaucgaucauugucaugcuggcaauaauccucauucugcuucugucugagaauaucauuuuuaacuauuuguucaauacucucuaccgcuccuguucaaugugcgggcugauccacuaucgaccuggauuaaagguugaccugacaaaaaccaacaaguguggcaguugcauauguggcuuugaugagcagcagagcuccggguucgaauacgagguguuucuaaaggacaugcauguacagagagaaucuugcaaauucggaccaagggugaaucacuuucggaacacuaagauccuccuguucauuaucgcuauuuguacaucauuuuacaccgucuaugccgacgaggauugccuuagcaaaaauauccguauaacguaccaagaauugcacaacugcauugguccgcauaucaugggcgacaccuguaugaguaaguccgagcuguauagcgaucuccugucuaaaaaucuuauuacagaguacgacaagaaguauuucgaacccgauacugugaacgaccaguucaauaaaaucgaguuugcucaggaugcccaccgcaugauacuguuggaaagaauccucuacaagaccgagugcgaaaugcugucauuaaagaaaaacagugggccuuauaauguugcauggaggacauaccugaaaaaccauaauauugaccuauguagccggcacaacuacaagaugaucugccaguguauuaacacucauuccaugugcaagaauaccgauaucgacuucaacaaagagauagagacauauuacaaggccaaugcugcggcauaucgaucugauuuuaacaccauuaucgacacucucaaaacggccuuccgcggacugacaaaggugcuuaucgaaaauuacauugagaaagacgauucggacgcuuugaaggcccuguuuagcaacaucaccgauuccguccaagacaauuaucagauggugggcguacucaaauucgcaucaaagcuguuaaacauuagucuggguagaacuaccaggucugcccagcacagcauaaugacaaaugaaaucccaaaguccaaccccuuuaccgauuacucauauagcucuguuaauauuaaagaguguauguccccugagagucuuaagugcuucaaaaagcgggacagcgcuccacacacuaaccauuugcucuguaaaauggauaauaaguacaaggccuuugacuggcccgaaaucgagacagugcaaaaagggcagaagcugugccuaggcgauucucacuguaaccuggaguucacggcaauuaccgcggacaaaaucaugucccucacuaauugcuacaaggagucauuuacagcucagccggccgauaugcagaccggagucaaaaagugcagugcagacgaaauaggcgaguguaucacacuggaggauaagagcuggccuauuguguucugcggggacaaauauuacuauucggacggaaaggaacaugccaaagaugguuccaucaacaacuacugucuugcuaauaagugcucugagcaacgcuuucccauucacaaaaacugguucaagaaguguaauugggacaaaacucacaaggaguucaccacgaugagacagaucaacuauaaugauauaaccagcuacaggaaagccauugagucagaaaucggcacagacuugaugacucaucacuauaagccaaccaaaaaccugccucaugucgugccccguuaccacaguaucgauguucaggggacagaguccacugagggaauuauaaauggcuuuauccagaacaccauuccagcaaucucugguuuaggggugggcuaccaucucggauucaagggcaaucaacuguuugacauuguaaucuucgucaaaaaggcuguguauaaggcccaguaccagaaaguuuauacgacagggcccagcauauccaucaacauugaacacaaugagaagugcaccggacacuguccugagaaaaucccagcgaaggaagguuggcuuacuuuuucaaaagaacauacaagcaguuggggcugcgaggaguacgggugucuggccauugauaccggaugcuuguauggcucuugucaggacgugauccggccggaacucgauauauacaagaagauugguuccgaggcuagccugcuagaaaucugcaucacucugccccacgagaccuauugcaacgacauggauauucucgagccuaucauaggggacaaacugucggcaucauuccaaaauacacagacgaaccagcuuccaaauuugauggccuacaagaaaggcaaggucuacaccggacagauuaacgaugugggcaacacugcucugcaaugugggucuauccagguagugaauggaaguacaauuggcuccgguaaccccaaauuugacuauaucugccaugccaugcgaagaaaggacguuauagucaggaaguguuucaaugauaacuaccagagcugcacccgcuuagacccucggaaugaucucauuccauauagaaaaggggacaucaucgaaauuucuaagacaggaagcaacaugggccaaaugacuuuuaaaaucgagcugggugauauuaauuacaagauauucaccaaauccguggaccuucagaugucaggcaucugugcagggugcauugauugugcggaaggaaucaguugcagcaucaacgccgacgugucugcugagacggucugucacugcaagacaaauugugaagauuuuauuuccaacauaguuaucucaccccagauuaagaccuauaauaucaaagugcauugcaagaguaaaguggagaagauuacugccaacaucugcggcaggaauauagaccugcagcuaaccguaaaaccguacaaccaaaagaucgaucucagccagcuggacgaguccaauuauauuaaggaagaggacuugcagugugggacauggcugugcaaaguccagaaggaaggaaucgauauuguguucaaaggcuuauucucuggucucgggaaguacugggcaauccugauauacucgauuaucggaauuaucguugugauacuucugaucuaugucuugcucccuauuggccgccugcuaaaagcauuucugaucaagaacgagauugaauacacuauggagcagaaaaucaaguga

SEQ ID NO: 11057 - RNA, 4263 nt, Artificial Sequence
  derived and/or modified CDS sequence (opt3) from OROV(TVP-19258/IQT-4083)__KP795091.1__GP
auggccaaccugaucauuauaagcaugauccucggcauugcuuacgggcacccccuuuccaccucucaaaucggagacagaugcuucgccgguggcucacuguuuaaggagaugaauuugagugugggguuaggagaaauuugugucaaagaugacaucagcauaguuaaguccacaacugcauucucuaaaaacgcgcuggcucuagaggccacgaccaaguuuuauaggucguucaucgugaaagauuggucagaaugcaauccuguacucgacaaguuuggcaacuucauggugcugaaugucgauaacaauggucaucuugugccaaagauguacacaugucgggcagccugcgacauucgccugaacaaagauaaugcugagaucauuuugagcaguacuaagcucaaccacuuugaaaucguugggaccacauccaccucuggaugguucaaaaauacuauaacaaacaaucuggagcauaccugugagcacgugacggucaacugcggccaaaagagcgugaaauuucaugcauguuuccgacagcaccgugccugcauuagauuuuucaagggcacuuauaugccguacuccaugaucgaagcuauguguguaaauauugagcugaucauccucaccuuauauauuuuugccgcgauaaucuucgcacugauuaucacaaagucauacauagccuaucuuuugcugccccuauucuacccugcuacuuggcucuacgggaaaguuuauaagaggauuaacaguugcccaaacugucugcuugccagccaccccuuuaccucuugcccuaaaaucugcaucuguggaucccgguucucaugcacagaagcacugaaggugcaucgcauggguaaagacuguuugggcuacaagagccucaguaaagcuagacagaugugcaagucuaaguccuggagcuuuaccgccgcgauucugacgggguuaauccugauggaguucgucucgccaauugccggagagaggauguauaaacucgaagaacuugcagaugacuacauagaacugacugaacaggugaauaucuugggcaaggaaauuaaaauccuaaagcaaucuaucauugugaugcuggcuauaauccucauucugcuucuguccgagaacaucauuuuuaauuauuuguucaacacacucuaccggucauguaguaugugcggucugauccacuaucgccccggguuaaaagucgaucugaccaagacuaauaaguguggaagcugcauauguggcuuugacgagcagcaguccucuggcuucgaauacgagguuuuucuaaaagauaugcaugugcagcgagaaagcugcaaguucgggccuagaguaaaccacuuuaggaauacaaaaauccuccuguucaccauugccaucuguacgucauuuuacaccguguaugcugacgaggacugccuuaguaagaacauucggaucacauaccaagaauugcacaauugcauaggaccacauauuaugggugauacuuguaugccgaaauccgagcuguauagcgaccuccugucuaagaaccuuaucaccgaguacgauaagaaauauuucgaacccgacacagucaaugaucaguucaacaagauugaguuugcccaggacgcacaccguaugauccuguuggaacgcauacucuacaaaacugagugcgaaaugcugucauuaaagaaaaauaguggcccuuauaacguggccuggagaaccuaccugaagaaucauaacaucgaucuauguagcaggcacaacuacaagaugauuugccaguguaucaauacacauuccaugugcaaaaacaccgacauugauuucaauaaggagaucgagacuuauuacaaagcuaacgcggcagccuaucggucugacuuuaauacgauaauugauacacucaagaccgcuuuccgagggcugacuaaaguucuuaucgaaaacuacaucgagaaggacgacucggaugccuugaaagcacuguuuagcaauauuaccgacuccgugcaagauaacuaucagauggucggagugcucaaguucgccucaaagcuguuaaauaucagucugggccgcacaaccagaucugcucagcacagcauuaugacuaacgaaauaccaaaauccaaucccuuuacagacuacucauauagcucuaucaacauuaaggaguguauguccccugagagucuuaaaugcuucaagaaaagggauagcgccccacacacgaaucauuugcucuguaagaucgacaacaaguacaaagcauuugauuggcccgaaauugagaccguacaaaagggucagaaacugugccuaggggacucucacuguaaucuggaguucacugcgaucacagcugauaagauaaugucccucaccaacugcuacaaagagucauuuacagcccagccggcagacaugcagacuggcaucaagaagugcagugccgaugaaauuggagaguguaucacccuggaggacaaaagcuggccuauuaucuucugcggcgauaaguauuacuauucggacgggaaagaacaugcuaaggacggauccauaaacaauuacugucuugccaacaaaugcucugagcaacgguuucccauucacaagaauugguucaagaaauguaacugggauaagacgcacaaagaguucaccacaaugcgccagaucaauuauaacgacaucacuagcuacagaaaggcaauugagucagaaauagguaccgauuugaugacacaucacuauaaaccaacuaagaaucugccucauguugugcccagguaccacaguaucgacguccagggcaccgaguccacggaggggauuaucaacggauuuauucagaauacaaucccagcuauaucuggcuuaggugugggguaccaucucggcuucaaaggaaaccaacuguuugauaucgucauuuucgugaagaaggccguuuauaaagcgcaguaccagaagguguauaccacuggccccagcaucuccauuaauaucgaacacaacgagaaaugcacagggcacuguccugaaaagauaccagccaaagagggauggcuuaccuuuucaaaggaacauacuagcaguugggguugcgaggaguacggcugucuggcuauugacaccgggugcuuguauggaucuugucaggauguaauccguccggaacucgacaucuacaagaaaauuggcuccgaggcaagccugaucgaaauaugcauuacacuaccccacgagacguauugcaaugauauggacauccuggagccuauuaucggugauaagcucucggccucauuccaaaacacccagacuaaucagcugccaaaccuuauggcuuacaaaaaggggaaagucuacacaggccagauaaacgacgugggaaauaccgccuugcaauguggcucuauucagguugugaacgggaguacaaucggauccggcaaucccaaguuugauuauaucugccaugcaaugcggcgaaaggacgucauugugagaaaauguuucaacgacaauuaccagagcugcacuaggcuggauccucgcaacgacuuaaucccauaucggaagggugauauuauagaaaucucuaaaaccgggagcaauaugggacaaaugacguuuaagauugagcucggcgacaucaacuacaaaaucuucacaaaguccguagaucugcagaugucagguauuugugcgggcugcauagacugugccgaagggaucaguugcagcauuaaugcugaugugucugccgagaccguuugucacugcaagacuaacugugaagacuuuaucuccaauauugucaucucaccccagauaaaaaccuauaacaucaaggugcauugcaaaaguaagguggagaaaauuacagcaaauaucugcgagagaaacauugaucuucagcugacugucaagccguacaaucaaaagaucgaccuaagccagcucgaugaauccaacuauauaaaagaggaagaccugcaguguggaaccugguugugcaagguucagaaagagggcauugacaucguguucaaggggcuguucucuggauuaggcaaauacugggcuauucucaucuacucgauaaucgguauuaucgugguaauucugcuuaucuauguccuguugccuauagggaggcuccugcgcgccuuucuaauuaagaaugaaaucgaguacacaauggagcagaaaaucaaguga

SEQ ID NO: 11058 - RNA, 4263 nt, Artificial Sequence
  derived and/or modified CDS sequence (opt3) from OROV(TVP-19259/IQT-7085)__KP795094.1__GP
auggccaaccugaucauuauaagcaugauccucggcauugcuuacgggcacccccuuuccaucucucagauuggagacagaugcuucgccgguggcucacuguuuaaggagaugaauuugagugugggguuaggagaaaucugugucaaagaugacauaagcaucguuaaguccaccacagcauucucuaaaaacgcgcuggcucuagaggccacuacgaaguuuuauaggucguucauugugaaagauuggucagaaugcaauccuguacucgacaaguuuggcaacuucauggugcugaaugucgaugacaacggucaucuugugccaaagauguacaccugucgggcagccugcgauauccgccugaauaaagacaacgcugagauuaucuugagcaguacaaagcucaaucacuuugaaauaguugggacuaccuccacaucuggaugguucaaaaacaccauuacuaauaaccuggagcauacaugugagcacgugaccgucaauugcggccaaaagagcgugaaauuucaugcauguuuccgacagcaccguggcugcaucagauuuuucaaggggacguauaugccguacuccaugauugaagccauguguguaaacaucgagcugaucauucucacuuuauauauauuugcugccaucauuuucgcgcugaucauaaccaagucauacauugcauaucuuuugcugccccuauucuacccuguuacauggcucuacggaaaaguguauaagaggaucaauaguugcccaaacugucugcuugccagccaccccuuuacuucuugcccuaaaaucugcauuugugguucccgguucucaugcaccgaagcucugaagguccaucgcaugggcaaagauuguuugggguacaagagccucaguaaagccagacagaugugcaagucuaaguccuggagcuuuacagcagcuauccugaccggauuaauucugauggaguucgugucgccaauagccggcgagaggauguauaaacucgaagaacuugcggacgauuacaucgaacuggccgaacaggugaacauuuuggguaaggaaaucaaaauccuaaagcaaucuauugucguuaugcuggcaauaauccucauucugcuucuguccgagaauaucauuuuuaacuauuuguucaauacgcucuaccggucauguaguaugugcgggcugauccacuaucgccccggauuaaaaguggaccugacuaagacaaacaaguguggcagcugcauauguggcuuugaugagcagcaguccucuggguucgaauacgagguauuucuaaaagacaugcaugugcagcgagaaagcugcaaguucggaccuagagucaaucacuuuaggaacaccaaaauccuccuguucacuauugcuaucuguacaucauuuuacaccguguaugccgacgaggauugccuuaguaagaauauucggaucacguaccaagaauugcacaacugcauagguccacauauuaugggcgacaccuguauguccaaaagcgagcuguauucugaucuccugucaaagaaucuuaucacagaguacgacaagaaauauuucgaaccggauacuguuaacgaccaguucaauaagauugaguuugcucaggaugcccaccguaugauccuguuggaacgcauacucuacaaaaccgagugcgaaaugcugaguuuaaagaaaaacagcgggcccuauaauguggcauggagaacauaccugaagaaccauaauaucgaccuauguuccaggcacaacuacaagaugauuugccaguguaucaacacucauucuaugugcaaaaauaccgauauugacuucaacaaggagaucgagacauauuacaaagccaaugcugcggcauaucggucggauuuuaacaccauaauugacacucucaagacggccuuccgaggacugacaaaaguccuuaucgaaaauuacaucgagaaggacgauagcgacgcuuugaaagcccuguuuuccaacauuaccgauucagugcaagacaauuaucagaugguaggcguucucaaguucgcaaguaagcuguuaaacaucucucugggucgcacuaccagaagcgcccagcacuccauuaugacaaaugaaauaccuaaaucaaacccauuuaccgauuacagcuauucuuccgugaauaucaaggaguguaugagucccgagagccuuaaaugcuucaagaaaagggacucugcuccucacacuaaccauuugcucuguaagauggauaauaaguacaaagccuuugacuggccagaaauugagacaguccaaaaggggcagaaacugugccuaggcgauucccacuguaaccuggaguucacggcaaucaccgcggacaagauuaugucacucacuaauugcuacaaagagaguuuuacagcucagcccgccgauaugcagaccggaaucaagaagugcagcgcagacgaaauaggcgaguguaucacacuggaggauaaaucguggccgauuguguucugcggggacaaguauuacuauuccgacggaaaagaacaugccaaggaugguucuaucaacaacuacugucuugcuaauaaaugcagcgagcaacgguuuccuauucacaagaacugguucaagaaauguaauugggacaagacucacaaagaguucaccacgaugcgccagaucaacuauaaugauauaaccucauacagaaaggccauugagagugaaaucggcacagacuugaugacucaucacuauaaacccaccaagaaccugccacaugucgugccuagguaccacuccaucgauguucaggggacagagucuacugagggaauuauaaauggcuuuauccagaacaccauucccgcaaucagcgguuuaggggugggcuaccaucucggauucaaaggcaaucaacuguuugacauuguaaucuucgucaagaaggcuguguauaaagcccaguaccagaagguuuauacgacagggccauccauaucaaucaacauugaacacaaugagaaaugcaccggacacugucccgaaaagaucccugcgaaagaggguuggcuuacuuuuagcaaggaacauacaaguucuuggggcugcgaggaguacgggugucuggccauugauaccggaugcuuguauggcuccugucaggacgugauccguccagaacucgauauauacaagaaaauugguagcgaggcuucgcugaucgaaaucugcauuacucuaccgcacgagaccuauugcaacgacauggauauccuggagcccauaauuggggacaagcucucagcaucuuuccaaaauacacagacgaaccagcugccuaaucuuauggccuacaaaaagggcaaagucuacaccggacagaucaacgaugugggcaacacugcuuugcaaugugggaguauucagguagugaauggauccacaaucggcagcgguaacccaaaguuugacuauauaugccaugccaugcggcgaaaggacguuauugucagaaaauguuucaaugauaacuaccagucuugcaccaggcuggacccccgcaaugauuuaaucccuuaucggaagggggacaucauugaaaucagcaaaacaggauccaacaugggccaaaugacuuuuaagauugagcucggugauauaaauuacaaaaucuucaccaagucaguggaccugcagaugaguggcauuugugcagggugcaucgauugugcggaaggaaucagcugcucuauuaacgccgacguguccgcugagacggucugucacugcaagacaaauugugaagauuuuauaucaaacaucguuauuaguccacagaucaaaaccuauaauauuaaggugcauugcaaaagcaagguggagaaaaucacugccaacauaugcggcagaaauaucgaccuucagcugaccguaaagcccuacaaccaaaagauugaucuaucccagcucgacgagucuaauuauaucaaagaagaggaccugcagugugggacaugguugugcaagguccagaaagaaggaauugauaucguguucaagggccuguucucggguuuagggaaauacugggcaauacucauuuacagcaucauuggaguuaucguggucauacugcuuaucuaugugcuguugccgauuggcaggcuccugaaggcuuuucuaaucaaaaacgagauugaauacacuauggagcaaaagaucaaguga

SEQ ID NO: 11059 - RNA, 4263 nt, Artificial Sequence
  derived and/or modified CDS sequence (opt3) from OROV(TVP-19262/OBS-9478)__KP795100.1__GP
auggccaaccugaucauuauaagcaugauccucggcauugcuuacgggcacccccuuuccaccucucagaucggagacagaugcuucgccgguggcucacuguuuaaggagaugaauuugagugugggguuaggagaaauuugugucaaagaugacaucagcauaguuaaguccacaacugcauucucuaaaaacgcgcuggcucuagaggccacgaccaaguuuuauaggucguucaucgugaaagauuggucagaaugcaauccuguacucgacaaguuuggcaacuucauggugcugaaugucgauaacaauggucaucuuauuccaaagauguacacaugucgggcagccugcgacauccgccugaacaaagauaaugcugagauuaucuugagcaguacuaagcucaaccacuuugaaauaauugggaccacauccaccucuggaugguucaaaaauacuaucacaaacaaucuggagcauaccugugagcacgugacgguuaacugcggccaaaagagcgugaaauuucaugcauguuuccgacagcaccguggcugcauuagauuuuucaaggggacuuauaugccguacuccaugaucgaagccaugugugucaauaucgagcugauuauacucaccuuauauaucuuugcugccauuaucuucgcgcugauaauuacaaagucauacaucgcauaucuuuugcugccccuauucuacccugccacuuggcucuacggaaaaguguauaagaggaucaacaguugcccaaacugucugcuugcuagccaccccuuuaccucuugcccuaaaauuugcaucugugguucccgguucucaugcacagaagcccugaagguacaucgcaugggcaaagacuguuugggguacaagagccucaguaaagcaagacagaugugcaagucuaaguccuggagcuuuaccgcugccauucugacgggauuaauacugauggaguucguuucgccaaucgcgggcgagaggauguauaaacucgaagaacuugccgaugacuacauugaacugacugaacaggugaauaucuuggguaaggaaaucaaaauucuaaagcaaucuauaaucgucaugcuggcaauuauccucauucugcuucuguccgagaacaucauauuuaauuauuuguucaacacacucuaccggucauguaguaugugcgggcugauccacuaucgccccggauuaaaaguggaucugaccaagacuaauaaguguggcagcugcauuuguggcuuugacgagcagcaguccucuggguucgaauacgagguguuucuaaaagauaugcauguccagcgagaaagcugcaaguucggaccuagaguuaaccacuuuaggaauacaaaaauccuccuguucaccauugcuaucuguacgucauuuuacaccguguaugccgacgaggacugccuuaguaagaacauacggauuacauaccaagaauugcacaauugcaucgguccacauauuaugggcgauacuuguaugccgaaauccgagcuguauagcgaccuccugucuaagaaccuuaucaccgaguacgauaagaaauauuucgaacccgggacaguaaaugaccaguucaacaagauagaguuugcucaggaugcccaccguaugauccuguuggaacgcauucucuacaaaacugagugcgaaaugcugucauuaaagaaaaauaguggaccuuauaacguggcauggagaaccuaccugaagaaucauaacaucgaccuauguagcaggcacaacuacaagaugauuugccaguguaucaauacacauuccaugugcaaaaacaccgauauagacuucaauaaggagauugagacuuauuacaaagccaacgcugcggcauaucggucugauuuuaauacgaucaucgacacacucaagaccgccuuccgaggccugacuaaaguccuuauugaaaacuacaucgagaaggaugacucggacgcuuugaaagcccuguuuagcaauauuaccgauuccgugcaagacaacuaucagaugguuggugugcucaaguucgcaucaaagcuguuaaauauaagucuggggcgcacaaccagaucugcccagcacagcaucaugacuaacgaaauuccaaaauccaaucccuuuacagauuacucauauagcucuaucaacauuaaggaguguauguccccugagagucuuaaaugcuucaagaaaagggacagcgcuccacacacgaaucauuugcucuguaagaucgauaacaaguacaaagccuuugacuggcccgaaauagagaccguccaaaagggccagaaacugugccuaggagauucucacuguaaucuggaguucacugcaaucacagcggacaagauuaugucccucaccaacugcuacaaagagucauuuacagcucagccggccgauaugcagacuggcaucaagaagugcagugcagacgaaauuggggaguguaucacccuggaggauaaaagcuggccuauaauuuucugcggagacaaguauuacuauucggaugguaaagaacaugccaaggacggcuccaucaacaauuacugucuugcuaacaaaugcucugagcaacgguuucccauccacaagaauugguucaagaaauguaacugggacaagacgcacaaagaguucaccauuaugcgccagauaaauuauaacgauaucacaagcuacagaaaggccauugagucagaaaucgggacugacuugaugacccaucacuauaaaccaacaaagaaucugccucaugugguacccagguaccacaguauugauguucagggaacugaguccaccgagggcaucauaaacgguuuuauccagaauacgauuccagcaaucucuggguuaggcgugggauaccaucucggcuucaaagggaaccaacuguuugacauugucaucuucgugaagaaggcugucuauaaagcccaguaccagcguguguauacaaccggacccagcauauccauuaauaucgaacacaacgagaagugcacuggucacuguccugagaaaaucccagcgaaggaaggcuggcuuacauuuucaaaagaacauaccagcaguugggggugcgaggaguacggaugucuggccauugauacuggcugcuuguaugguucuugucaggacguuauccggccggaacucgauauauacaagaagauuggguccgaggcuagccugaucgaaauuugcaucacccuaccccacgagacauauugcaaugacauggauauacuggagccuauuaucggcgacaaacucucggcaucauuccaaaacacgcagaccaaucagcugccaaaccuuauggccuacaagaaaggaaagguguacacuggccagaucaacgauguagggaauacagcuuugcaauguggaucuauucaggucgugaacggcaguaucauugguuccgggaaucccaaauuugacuauauaugccaugccaugcgaagaaaggauguuaucgugaggaaguguuucaacgacaauuaccagagcugcacccgccuggacccucggaacgauuuaauuccauauagaaaaggagacaucaucgaaauuucuaagacaggcagcaauaugggucaaaugacuuuuaaaauagagcucggcgauaucaacuacaagauuuucaccaaauccgucgaccugcagaugucagggaucugugcaggaugcauugauugugcggaaggcaucaguugcagcauaaaugccgacgugucugcugagacgguaugucacugcaagacaaacugugaagauuuuaucuccaauauugugaucucaccccagauuaagaccuauaacaucaaaguucauugcaagaguaaagucgagaagauaacugccaauauuugcgagaggaacaucgaccuucagcugaccgugaaaccguacaaucaaaagauugaucuaagccagcucgacgaauccaacuauaucaaggaggaagaucugcagugugggacaugguugugcaaagugcagaaggagggaauagacaucgucuucaaaggccuguucucugguuuagggaaguacugggcaauucucaucuacucgauuaucggaauaauuguugugauccugcuuaucuaugugcuguugccuauuggccgccuccugcgagcuuuucuaaucaaaaaugaaauagaguacacuauggagcaaaagauuaaauga

SEQ ID NO: 11060 - RNA, 4299 nt, Artificial Sequence
  derived and/or modified CDS sequence (opt3) from OROV/FPV(Aus Ch 16129)__KF697137.1__GP
augaaguucgugagcauccugcucuuugucuccuggcuuggcgccaccuaccagaaccccguuucucacagacaaauuggggagaggugcuucgcuggagguucacugauaaaaacagugaaucagacgaguggcguaagcgaaguguguguccgggacgauaucuccaugauuaagucuaucgugcauacuaccaaagcaucggacacagccguuaacaauuauauucgcuuuuaccgaguguucaucgucaaggaguggcacgauugcaacccuuuuccagacccgaaagggacuuucaugguguuggauguaucaagcaccaaucauuuagaacccauaacauauaccugucguacuccuugcgagaucacacuggacaaggauagugcggaaguuacccuauccucucagaagaugaaccacuacgagauuagcggauccacgaucaauaacggcugguuuaaaaauucaauuagugugagccucgagcauacuugugaacacaucaccgucucuugcggucagaagacagugagauuccacgcuuguuuuaggcaacaucgguccugcacucgcuucuuuaaaaacucaaugaugccagccagaaugaccgagagcauaugucagaaucuggaaauuauccuucugacaugcuucaguuuuguguguuucauuuucuugugcaucaucaccaagacguaugucgcauacguucucauucccguguuuuauccuuucacuuacauauacgggaggcuguaugacaaauacuuuaagcugugcgagaacugucucuuagccguacacccauucacacccugcgagaccgugugugucugcggaucucaguaugcuaauacugaacagcugcggacacaucgcaugaccaacaauuguaagggcuacaaaucccuuagcaagucgcgagcaaugugcaaaucuaagggcuguuccuuugugguugccaucuucugcucaauuaucuuuuucaguuuuauaacgccuauuaacagccaagaguauaaauuguccgaucugccagacgaguucaccagacuagaggaagagaacacaaugcucaagaucaggcugcuugugaucaaaauuacuaucucugucauuagcgugaccauaacaguaacuucacugaccgagcggaagguuuuucaggaauuguucaaugcuaucuaccgucacuguccguuuugcgggaugauucaccgcagaaggggacuccggguggucaacaguacaaccaauaagugugguacuugcaucugcggcuauaaagaggaaacggagcaugggguggaauacgagaucuuccugaagacaaugcaccaggagaacgucaauuguauguucaaacccucccagcgacauuuucgcaacuucaagauuuuaauagccuuucuggcgaugugcaugaucauuaccagcgugucugcagaugaaaaacacugucucaaguacaaggagccuguuaaacuuucaaaucugacugaaugccauaguuuguggcuaaacaucaccgagugucaaauuaaucagagcacacuguucgaaacccucaagggagagcagcuggugacugacuuugauaaaccagacuucacaaucaugggccaaaaguaugacauagccauggagagaaucgaaaacgcucagaaucuucaccacaugauucuguuggaguaccuccaugccaaauccaacugccugaaguauaagcaguuaaaaucuaauucgggucccuacaacaucccuuggaggacguauauucacgggcauggacuggauguauguggccaguacagcuauaagcuaaucugcaaauguauauccaccggcaugcacugcgaaaauacugcacucgacauuuacaacgagaugcggcaauuuuacacaaacaaucaggagaacuauaaucuggaucuuaacaccgucaucaaggcuauuggguuggccaugcgcggaaucggucagaugauaaucgaagaguucuuuggcgaaucacagauugaggaacugaguaauuuccucaacaugacaucuaaaaaucuggggacuaacaagcaacuuaucggacugauuaauuuuggcuugaugcuccuggacaucaaccagaccaagacgccacagauagaucccaaaccgagaaccuuacaggcgaggagcuccauuccuacagguacugagaucaccgacuggacaaaggggcaaucaaaaaucaagacuugugccgaguacagcacccugacgugccagucuuggcguaaaacagugaauaccaaguccuuccuaaugugcaaaguuaguagcaaguggcacguguauaacuggcccgaaauuccaacugucgugagaaauucuaagcucugucugggcgauuaccauugcaacauggaguuuacaccuaucgacgcagaugaagcucuuaaacaguugcgauguuauaagaccgaguucguacccuccccagacggaauggaugaaucaauuaaaaagugcacucuggagaaauucggcggguguaccacagccaauggacacaguuggacgauaauggugugcaacgguagauacuaucagaccaacacuagggagcaugcuaaggacggccuccugaauagcuacuguuuugaacccaagugccaaucggggcgccacccuauccauaaauccuucuuaaacaauuguauuuggaaggagucuagccggcagaucauugaaacaagaaccaucgaguacaacaauauagaagacuauaaaaagucaguugagagugauaucaaauccgaccugacaauucaccacuuuaagccaacuaagaaccuuccguuggucacccccacguacaucucugugguggccgauggaacaauggucagcgacggcauucagaaugcauauguuaaagguaccaucccugggauauccggcguggccacuggacuccaugugaagaccccagauggcauucugcuaauggacaucaucguauacgucaggaaagcucuguauaaggcgaacuacgagaaaauuuauucaacagggcccacuauaggaaucaaugugaagcacaacgaaaagugcaccgguacauguccugagcauauuccaaaagaugaaggcuggcucacguucagcaaggagcacaccaguaauugggggugcgaggaauacggaugcuuugcaaucaacucuggcugucuguacgguuccugccaagacauuauccgccccgagcuugauauauauaaacagcagggggaagaacagacuuugcuggaauuauguaucacacucccgcaugagaccuucugcaaugaccuggauguucuugagccugugauuacugacaagcugcaauuggauuuucagacaacccagagcgaccaccucccagaacuggucgcccugaaaaagggccuaauccucacgggacagcugaacgaccuuggcaauacugcugccaugugugggucggugcaauugguuaacaaaaccauuuacggacagggcaaccccaaguucgauuuuaucugccacgcaaugcgacggaaggacgugauaguacguagauguuaugauaaucauuacucaacaugcgcccuguuaaaacagaggaacgaccuccugcacaaggaggucaaugaucagaugucuauuaccgugaacgguaaaaaucuugggcugaucaacuuccgccuaaaucucggagaccugaacuauaaguuguuugugaaugaaccuaacuucgagcugacuggccaaugugcugguugcaucaguugugccgaugaaauuuccugccaguuaaauaucauagcagaccaugaguucacaugcaaagucagcucuagcuguaaccucuacauuuccaauaugaugaucacccccgcgaaccacauuuauaaucugaagguuucaugccgggagcacgugaguaacaucgaucuugcuguauguggccggagcuuuucucugcaugccacauugaagcagcacucccaaaaacucgaccugucagcacuagaugaaacuaauuucgugaaggaggaagaccugaggugcgggaccuggcuuuguaaagucaaggaugagggacucaguuuucugacgcgaagcauauucggcuccuuggggacauacuggucuuacuuuauuuauggacugaucuucaugaucuuacucuuuauugccaucuacuuccuguauccacuuugcaaacgccugaagggcuugcucgaagagaacgagcgggaauaccugauugagucgaagaugaaauga

SEQ ID NO: 11061 - RNA, 4257 nt, Artificial Sequence
  derived and/or modified CDS sequence (opt3) from OROV/IQTV(IQT9924)__KF697143.1__GP
auggacugcaucauuuucuaccugagcuuuuucgccguggucaccgcucaccccguuucccaucaccaggugggcgauagauguuuugcagggggaaaccucauaaaggaccuuaauaaaacaguaaacaucggugaggugugcgucagggaugacauuucuaucauuaagucaacuacggccauccagaaaagucuggaucauuugagcacccggacaaaguucuaucgcguguacauaguuaaagaaugggcggaguguaauccuaucauugacuaugcuggcaacuuuaucgugaugaauauugaugacaacgggcacuuagucccacgaaugcauacuugccgugccuccugugauaucagacugaauaagaacgacgcagaaauaauucuaucuucgcagaagaccaaucacuacgagaucauuggaacaaccacugugucaggcugguucaaaaacacaaucaaucucccgcuggaacauaccugcgagcacaucacgguaaacuguggucaaaagagccuuagguuucacgccugcuuccggaugcaucgcggguguacuagauuuuucaaaaauaccuauaugcccaguacaaugauugagcacaugugcguuaaccuggaauugauaaucuuuacucucuacauuuucaccgcucugguguuugcauauaucauaacaaaguccuacauugccuacauccugcucccuuuauucuauccacugaccuacgucuucggaaucauuuauucuaaacuuaagcaguguaagacgugcauguuggcugcccaccccuuuacuaauugcccuaaaaggugugugugcggcagccgguucaacuguacagaggcgcugcgcgugcaucgacuaggcagagauugccaaggguacaagucccucucaaaagcaaggcagauguguaagaguaaaagcuggucuuuuaucauugccauauucaccggacugauccuuauggaauuuauuacuccaauccacggugagcggacauauaagcuguccgaguuggcugacgaguucaucgccaugaaaaccgaagucacgguuaugcagcguucaauuuacaaccagaagauacucaauaucgcacuguuaacccuggugguacucauuauccuucuggaaacauauauuuuuaagaucuuguucagccuacuguaccgcaguugcucuauguguggccucauacauuacaaaguggggcugaagaucaaccuucugacuaccaauaaaugcggaacauguauuugcggcuuuuccgagcaacagagcucggguuucgaauaugaggucuuuuugaaggauaugcacaaacagagagagucuuguaaguacuuccccaugcucaaccauuuuaggaaucugaagaucuuaacuaccauucugcuacucauccugcuugcuacauccgugucaagugaaugcuugcagaaaccucugaagauaaaacucgaggaccugcacgaaugcauugggguuaacuuccuugacaagcaauguuauaaucggaaaaaccuguacgagagcuugcgauccaagaaucucaucucugaaguggauaagaaauauuucgagaacgccgaccuggagggacaguuuaagcgcauugaauacgcgcaggaugcccacagaaugaucuuacuggagaggauacuauauagcaccgaaugcgagaugcauacuauccucacgaauggcggcgcauacaacauuccauggcggacauaccugaaaaaucacaaccuuaauuugugugggaagcauguccacaaaauggugugccaauguguaaacacccacacucagugccugucaaccggaaucgacuaucaggaugaaauuacaaaguucuaccaggcugacggugauaguuaucgcuccgaccucagcaucauacuggagaccauuucuacugccuuuagaggcuuaacaaagguucugaucgagacguacaucgaacaagauaacucagagaguaugauuaaacuuuugaauaccauccaggggaaggugccgaacaauuaucagaugcucggcauucugaaauucgcuauaaagaucaugaacauuaaucagacuaggggaguccguagcgcccggcauacaaucguguccaacgacauucccaugucugaaccuuuuucgaauuucgaggucagcaacaucaauauaaaacaaugucuagagccacugacccucaagugcuuuacaaaacgaggugauucaccccacuccaaccaucugcuuuguaaggaacagaguaaguacaaaguguucgaguggccugaaguugagacugugaccaagaauaacaaauugugccugggggacacgcacuguaauuuaaaguuuaccgcaacaacuucugacgaaaucauuaaacuccugaacugcuucagcgauaccuauaagccaaaucccggcgagauggagaucggacuuaagaaaugcaacgccgaaaagauuggcgaguguguaacacuggaaaacuccccguggccuaucgucuacugcgagaauaaauacuauuacucagaagcuaaggagcaugcgaaagacgggagcgugaacucuuauuguuugacuaauaagugcaccgaggauagacuccccauaaacccagcaugguuuaaguccuguaauugggaaaagaacauuaaggagacggccacaaucaaagaguucguuuacaaugacaucaagaguuauaggaaaagccuggaaucugaaauuaacaccgaucuaaugauacaccacuaccgcccuacuaagaaucugccccauaucaagccaauuuauaaaucccucucaauccagggaagugagacaguggacggucugcagaacagcuuuauugagggcgaaaugcccgcuaucucggggcuugccaauggauaccacuugauguacaagggcacccaacuguucgauauagucaucuucauucggaaagcaguguauaaggccaacuacuauaaaaucuacacuaccgguccuuccauugcuaucaauauggagcauaacgaacagugcacagggcacuguccaucuaagauaccgagcaaagagaauugguuaacguuuucaagagagcauaccaguuccuggggcugcgaagaguauggaugucucgccauugacacuggcugccuguacgggucuugucaggauguaaucaggcccgaaaucgacguguauaaaaagagcggaacagagcagucccuuauugaacugugcaucaccucagcacacgagacauucugcaacgaucuagacauacucgagccuauuaucggugagaaaauuagcgcgaguuuucaaucuacucaguccaaccagcugccaaauaucauagcuuuccgcaagggccaaauuuugaccggggccaucaacgaucugggaaauacgggcagccagugugguucgauccaguuaguuaacaauacacuccugggggaaggcaacgucaaauuugacuacauuugccacgcaaugcgacggaaggacgugaucauucguagauguuacaaugaucauuucaccucaugcaaccuucugcagaaaaggucugacuugauaggaaauaucaacggcaaggaacuccaaauuaguauguccgggcgcagcaugggaucuaugaaguuuaaaaucgagcugggcgauaucaauuauaagcuauacacugaaaacgccgacauuaccauacggggugagugugggggaugcaucggcugugcugaggccgugagcugcucccuggaagucgagucagcaagugaaauucuuuguaaaguugagugcaauugucagcccuauaucgaaaacauucucaucaagccucagacaaaaacuuacagcuucaaggcuaccugccuggagaagucuaauacauuggauauaaaaaucugcgguaagcagauuaucgccccacugacgauuaaauccuauaaccaaaagaucgacuuaucaaaacucgaugagaguaauuacgugaaggaagaggaccuggcguguaacaccuggcuuugcaaggugcagacugaaggcuuuaacuucguauuuagcgggcuguucgccggauucggcagauauuggacaauagcuauuuacaucuugauugcagucgugaucauacucauccugauuuacauccuaaugcccauuuuuaggcugauccgaaccuuccuuauuaaaaaugagauagaguauacuacagaacagaagaugcgcuga

SEQ ID NO: 11062 - RNA, 4257 nt, Artificial Sequence
  derived and/or modified CDS sequence (opt3) from OROV/IQTV(MIS-0397)__KJ866387.1__GP
auggacugcaucauuuucuaccugagcuuuuucgccguggucaccgcucaccccguuucccaucaccaggugggcgauagauguuuugcagggggaaaccucauaaaggaccuuaauaaaacaguaaacaucggugaggugugcgucagggaugacauuucuaucauuaagucaacuacggccauccagaaaagucuggaucauuugagcacccggacaaaguucuaucgcguguacauaguuaaagaaugggcggaguguaauccuaucauugacuaugcuggcaacuuuaucgugaugaauauugaugacaacgggcacuuagucccacgaaugcauacuugccgugccuccugugauaucagacugaauaagaacgacgcagaaauaauucuaucuucgcagaagaccaaucacuacgagaucauuggaacaaccacugugucaggcugguucaaaaacacaaucaaucucccgcuggaacauaccugcgagcacaucacgguaaacuguggucaaaagagccuuagguuucacgccugcuuccggaugcaucgcggguguacuagauuuuucaaaaauaccuauaugcccaguacaaugauugagcacaugugcgcuaaccuggaauugauaaucuuuacucucuacauuuucaccgcacugguuuuugccuauaucauaacaaaguccuacauugcuuacauccugcucccuuuauucuauccacugaccuacguguucggaaucauuuauucuaaacuuaagcaguguaagacgugcauguuggccgcgcaccccuuuacuaauugcccuaaaaggugugucugcggcagccgguucaacuguacagaggcacugcgcgugcaucgacuaggcagagauugccaaggguacaagucccucucaaaagccaggcagauguguaagaguaaaagcuggucuuuuaucauugcuauauucaccggacugauccuuauggaauuuauuacuccaauccacggugagcggacauauaagcuguccgaguuggccgacgaguucaucgcaaugaaaaccgaagugacggucaugcagcguucaauuuacaaccagaagauacucaauaucgcucuguuaacccugguugugcucauuauccuucuggaaacauauauuuuuaagaucuuguucagccuacuguaccgcaguugcucuauguguggccucauacauuacaaacuggggcuuaagaucaaccuguugacuaccaauaaaugcggaacauguauuugcggcuuuuccgagcaacagagcucggguuucgaauaugagguauuucucaaggauaugcacaaacagagagagucuuguaaguacuuccccaugcugaaccauuuuaggaauuuaaagauccugacuaccauucuacuccugauccuuuuggccacauccgugucaagugaaugccugcagaaaccucucaagauaaaacuggaggaccuucacgaaugcauuggggucaacuuccuggaccggcaauguuauaaucgaaaggauuuguacgagagccuccgcuccaaaaaccugaucucugaaguggacaagaaguauuucgagagcgcggauuuaggaggccaguuuaaaagaauugaguacgcccaggacgcacacaggaugauccugcuagaacggauacucuauucaaccgagugcgaaaugcauacuauccugacgaauggcggggcuuacaacauuccauggcgcacauaccuuaagaaucacaacuugaaucuguguggaaaacauguucacaagauggugugccaaugugucaacacccacacucagugccucaguaccgguaucgauuaucaggacgagauuacaaaauucuaccaggccgauggcgacuccuauagaagcgaucugucuaucauauuagaaaccauuucaacugcuuuuagggggcugacaaaggugcuuaucgagacguacaucgagcaagacaauagugaaagcaugauuaaguugcucaacaccauccagggaaaaguaccgaacaauuaucagaugcugggcauucuaaaguucgccauaaaaaucaugaacauuaaucagacucgugguguucgguccgcacgacauacaaucgugucuaacgauauucccaugucggagccuuuuagcaauuucgaagccuccaacaucaauauaaagcaauguucagagccacugacccucaaaugcuuuacaaagagaggggacaguccccacucuaaccaucugcuuuguaaagagcagagcaaguacaaggucuucgaauggccugagaucgaaacugugaccaaaaauaacaaguugugccugggcgacacgcacuguaauuuaaaauuuaccgcuacaacuuccgaugagauuaucaagcuccugaacugcuucucagacaccuauaaaccaaaucccggagaaauggagauuggccuuaagaagugcaacgcggagaaaaucggggaaugugucacacuggagaauagcccguggccuauaguguacugcgaaaacaaguacuauuacucugaggcaaaagaacaugccaaggauggauccguuaacaguuauuguuugacuaauaaaugcaccgaggacaggcuccccauuaacccagcuugguuuaagagcuguaauugggagaagaacaucaaagaaacggccacaaucaaggaguucguguacaaugauauuaaaucuuaucgcaagucccuggaaucagagauaaacaccgaccuaaugauccaccacuaccggccuacuaaaaaucugccccauauuaagccaaucuauaagagucucagcauucaggguucggaaacaguagauggccugcagaacuccuuuaucgagggggagaugcccgcaauaucuggacuugccaauggcuaccacuugaccuacaaagguacucaacuguucgacaucgucauuuucaucagaaaggcuguguauaaagccaacuacuauaagauuuacaccacagggccuagcaucgcaauaaauauggaacauaacgagcagugcacgggccacuguccaucaaaaauuccgaguaaggaaaauugguuaaccuuuuccagggagcauacuucuagcuggggaugcgaggaauauggcugucucgcgaucgauacagggugccuguacggauccugucaggacguuauccgccccgagauugauguguauaaaaagucagguaacgaacagagccuuaucgagcugugcauaaccagugcucacgaaacauucugcaaugaccuagauauucucgagccuaucauuggcgagaagaucucugccuccuuucaaagcacucagucgaaccagcugccaaacauaauugcauuccgaaaagggcaaaucuugaccggagccaucaaugaccugggcaacacggguucacagugugggucuauucaguuagucaauaacacacuccugggcgaaggaaaugugaaguuugacuacaucugccacgcuaugcggcguaaagauguaauuauaagaagguguuacaacgaccauuucaccaguugcaaucuucugcagaagcgcuccgauuugaucggcaacauuaaugggaaagagcuccaaaucagcaugucuggacggagcaugggcuccaugaaguuuaagaucgaacugggugacauuaacuauaaacuauacacugagaaugccgauauaaccaucagaggggaauguggaggcugcauugguugugcagaggcugugucaugcagucuggagguugaaucuagcuccgagauccuuuguaaggucgaaugcaacugucagcccuauauugagaauauccucauaaaaccucagacaaagacuuacucauucaaagcgaccugccuggaaaggaguaacacauuggacaucaagauuugcggcaagcagaucauugccccacugacgaucaaaagcuauaaucaaaagauagauuuauccaaacucgacgagucuaacuacgugaaggaggaagaucuggccuguaauaccuggcuuugcaaagugcagacugagggguuuaacuucgucuuuucgggacuguucgcuggcuucgggcgauauuggacaauugcaaucuacauuuugaucgccguugugauaauccucauucugaucuacauucuaaugcccaucuuucgccugauacggaccuuccuuauuaagaacgaaaucgaguauacuacagagcagaagaugagauga

SEQ ID NO: 11063 - RNA, 4257 nt, Artificial Sequence
  derived and/or modified CDS sequence (opt3) from OROV/MDDV(FMD 1303)__KF697145.1__GP
auggccuuccugcucaucuacgugguccuugcugcagccguugcgagccacccccuguccaaccaucagauuggcgacagaugcuuugcugggggaaauuugauaagggaguuaaacaagaccgugaauaucggugaacuguguguacgggaugacauuucuaugaucaaaucaacaacugccauucaaaagagugugggccaccuaagcacgcgcaccaaauucuaucgagucuacaucgugaaggagugggcagaaugcaacccuauaaucgauuuugccgggaauuucauuaucaugaacauugacgagaauggacaucucguuccaaaaaugcacacaugucgugcuuccugcgauaucagacugaacaaggacgaugcagaaauaauucuuucuucgcagaagacuaaucauuaugagaucauuggcaccacaucaaucagcgguugguuuaaaaacaccaucaaucugccguuggagcacacuugugaacacauuacagugaacugcgggcagaagagucucagguuccaugccuguuuucggaugcaccgcggaugcaccagauucuuuaaaaauacguacaugcccuccacuaugauagagaccaugugugucaaccuggaacugaucauuuucacacucuauaucuuuucugcugccguguucgcguacguaauaacuaagagcuauauugcauacaucuuacugccuguuuucuacccaaucaccuauauucuuggcuccaucuacucaagguucaaacagugcaagacauguauguuggccgcucaucccuucaccaguugcccuaagaaaugcguguguggcagccgguuuaauugcacggaggcccugcgcguccaccgacuagggaaggacugucaaggauauaaaucucucuccaaggcaagacagaugugcaaaucaaagagcuggaguuucauuauagcuguguuuacuggucugauccuuauggaguucauuacaccaaucucuggcgaaaggauguacaaacuguccgaguuggccgaagaguuuaucgaaaugaaggaggaggcgagcgcccucaagaaagcaauuaacaaccugaaguuacugaaugugcuccuuucggcuauagccacccuggucguugugauggaaacuuauaucuucaaaucuuuguuuaaccuacuguaccgguccuguucaaugugcgggcucauucacuauaagaucggacugcguguaaaucuucugacaaccaaccgcuguggcacgugcauuugugguuucaaugagcagcagaguagcggguuugaauacgagaucuucuugaaagauaugcauaagcaaagagaauccugcaaguacuuucccaugcucaaccacuucaggaaugugaaaauacugaccgucuuuuuacugcuaacaaugcucacugcuucugccagcucagagugucugcagaagccucuuaaaaucaaguuggaggaccugcaugaaugcauuggagugaacuuccucaaucggcagugcuauaacagucaggagcuguaccaaucccuuaaaagcaagaaucugguuucugaaguggauaagaaauauuucgacaacaagaauuuggaggaucucuuuaaacgaaucgaauacgcacaggacgcccaccgcaugauucuguuagagagaauccuguauucaaccgagugugaaaugcauacaauacuaacuaacggcggcgcuuacaauauuccauggaggaccuaucucaagaaccacaaccugaaucuuugcgggaaacacguccauaagauggugugucagugcaucaacacacacacccaauguuugaguacuggaauugacuaccaggaugagaucacgaaguucuaccaggcggacggugauagcuaucgggcagaccuguccguaauacuccagacaaucgccaccgcuuuucgcggcaugacuaaaguucugauugaaaccuacaucgagcaagauaauucugagucgaugauuaaguuacugaacacaaucaaagaaaaggugccgaauaacuaucagaugcuugggauauugaauuucgccauuaaaaucaugagcgucaaccagaccagaggagugagguccgcacgucauacuaucauuucaaaugacauccccaugagugagacauuuucuaacuucgaagucagcaauauugaugugaagcagugcacggacccucucacccugaaauguuuuacuaagcggggcgaugccccacacuccaaccaccuacugugcaaggagcaaaauaaauacaagguuuucgaauggcccgagauagagacagugaugaaaaacaauaagcucugucugggugacacccauugcaaccuuaaauuugcugccaucgcaucagaugaaguaauuaaguugcugaacuguuucagcgacacauauaagccuaauccaggggagauggaagucggcgcgaaaaagugcaacgcugacaaaaucggagagugcauuacuuuagaaaauaaccccuggccgaucguguacugugagaccaaguauuacuacucugaugccaaagagcacgcaaaggacggcaauguuaacuccuauugccucacgaauaaguguaacgaagaucgauuuccuauaaaucccaccugguucaaaaguugcagcugggacagaaacgugaaggagacaacuaccaucaaagaauuuguccauaaugauauuucugccuacaggaagucccuggagucagaaaucaguacagaccuucugauucaccauuaucgcccaacuaaaaacuugccucacaucaugcccgcuuacaagagccucaccauacaggggucggagacgguggauggacugcaaaauuccuucauugagggugaaaugccagccaucucuggccuagcaaacggguaucaccugaaguacaaaggaaucgagcucuuugacauuguaauauuuauccggaaggcuguguauaaagccaauuacuacaagauuuauacaaccggccccagcguugcgaucaacauggaacauaacgagcaguguacugguucaugcccuaaaaagauuccagccaaagagaauuggcugacauucaguaaggaacacaccuccucuugggggugugaggaauacggcugccuugcuaucgauacuggauguuuguauggcagcugccaggacgucauaagaccggagguggauguguacaagaaagcauccgccgaacagucacugaucgaguuauguauuaccagcgcucaugagacauuuugcaacgaccucgauauccuggaacccauuaucggggacaagauaagugccgcauuccagucuacgcaggucaaucaacuuccuaacauuaucgcguuuaaaaagggacagaucuucaccggugccauuaaugaccugggcaacacugggucccagugcggaagcauccaacuaauaaauaacacacuccugggcgaggguaauguuaaauuugauuauauuugucacgcuaugaagaggaaggacgugaucgugcgccgaugcuacaacgaucauuucgccucguguaauuugcugcagaaacggucagacuuaguagggacccucaacggcaaggaacugcaggucucuaugaguggacguuccaugggcagcaugaaauuuaagguggagcuuggggauauuucuuauaaacuguacacagaaaaugcagacaucagcauauccggagagugcggcgguuguauuaacugcgcugaggccaucucaugugcauuggaaaucgauaguagcacugagguucucugcaagcuggaauguucuugccagccauacauucaaaauauccuaauuaagccccaggugaaaaaguauuccuucaaagccaccuguuuugagaagagaaacucacuggaagucacggugugcaaaaagcagcacacaauaccucuuaccaucaagaguuacaaucagaaaauugaccucagcaggcuggaugaguccaacuauguucgcgaggaagacuugacuugcaacaccuggcuguguaagguggagaaagaagggaucggaguaauguucucuggcuuauucgcugguuuuggcaaguacuggucgaucgcgauuuaugcccucauagcacuggucaucuuccuuauucugaucuacauuuuggugccaaucuuucggcucauaagaacauuccugaucaaaaaugagguggaguauacuaccgaacaaaagaugagguga

SEQ ID NO: 11064 - RNA, 4257 nt, Artificial Sequence
  derived and/or modified CDS sequence (opt3) from OROV/MDDV(INHRR 17a-10)__KJ866390.1__GP
auggccuuccugcucaucuacgugguccuugcugcaaccguugccagccacccccuguccaaccaucagauuggcgacagaugcuuugccgggggaaauuugauaagggaguuaaacaagacagugaauaucggugaacuguguguacgggaugacauuucuaugaucaaaucaacuacggcuauucaaaagagugugggccaccuaagcacccgcacaaaauucuaucgagucuacaucgugaaggagugggccgaaugcaacccuauaaucgauuuugcagggaauuucauuaucaugaacauugacgagaauggacaucucguuccaaaaaugcacacuugucgugccuccugcgauaucagacugaacaaggacgaugcugaaauaauucuuucuucgcagaagaccaaucauuaugagaucauuggcacaaccucaaucagcgguugguuuaaaaacacuaucaaucugccguuggagcacacaugugaacacauuaccgugaacugcgggcagaagagucucagguuccaugcauguuuucggaugcaccgcggaugcacgagauucuuuaaaaauacuuacaugcccuccaccaugauagagacaaugugugucaaccuggaacugaucauuuucacucucuauaucuuuucugccgcuguguucgccuacguaauaaccaagagcuauauugcguacaucuuacugccuguguuuuacccaaucacauauauucuuggcuccaucuacucaagguucaaacagugcaagaccuguauguuggcagcccaucccuucacgaguugcccuaagaaaugcguguguggcagccgguuuaauugcacugaggcucugcgcguccaccgacuagggaaggacugucaaggauauaaaucucucuccaaggccagacagaugugcaaaucaaagagcuggaguuucauuauagcaguguuuacaggucugauccuuauggaguucauuaccccaaucucuggcgaaaggauguacaaacuguccgaguuggcugaagaguuuaucgaaaugaaggaggaggccagcgcgcucaagaaagccauuaacaaccugaaguuacugaaugugcuccuuucggcaauagcuacucuggucguugugauggaaacauguaucuucaaaucuuuguuuaaccuacuguaucgguccugcucaaugugugggcucauucacuacaagaucggacugcguguaaaucuucugaccacgaaccgcugcggcaccuguauuugcgguuucagugagcagcagagcuccggguuugaauaugagaucuucuugaaagauaugcauaagcaaagagaaucuuguaaguacuuucccaugcucaaucacuucaggaacgugaaaauacugacagucuuuuuacugcuaacuaugcucaccgccagcgcuucaagugagugccugcagaagccucuuaaaaucaaguuggaggaccugcaugaaugcauuggagugaauuuccucaaccggcaguguuacaauucccaggagcuguaucaaagccuuaaaucuaagaaccugguuucagaaguggauaagaaauacuucgacaauaagaacuuggaggaucucuuuaaacgaaucgaauaugcccaggacgcacaccgcaugauucuguuagagagaauccuguacaguacagagugcgaaaugcauacuauacuaaccaauggcggcgccuauaacauuccauggaggacauaccucaagaaucacaaccugaaccuuugugggaaacacguccauaagauggugugccaguguaucaauacccacacucaaugcuugagcacgggaauugacuaucaggaugagaucacaaaguucuaccaggcugacggugauuccuaccgggcggaccugucuauaauccucgaaaccauugcaacugccuuucgcggcaugaccaaaguacugaucgagacauauauugagcaggauaacucggaaagcaugaucaaguuacugaauaccauaaaagagaagguuccgaacaauuaccaaaugcuugggauuuugaacuucgcuaucaaaaucauguccgugaaucagacuagaggagucaggucagcccgucauacaauuaucaguaacgacauucccaugucugaaacguuuaccaauuucgaggugagcaacauagaugucaagcaguguacugacccucucacacugaaaugcuuuaccaagcggggcgaugcaccacacuccaaucaccuacuguguaaggaacagaacaaauauaagguguucgaguggcccgagaucgaaacaguuaugaaaaauaacaagcucugccugggugacacucauuguaaucuuaaauuugccgcuauugccucagaugaggugaucaaguugcugaacugcuucagcgacaccuacaagccuaacccaggggaaauggagguaggcacgaaaaagugcaaugcagacaaaauuggagaauguaucaccuuagagaacaaucccuggccgauagucuauugcgagacaaaguacuauuacucugaugcgaaagaacacgcuaaggacggcaacguuaauuccuacugucucacuaacaagugcaaugaggaucgauuuccuaucaaccccaccugguucaaaaguuguagcugggacagaaauguuaaggaaacaacuaccauuaaagaguuugugcauaacgauaucucugccuauaggaagucccuggaaucagagauuaguacggaccuucugauccaccauuaccgcccaaccaaaaauuugccucacauaaugcccgcauauaagagccucacaauucaagggucggagacugucgauggacugcagaacuccuucaucgaaggugacaugccagccaucucuggccuagcuaauggguaccaccugaaguauaaaggaauugagcuguucgauauagugaucuuuauuaagaaagccguauacaaggcaaacuauuacaaaaucuacacaaccggccccagcguggcuauuaauauggaacauaacgagcagugcacugguucauguccuaagaaaaucccagccaaggagaacuggcugaccuucaguaaggaacacacauccucuugggggugcgaggaauauggcugucuugcgauagacacgggaugcuuguacggcagcugucaggauguuauccggccggagauugacgucuauaaaaaggccuccgcugaacaaucacugaucgaguuaugcauuaccagcgcacaugagacuuuuugcaaugaucucgacauccuggaacccauaauuggggacaaaaucagugccgcuuuccagucuacacaggugaaccagcuuccuaauaucauugccuuuaagaaaggacaaaucuucaccggugcaauaaacgaucugggcaauacagggucccaguguggaagcauucagcuaaucaacaauacucuccugggcgaggguaacgugaaguuugacuacauuugccacgcgaugaagagaaaagaugucaucguuaggcgcuguuauaaugaccauuucgccucgugcaacuugcugcaaaagcgaucagauuuaguggggacccucaauggcaaagaacuccaggugucuaugaguggacgguccaugggcagcaugaaguuuaaaguagagcuuggggacauaucuuacaagcuguauacggaaaacgcugauauuagcaucuccggagaguguggcgguugcaucaauugugccgaggcaauuucaugcgcuuuggaaaucgacaguagcacagagguccucuguaagcuggaaugcucuugucagccauacauucagaacauacuaaucaaaccccaagugaagaaauacuccuucaaggcgaccugcuuugagaaacguaauucacuggaaguuacugugugcaagaagcagcacaccauuccucuuacaaucaaaaguuauaaccagaagaucgaucucagcagacuggacgaguccaauuacgucagggaggaagauuugacuuguaacaccuggcugugcaaaguggagaaggaagggauuggaguuauguucucuggcuuauucgcagguuuuggcaaauauuggucgauagccaucuacgcucucauugcgcuggugaucuuccuuauucugaucuauauauugguaccaaucuuucgccucauucggacauuccugaucaagaacgaggucgaguacacgaccgaacagaagaugagauga

SEQ ID NO: 11065 - RNA, 4257 nt, Artificial Sequence
  derived and/or modified CDS sequence (opt3) from OROV/Perdoes virus(BeAn789726)__KP691625.1__GP
auguucauccaguuuaaccuggccuucuuuugccucagcauuguguguggccacccccuuaccaaggaccauauaggggauagaugcuucgcuggagguaaucuguuuaaagagaucacacaaacuacgggcuuguccgaaauuuguaucaaggacgauauuucuaucauaaaaucacaggucgagaucaagaaacagaguagcgaaguuaccuacgcagugaaguucuauaggguauacuuagugaaggagugguccgaaugcaacccuauucaggaccaacacgggucuaucaugauucuggaugucacaaauacuggacuaaucgugccaaaaauguauaccugucgggccgcgugcgacauaacacucgauaaggacaacgcugagguuguguuuauuucgcagaaaaauaacaauuacgagcuggccggcaccacugucaugcaugguugguucaagaacgugguaucaaucaaacuugaacacacaugugagcaucugaccgcaacgugcgggcagaagacuguuaaguuucacgccuguuuccgccagcaccgagcuugcgcacguuuucuaaaaaccacauauaugccgauugugauggucgaaagccucuguaguaaucuggagcuggugaucuucaucacuuacauuuuugugugccucgccuucgcuuucauaaucaccagaacauaugucgccuacuuacugauucccguguuuuacccuuucaccuaugcguacggaaagauguaucuuaaaugcguuaagacguguccaaacugcuugcuggcaaugcaucccuuuacuaauuguacaaaccuaugcaucuguggcuccagguucucuaauaccgagagccucaaaguacaccggcugggcaacugcuacggguauaaggcccuuuccggagcucgcucaauguguaaaaguaaggugagcucuuuuacuacagccauguucuuugguauaauuauccuguccuucaucgcaccuuugaauggcgaaagacucuacaagcugucagaguuaccagaugaauauauugagauggaaagcaccaucgaggggaguaaacaaaaggagacgauugucgacauaaucaacuacaccgcucuggugcucauucuuaucacaauccuguugcagggaauuuuggaaaacuacauauuuaggcugaaauuccgguuuugcucuuucugugauaugauccauaugaagaaaaaucucaagaucuuuuccaacaugacuaauaagugcggcaccuguauuugcgguuucaaccaggagauucgcagcggguucgacuaugaaguuuuuaucaaagauaugcacgugucgcgagagucuugcaaguacaauuaucacaaaaacuacuccuucuauauaaagaugcugcuugucgugcuguugguaccccucaucggaacaacugccgcggaagacaccaaaugucugaaguacgacuuaaauaagaacauugaggaucugaaagacugcuauggccuaaagcucaauaucgauaaacaugacacaguugagaacgccuacaagaaucugguggaucagaaacuugucucagaauuggacagacuggaucucaacauuaugcugggcaguaaggagagcaucuuugaagcaauagagaccuccaugaauauucaccaaaugguguuccuugaauaccuggcuuauaagacugacccuaaauugucugagaucaagcagaacacggggccauacaauauugccuggaggacauuuauccauggaaacagccucgaggucugugguaacuauccguacaaacugauaugcuauuguaucaaucagaagacccacugcgaaaacucaacuguggauuacggcauucaaauccagcccuucuauaaucagcauccuaacaguuacaaauccgacauggaggcuuuaauuaagaccguucagaucgccuuucgggggauaauuaaagugcugauccaauacuauguagaaaauaacaagacaagcgagcuaucuaaucuccugaccgagcuucguaacgucaugggaaauaacauccagaugaagggcauuuugaaauaccuggaaacuuaucucaagaaaccacuguuaauggcacgcacaaucagaauugccgcuaagguggauacgucaggugaccccuacaauaacuucaguaccagcaaagagaauauaacuaaguguaucaagauucagaaacugaggugcaucacaaagcugacccggauugaacacaacuauaucuuguguggggacuccgagaaaaagcucuaccaguggccugcgaaaccaacaauaguugaugacaaugaugcaugccugggcgacaagcacugucaucuacccuuuaucccgauuggaaacgaugaagccaucaagacugugaacugcuaugucgagguguacgagcaaaauccuggcgacaugaacucuuaccagaaaaagugcgaugcuaugaauguagggaccugucugacgauuaaaaacgaaaauuggcccaucgugcagugcaagaccggaaaauauuacuaugccgacggucgaauacacgcaaaggauggcacaauuaacacuuacuguuucucggagaagugcaaugccgaccgcuauccaauccaucaggauuacaucaacagcuguaauuggcaagaaaccauuaaagacuuucagcacguuagagaguucguccaccucgauauagaauccuauaagaaagcuaucgagucagacauuaagacagaccugguggugcauaaauuuaggccugucaagaaccuuccccacguuaucccaauuuacaaaaguaucacugugcaggggaccgagacgucugauggaauacagaaugccuucauccaaggcagcaugcccgcaauuuccgguuuggcgaacggguaccaucuguucacaccugacucaaagcaguuauuugaugugguacucuuccugcggaaggcuagcuauaaagccgaauaccgcaagaucuauucuaccggcccaacuauuggaaucaaugucgagcacaacgaaaaaugcacaggcuccuguccgaagaccauagacaaaaaggauaauuggcuuacuuuuaguaaggagcauaccagccagugggggugcgaagaguacggaugucuggcaauuaacacagguugcguguucggcucuugucaagacaucaucagacccgagauugauguuuauaaaaugcacggggccgaaagguccguggucgaguugugcaucacgcucccucacgaaaccuacugcaacgaccuggaugugcuagagccaauaauuggagacaagauccaggcugccuuucagacuguucagucaaaucauaugccccgucugauggcaauuaaaaacaauaaggcuuucacaggccaaaucaacgaucucgguaguaccgccagcuauugugggucggugcagaaauuuaaugagacaauaauuggccagggagacccuaaguucgauuacguaugccaccuucuuaagcggaaagacaucaucguccgaagauguuacuccaacaauuaugaaucuugcaaguugcugacuccaagggcggacauuaucguggauaaaaagggcgagagcuuacaggccucaauuguggggcucaaccugggacaaaugaauuuuaaaauaaugcuuggcgacaucaacuacaagcaguauaccgaaaguaauaaccuggaggcuacgggucagugugucgggugcguugauuguuccgaagacauugugugcaaucuaaagaucgagucucagagcgaguccguauguaacaucaaaucagauugcaaucucuaccugagcaguauguugauucaacccacagugggagaauauaaccugaagaugucuuguaaugcaaaauuagacaaggucaacauagagaucugcaaacagaaguucgugcucccgcugaccauuaagucccauaaccagaaaaucgaucuuagcaagcuggacgaaucgaauuacauucgcgaggaagauuugaaaugcgacacuaugaucuguaagguuaaagaugagggccucucauuuauaaccaacucucuguucgguggcaucaguuauuucuggaagauucuaaucuccagccugauugugaucuuucuuauaauucucuucuacuacgucgggcugccuaucuugcggcugauuaaagacuauuuaaaggagaaugaacucgaguaccuggccgaaggaaaguga

SEQ ID NO: 11066 - RNA, 4257 nt, Artificial Sequence
  derived and/or modified CDS sequence (opt3) from OROV/Perdoes virus(BeAn790177)__KP691628.1__GP
auguucauccaguuuaaccuggccuucuuuugccucagcauuguguguggccacccccuuaccaaggaccauauaggggauagaugcuucgcuggagguaaucuguuuaaagagaucacacaaacuacgggcuuguccgaaauuuguaucaaggacgauauuucuaucauaaaaucacaggucgagaucaagaaacagaguagcgaaguuaccuacgcagugaaguucuauaggguauacuuagugaaggagugguccgaaugcaacccuauucaggaccaacacgggucuaucaugauucuggaugucacaaauacuggacuaaucgugccaaaaauguauaccugucgggccgcgugcgacauaacacucgauaaggacaacgcugagguuguguuuauuucgcagaaaaauaacaauuacgagcuggccggcaccacugucaugcaugguugguucaagaacgugguaucaaucaaacuugaacacacaugugagcaucugaccgcaacgugcgggcagaagacuguuaaguuucacgccuguuuccgccagcaccgagcuugcgcacguuuucuaaaaaccacauauaugccgauugugauggucgaaagccucuguaguaaucuggagcuggugaucuucaucacuuacauuuuugugugccucgccuucgcuuucauaaucaccagaacauaugucgccuacuuacugauucccguguuuuacccuuucaccuaugcguacggaaagauguaucuuaaaugcguuaagacguguccaaacugcuugcuggcaaugcaucccuuuacuaauuguacaaaccuaugcaucuguggcuccagguucucuaauaccgagagccucaaaguacaccggcugggcaacugcuacggguauaaggcccuuuccggagcucgcucaauguguaaaaguaaggugagcucuuuuacuacagccauguucuuugguauaauuauccuguccuucaucgcaccuuugaauggcgaaagacucuacaagcugucagaguuaccagaugaauauauugagauggaaagcaccaucgaggggaguaaacaaaaggagacgauugucgacauaaucaacuacaccgcucuggugcucauucuuaucacaauccuguugcagggaauuuuggaaaacuacauauuuaggcugaaauuccgguuuugcucuuucugugauaugauccauaugaagaaaaaucucaagaucuuuuccaacaugacuaauaagugcggcaccuguauuugcgguuucaaccaggagauucgcagcggguucgacuaugaaguuuuuaucaaagauaugcacgugucgcgagagucuugcaaguacaauuaucacaaaaacuacuccuucuauauaaagaugcugcuugucgugcuguugguaccccucaucggaacaacugccgcggaagacaccaaaugucugaaguacgacuuaaauaagaacauugaggaucugaaagacugcuauggccuaaagcucaauaucgauaaacaugacacaguugagaacgccuacaagaaucugguggaucagaaacuugucucagaauuggacagacuggaucucaacauuaugcugggcaguaaggagagcaucuuugaagcaauagagaccuccaugaauauucaccaaaugguguuccuugaauaccuggcuuauaagacugacccuaaauugucugagaucaagcagaacacggggccauacaauauugccuggaggacauuuauccauggaaacagccucgaggucugugguaacuauccguacaaacugauaugcuauuguaucaagcagaaaacccacugcgaaaauucaacuguggauuacggcauucaaauccagcccuucuauaaccagcauccuaauaguuacaaguccgacauggaggcuuuaauuaaaaccguucagaucgccuuucgggggauaauuaaggugcugauccaauacuauguagaaaacaauaagacaagcgagcuaucuaaccuccugaccgagcuucguaaugucaugggaaacaauauccagaugaaaggcauuuugaaguaccuggaaacuuaucucaaaaagccacuguuaauggcacgcacaaucagaauugccgcuaaaguggauacgucaggugaccccuacaacaauuucaguaccagcaaggagaacauaacuaaguguaucaaaauucagaagcugaggugcaucacaaaacuuacccggauugaacacaauuauaucuuguguggggacuccgagaagaaacucuaccaguggccugcgaagccaacaauaguugaugacaacgaugcaugccugggcgacaagcacugucaucuacccuuuaucccgauuggaaaugaugaagccaucaaaacugugaacugcuaugucgagguguacgagcaaaacccuggcgacaugaacucuuaccagaagaaaugcgaugcuaugaauguagggaccugucugacgauuaagaaugaaaacuggcccaucgugcagugcaaaaccggaaaguauuacuaugccgacggucgaauacacgcaaaggauggcacaauuaauacuuacuguuucucggagaaaugcaacgccgaccgcuauccaauccaucaggauuacaucaauagcuguaacuggcaagaaaccauuaaggacuuucagcacguuagagaguucguccaccucgauauagaauccuauaaaaaggcuaucgagucagacauuaaaacagaccugguggugcauaaguuuaggccugucaaaaaucuuccccacguuaucccaauuuacaagaguaucacugugcaggggaccgagacgucugauggaauacagaacgccuucauccaaggcagcaugcccgcaauuuccgguuuggcgaauggguaccaucuguucacaccugacucaaagcaguuauuugaugugguacucuuccugcggaaagcuagcuauaaggccgaauaccgcaaaaucuauucuaccggcccaacuauuggaaucaacgucgagcacaaugaaaagugcacaggcuccuguccgaaaaccauagacaagaaggauaacuggcuuacuuuuaguaaagagcauaccagccagugggggugcgaagaguacggaugucuggcaauuaauacagguugcguguucggcucuugucaagacaucaucagacccgagauugauguuuauaagaugcacggggccgaaagguccguggucgaguugugcaucacgcucccucacgaaaccuacugcaacgaccuggaugugcuagagccaauaauuggagacaaaauccaggcugccuuucagacuguucagucaaaccauaugccccgucugauggcaauuaagaauaacaaggcuuucacaggccaaaucaaugaucucgguaguaccgccagcuauugugggucggugcagaaauuuaacgagacaauaauuggccagggagacccuaaguucgauuacguaugccaucugcuuaaacggaaggacaucaucguccgaagauguuacuccaauaacuaugaaucuugcaaauugcugacuccaagggcggacauuaucguggauaagaaaggcgagagcuuacaggccucaauuguggggcucaaucugggacaaaugaacuuuaagauaaugcuuggcgacaucaauuacaagcaguauaccgaaaguaacaaucuggaggcuacgggucagugugucgggugcguugauuguuccgaagacauugugugcaaccuaaaaaucgagucucagagcgaguccguauguaauaucaagucagauugcaaccucuaccugagcaguauguugauucaacccacagugggagaauauaaucugaaaaugucuuguaacgcaaaguuagacaaagucaauauagagaucugcaagcagaaguucgugcucccgcugaccauuaaaucccacaaccagaagaucgaucuuagcaaacuggacgaaucgaacuacauucgcgaggaagauuugaagugcgacacuaugaucuguaaaguuaaggaugagggccucucauuuauaaccaauucucuguucgguggcaucaguuauuucuggaaaauucuaaucuccagccugauugugaucuuucuuauaauucucuucuacuacgucgggcugccuaucuugcggcugauuaaggacuauuuaaaggagaacgaacucgaguaccuggccgaaggaaaauga

SEQ ID NO: 11067 - RNA, 4284 nt, Artificial Sequence
  derived and/or modified CDS sequence (opt3) from OROV/UTIV(BeAn84785)__KF697155.1__GP
auguuccugaucuuuauucucauacagaucgccgcuagcacaccccuuuccccucaacaggugggcgacagaugcuucauugggggaucucugaucaaggagauuaaccagucaaccgguuugggcgaagucuguaucaaagaugacauaaguaucauuaagagcaucaauauucagaaaaagaucuccaacgaucaaguucagaauacugugaaauuuuacaagacguauauagcaagggaguggcacgacugcaacccaauuuucgaugaacaugggucuuuuaugguauucgacaucucgaauaccggaucaauuaucccgaagaugcacacaugucgggcccagugcgagaucacuuuaaacaaagauaaugcggaagugauuuuuaccagcgcuaagacaaaccauuacgaggucaguggcaccacuacagugaaugguugguucaaacagaccauauccguuucucuggagcacacgugugaacauaucauugccagcugcgggcaaaagucccuaaaauuucacgcauguuuccgccagcaccgaucaugcgugcguuucuucagaaacaguuaucuccccuacaagaugaucgagagccuguguauaaauauugaacuuaucaucauucugugcuaugccuugcucuguuuuaucuucgcuuacauuauaacuaagaccuauaucgcauaccugcugauuccucucuucuacccaaucacauauaucuacggaaaaauuuauaacaaguacuuuaaaaggugcaagucuugcuuacuggccguccauccccuuacuaauuguaacaaaaccugcguguguggcugccgguucaauuccacagaggcuuugaagguacaccgccugggcaaagacuguaacggguuuaaggcccuaucaaaggcgagauuccucugcaaaagcaccggaccuaguuuuacgauauguuuccugacugguaugcuuauccugucuuuuauuacaccaaucaacuccgagaaguuguauaaacucgaagaacugcccgaugacuacauuaauuuagaaaaccagcugagcgagugcaauaacaauaagcagaucaccagggcacucgccguugcuuguauacuuggcaacauccuguucguguuguuuuucaaauuuauuuauaauaagcuaaucaacaauauuuaccggacuugcaaccuguguaauaugguccaucaccgcaagaaccucaaaaucuacucggaauuuacaaauaagugcgggaccugcguguguggauuuaacgaggagauacgaucuggcuucgauuaugaaguguucauuaaagacaugcacaucuuuagagauaauugccuguucaaguuuuacuccaaauauucaauuaucuacauauguaucauuauccuugucauuaaccugcaauuggguaugacgcucgccgaggaaaccgagacaaacugccugaauuuaccuaucagugcacagacucuggacauaguuaaguguuaugggcuaaaccucaauauuaccgaaaacaagcagaaaagcgaccugaucuccgagcuuaagucucaaaagacaaucacugaucaugacauuccagauuucaauaucauugacaugaagaccgagagcgcuuuugagaaaauagagacagccgaaaacauccacaggauggcguucuuggaguacauucuguauaagauggaaucaaagcucaauaccaucaaaacuaacaguggaccguacaauguggccuggcggacguacauuaaguaucauaaccuggaugcaugcggcaaauacccccacaagacaaucuguaccugcauaaaugcucaucuuuccuguagccagccuacuguagacucuaacucagagaucaaaaccuuuuauaguaaucaccagagcgccuucaagaacgauauuaaugugcugaucgagacaauuuccaucgcuuuucguggcauaauuaaagucucuaucaacuugcuccugaagaacaauaagaucgacgaauuaaaagagcugcuaaccaacauuucgaagaaacucgauacuaauauacagaugaaggggauccugcuuuucacagccgaacaauugaaaacgcaggagaccacuguaaagagcaugcagcagacacgcauggcaauuaucguuaagccacuggaguccaugaccggagacaaauuugauaacuucucaacaacuaauagaaacauuaccaagugcaaagaagccaagagucucucuuguuacaugacgaggaaaaauagcaucaacaaguaucuguuaugcaaucuggacgguuacaagauauuuuccuggcccgagaaaccuacccuuucaaucaacaauaacauuugcaucggcgacagccacuguaauuuguauuucaagccaauucucaacgaugaagcuaucaaaacaauaaauugcuacaagggggacuucacucccaacccgauggauaugggaucugcgauuaaaaagugugaggcaaaggaaaucggcgacugccuggugggugauaacaauauguggccuaucauucaauguuccaacgagaaauacuauuacgccgacgggaagaaucaugcuaaagagggcgauaucaacaguuauugccuaagcgaaaaguguaauaccgaccgguuucccauacacaacgagugguucaaaucuugcaaguggauuuccacaaucaaagaaucaauuagugucaaggaguuugugcaucuggauaucgaaagcuacaagaaaggaauagagucggacauucgaacugaucucaucauccacaaguuccgcccagugaaaaaucugccucacauugcccccaaguauaaauccaucaccauuucuggcauacuuguugcagacgggauccagaacgccuuugugagcggagagaugccagcuauuucagguuugggcaucggguacaaucuguauagucccgauggaacgaaguuauucgacaucguccucuuucugagaaaggccauuuacaaauccucuuacaaacuuauauauaaaacaggcccuaccaucgguauuaacguggaacauaaugagcaguguacugggagcugcccauccacaaucccgaagcaggaaggcuggcugaccuucucaaaagagcacacuagccaauggggaugugaagaguuuggcugcuuggcaauugacaccgggugccucuacggaaguugucaggauaucauaaggcccgagaugucuaucuauaagaugcugggugaagagaugacauccauugaaaucugccuaacgaccccuaaggagacuuacuguaacgaccuggaucuccuggagccacuuauuggcgacaaaaucgaagucagcuuccagacagugcagucgucacauaugcccaagauaauugcgguuaaaaauaacaagguguauaccgggcaaaucaaugauauuggaaacacagcuaauaucugcggcucuguacagauaaucaacaaaacugucauuggucaggggaacccuaaguuugacuacuugugucacgccaugaagcggaaagaugugaucguucgcaagugcuaugacaaucauuucgagaccuguaaacuguuagaagagagaagugaaauucucaucaaccaacaguccgauacgauagcagccagcaugucuggcaagaaucugggaauuaugaacuucaaauuugcucuuggcgacaucgauuacaagacauucaccgaggacgccagcuuugauaucaaggggcagugcgugggauguauuaauugcaucgaggaaauagucugugagcugaacauuguguccacuucaaguauccuaugcaccauuaaaacaccaugcgaaaauuaccacaacagccucgagaucaaucccgcaacuaccaaguaucacauaaaaaugucuuguccgcauaacaucgacaagaugaaaauuacaaucugcuccaaggaccuggaaaugccuuugacgcugaaacagcacgaucaaaagauugacuuaucaaagcucgaugagaguaauuacaucaaagaggaagaccugagguguagcaccuggcuuugcaagguaaaagaggaaggcauugguuucaucuuuuccgggauauucggaaacuuuggcaaguauuggacuauuuuccugaucguguugguuauccucgcuacaggucugcuaggcauuuuugucauauacccauguugcaaacgucugcggggguuccuugagaucaaugauauugccuaucucgcggaacagaagaugaaguga

SEQ ID NO: 11068 - RNA, 3231 nt, Artificial Sequence
  derived and/or modified CDS sequence (opt3) from HRTV(TN)__KJ740147.1__GP
augaucgugcccauuguccuguuccucacccuuugcccuagcgagcuguccgccuggggcucuccaggggacccgauaguuuguggagugagaacagaaacuaacaagucaauccagauugaguggaaagaagguaggagugagaaguugugccaaaucgaucgguuaggccacguaacgagcuggcugcgcaaucauuccucuuuucaggggcuagugggacaggucaaaggccgacccucggugucauacuucccugaaggugcuagcuauccacguuggagugggcuccugucccccugugacgcagaguggcuuggaaugauugccguuucuaaggcgggcgauaccgacaugaucgugccuggcccaacauacaaagggaagauauuugucgagagacccacuuauaacggauacaaggguuggggcugcgcugaugggaaaagccugucccacucaggaaccuauugugaaacagacaguagcgugucuuccggcuugauccagggugauaggguacucuggguuggggagguggucugccaacggggaaccccugugccagaagacguguucucagagcuggucagccugagucagucugaguuuccggauguuuguaagauugacggcguggcccucaaucagugcgaacaggaguccaucccccaaccuuuagauguagcauggauugacgugggccgcagccauaaaguccugaugagagaacacaagacuaaaugggugcaggagucgucugccaaggauuucguuuguuuuaagguggggcagggaccaugcuccaaacaggaagaggacgacuguaugucaaaggguaacugccauggcgaugaggucuucugcaggauggcuggguguagugcacggaugcaagacaaucaggaaggaugccgcugugagcuuuugcagaaacccggcgaaaucauagugaacuacggugggguaagcguucgaccuacaugcuauggcuuuuccagaaugauggccacccuggaggugcacaagccagauagggaacuaacgggauguacuggcugccaccucgaguguauugaagggggagucaaaaucgugacccugacaucugagcuucggagcgcuacugucugcgccucacauuucugugcgagugcaaaggguggcuccaaaaccacagacauucuguuucacaccggggccuuggugggacccaauagcauccguaucacgggccaacuccuggaugguucuaaguucucauuugacgggcauugcauuuucccggauggcuguauggcuuuagacugcacuuucugcaaggaguuucugcgcaacccucaguguuaccccguuaaaaaguggcuuuuccucgugguagucauaaugugcuguuacugcgcccugauguugcuaacaaauauccugagagcaauuggaguguggggcaccuggguuuuugcuccaaucaaacucgcccuggcgcuugggcugagguuggccaagcucaguaaaaagggacugguggcagucgugacucggggucagaugauaguaaacgaugaauuacaccagauucgaguggagcgcggcgaacaaaaugaggggagacagggauauggcccuaggggucccauccggcacuggcuguacagcccagcucuaauccucauucugacaaccuccaucuguucugggugcgacgagcuuguucaugccgaaagcaagucgauuacguguaaauccgcuucaggcaacgagaaggaaugcagugucaccggacgcgccuugcugcccgcagugaauccuggccaggaggccugucuccacuucucuaugccagggagcccggauuccaaaugccugaagauaaaagugaagucaaucaaccuuagauguaagcaggcuagcucuuauuacguccccgaggcgaaagcaaggugcacauccguucgucggugccgaugggccggagacugucaaaguggcugcccuacuuauuuuagcucuaauuccuucucagacgauugggcuaacagaauggacagggccggucuggggaugaguggauguagcgauggcugcgguggcgcagccugugggugcuuuaacgcugccccaucguguauuuucuggcgcaaguggguggaaaaucccuccaaccggguguggaaaguaucuccuugcgcaagcugggucuuggcggcuaccaucgagcucacacugccaucaggagaagugaagacuuuagagcccguuaccggccaggccacacagauguuuaaagggguggcaaucaccuaccugggaaguuccauugaaauagucggcaugacuagacuaugugagaugaaggagauggguacggggaucauggcccucgcuccgugcaaugacccuggacaugccauuaugggcaacgugggugaaauccaguguucuagcauugaguccgcaaagcacaucaggucagauggcugcauauggaaugcugaccugguugggaucgaacuucgcguggaugacgccguaugcuucagcaaauugacaagugucgaggcgguggccaacuuuucuaagauuccagcuaccaucuccggagugcgauucgaucaaggcaaucauggggaaagccggauuuauggaucgccccuggacaucacucgugucucaggcgaguuuucuguuaguuucagagguaugaggcucaaacuguccgagauaagcgcaucuuguaccggggaaauuacaaacgugagcggaugcuacuccuguaugaccggcgccucaguaaguaucaaguuacacagcucuaaaaauacuacaggucaccugaagugcgauuccgacgagacggcuuucucagugauggaaggcacccauacuuaccgcccucacaugaguuuugauaaagccgucauugacgaggaaugugugcuuaacugcgggggacauagcuccaaguugcuccugaagggcucucuaguuuucauggacgugccccgguuugucgaugggucguaugugcagacauaccacagcaaaguuccagcaggaggcagagugccuaaucccgucgacuggcugaacgcccucuucggugaugggaucaccagguggauacugggaaucauuggcguacuuuuggcgugugugaugcuguuuguuguggucguggcuaucacacgacgcuuaauuaagggccucacucagcgggccaaaguagcauga

SEQ ID NO: 11069 - RNA, 3231 nt, Artificial Sequence
  derived and/or modified CDS sequence (opt3) from HRTV(Patient2)__JX005844.1__GP
augaucgugcccauuguccuguuccucacccuuugcccuagcgagcuguccgccuggggcucuccaggggacccgauaguuuguggagugagaacagaaacuaacaagucaauccagauugaguggaaagaagguaggagugagaaguugugccaaaucgaucgguuaggccacguaacgagcuggcugcgcaaucauuccucuuuucaggggcuaauuggacaggugaaaggccgacccucggucucauacuucccugaaggugcuagcuauccacguuggagugggcuccugucccccugugacgcagaguggcuuggacugaucgccgugucuaaggcgggcgauaccgacaugauaguuccuggcccaacauacaaagggaagaucuuuguggagagacccacuuauaacggauacaaggguuggggcugcgcugaugggaaaucguugucccacucaggaaccuauugugaaacagacaguagcgucucuuccggccucauucagggugauagggugcuguggguaggggagguugugugccaacggggaaccccugucccagaagacguguucucagagcuggugagccucagucagucugaguuuccggaugucuguaagaucgacggcguugccuuaaaucagugcgaacaggaguccauuccccaaccucuggauguggcauggaucgacguaggccgcagccauaaagugcuuaugagagaacacaagacuaaauggguccaggagucgucugccaaggauuucguguguuuuaagguugggcagggaccaugcuccaaacaggaagaggacgacuguaugucaaaggguaacugccauggcgaugagguguucugcaggauggcuggguguagugcacggaugcaagacaaucaggaaggaugccgcugugaguugcugcagaaacccggcgaaauaauugucaacuacgguggggugagcguacgaccuacaugcuauggcuuuuccagaaugauggccacccuagagguucacaagccagauagggaacucacgggauguacuggcugccaccuggaguguaucgaagggggagugaaaauugucacccuuacaucugagcugcggagcgcuacugugugcgccucacauuucugugcgagugcaaaggguggcuccaaaaccacagacaucuuguuucacaccggggcccucgucggacccaauagcauccguauuacgggccaacuguuagaugguucuaaguucucauuugacgggcauugcauauucccggauggcuguauggcucuggacugcacuuucugcaaggaguuucuccgcaacccucaguguuaccccgugaaaaaguggcuuuuccugguugugguaaucaugugcuguuacugcgccuugaugcuacugacaaauauucucagagcaaucggagucuggggcaccuggguguuugcuccaauaaaacuggcccuugcgcugggguugaggcucgccaagcugaguaaaaagggauuaguugcaguggucacucggggucagaugauugugaacgaugaacugcaccagguacgaguggagcgcggcgaacaaaaugaggggagacagggauauggcccuaggggucccauccggcacuggcuauacagcccagcucucauccugauucuuacaaccuccaucuguucugggugcgacgaguugguucaugccgaaagcaagagcauuacguguaaauccgcuucaggcaacgagaaggaaugcagugucaccggacgcgcccugcuccccgcagugaauccuggccaggaggccugucugcacuucucugugccagggagcccggauuccaaaugccuuaagauaaaagucaagucaaucaaccugagauguaagcaggcuagcucuuauuacguucccgaggcgaaagcaaggugcacauccgugcgucggugccgaugggccggagacugucaaaguggcugcccuacuuauuuuagcucuaauuccuucucagacgauugggcuaacagaauggacagggccgguuuggggaugaguggauguagcgauggcugcgguggcgcagccugugggugcuuuaacgcugccccaucguguauuuucuggcgcaaguggguggaaaaucccuccaaccggguauggaaagucucuccuugcgcaagcugggugcucgcggcuaccaucgagcugacauuaccaucaggagaaguuaagacucuggagcccgugaccggccaggccacacagauguuuaaaggggucgcaaucaccuaccuaggaaguuccauugaaauagugggcaugacuagacucugugagaugaaggagauggguacggggaucauggcccuggcuccgugcaaugacccuggacaugccauuaugggcaacguuggugaaauccaguguucuagcauugaguccgcaaagcacaucaggucagauggcugcauauggaaugcugaccuuguggggaucgaauugcgcguagaugacgccgucugcuucagcaaacugacaaguguggaggcgguggccaacuuuucuaagauuccagcuaccaucuccggaguccgauucgaucaaggcaaucauggggaaagccggauuuauggaucgccccucgacaucacucguguuucaggcgaguuuucugugaguuucagagguaugaggcugaaauuauccgagauaagcgcaucuuguaccggggaaauuacaaacguaagcggaugcuacuccuguaugaccggcgccucagugaguaucaagcugcacagcucuaaaaauacuacaggucaccuuaagugcgauuccgacgagacggcuuucucagucauggaaggcacccauacuuaccgcccucacaugaguuuugauaaagccgugauugacgaggaauguguuuugaacugcgggggacauagcuccaagcuccugcuaaagggcucucugguguucauggacgucccccgguuuguggaugggucguauguucagacauaccacagcaaagugccagcaggaggcagagucccuaaucccguagacuggcucaacgcgcuguucggugaugggaucaccagguggauacuuggaaucauuggcguguugcuggccuguguuauguuauuuguggucgugguagcuaucacacgacgccucauuaagggccugacucagcgggccaaaguggcauga

SEQ ID NO: 11070 - RNA, 3231 nt, Artificial Sequence
  derived and/or modified CDS sequence (opt3) from HRTV(Patient1)__JX005845.1__GP
augaucgcccccgugguccuguucuuuacccucugcccuagccagcuuuccgcuuggggcucuccaggggacccgauuguuuguggagugagaacagagacuaacaagucaauacaaaucgaauggaaagaggguaggagugaaaagcugugccagauugaucgguugggccacguaacgagcugguuacgcaaucauuccucuuuccaggggcugaucggacaggugaaaggccgacccucggucucauacuuuccugagggugcaagcuauccacguuggagugggcuacucucccccugugacgccgaauggcugggacuuauugcggugucuaaggcuggcgauaccgacaugaucguuccuggcccaacauacaaagggaagauauucguggagagacccacuuauaacggauacaaggguuggggcugcgccgaugggaaaagccugucccacucaggaaccuauugugagacagacaguagcgucucuuccggcuugauccaaggugauagggugcucuggguaggggaaguugugugccagcggggaaccccugucccagaggacguguuuucagaacugauuagccugagucagucugaguucccggauguguguaaggucgacggcguugcacucaaucagugcgagcaagaauccaucccccagccuuuagauguggccuggauugacguaggccgcagccauaaagugcugaugagagagcacaagacuaaauggguccaggaaucgucugcuaaggauuuuguguguuucaagguugggcagggaccaugcuccaaacaagaggaagacgacuguaugucaaaggguaacugccauggcgaugagguguuuugcaggauggcaggguguagugcccggaugcaggacaaucaggagggaugccgcugugaacuuuugcaaaaacccggcgagaucauagucaacuacgguggggugagcguacgaccuacaugcuauggcuucuccagaaugauggcuacccuggaaguucacaagccagauagggagcuaacgggauguacuggcugccaccucgaauguauugaagggggagugaaaaucgucacccugacaucugagcuucggagcgccacugugugcgcgucacauuuuugugcaagugccaaggguggcuccaaaaccacagacauucuguuccacaccggggcuuuggucggacccaagagcauccguaucacgggccagcuccuggaugguucuaaguuuucauucgacgggcauugcauuuucccggauggcuguauggccuuagacugcacuuuuugcaaagaguuccugcgcaauccucaguguuaccccgugaagaaauggcucuuucuuguugugguagucaugugcuguuacugcgcacugauguugcuaacaaacauacugagagcuaucggaguguggggcaccuggguuuucgccccaauuaagcucgugcuggcgcuugggcugagguuggccaaacucaguaagaagggacuggucgcagugguaacucggggucagaugaucgugaaugaugaguuacaccaaauacgaguugaacgcggcgagcagaacgaagggagacugggacacggcccuaggggucccguccggcauuggcuauauagcccagcucucauucugauccuuacaaccuccaucuguucugggugcgacgaguuggugcacgccgagucgaaaagcauuacguguaaguccgcuucaggcaaugaaaaagagugcagugugaccggacgcgcccugcuccccgcagucaacccuggccaggaagccugucugcauuuuucuaugccagggagcccggauuccaagugccuuaaaaucaagguuaagucaauuaaucugagauguaaacaggcuagcucuuacuaugugcccgaggcgaaggcaaggugcacauccgugcgucggugccgaugggccggagacugucaaaguggcugcccuacuuacuucagcucuaacuccuuuucagacgauugggcuaauagaauggacagggccgguuuggggaugaguggauguagcgauggcugcgguggcgcagccugugggugcuucaacgcugccccaucguguauauuuuggcgcaaauggguagagaaccccuccaaucgggucuggaaggugucuccuugcgcaagcuggguucucgcggcuaucauugaacugaccuuaccaucaggagaggugaaaacacuggaacccgucacuggccaggccacccagauguucaaggggguggcaaucacauaucuaggaaguuccaucgagauuguuggcaugaccagacucugugaaaugaaggagauggguacugggauaauggcccuggcuccgugcaacgacccuggacacgccaucaugggcaaugugggugagauucaguguucuagcaucgaauccgcaaaacauauuaggucagauggcugcaucuggaacgcugaccuuguagggauagaguugcgcgucgaugacgccgugugcuuuagcaagcugacgaguguggaagcggucgccaauuucucuaaaaucccagcuauuaucuccggaguucgauuugaucaaggcaaccacggggagagccggauuuacggaucgccccucgacaucacaaaggugucaggcgaguucucuguaaguuuccgugguaugagacugaaauuauccgaaauaagcgcaucuuguaccggggagauuacuaaugugagcggaugcuauuccuguaugaccggcgccucagucaguaucaagcugcacagcucuaaaaacacaaccggucaucuuaagugcgauuccgacgaaacugcuuuuucagugauggagggcacacacacguacaggccucauaugaguuucgauaaggccguuguggacgaagagugugucuugaauugcgggggacacagcuccaaacuccugcuaaagggcucucugguguuuauggacguuccccgcuucguggaugggucguacguccagaccuaucacagcaaaguaccagcaggaggccgggugccuaaccccguugacuggcucaaugcgcuguuuggugaugggauuacuagauggauccuuggaauaaucggcguguugcuggccugugucuuacucuucgugguaguggucgcuauuacaaggcgacugaucaagggccuuacccagcgcgccaaaguugcauga

SEQ ID NO: 11071 - RNA, 3942 nt, Artificial Sequence
  derived and/or modified CDS sequence (opt3) from PTV(PAN472868)__NC_027201.1__GP
augaucuucaccauucugaacgugcucacaagagccaugcuugucaugagcauguacucccugacuacgugggacucuaccucaaggaaugauaugugcuuuaguaacgacagccccuuggagggcuuaguuuauuacugggaaacacacuccaagaaacaugauuauaagaaacaggagucucaacggugucgcgugggggacucggauaagaaaaugauaacuaauguaaccaucauuucacugaucagcgaaauucagaagaguaucuccgagcuaucucucagcugcggaaacgacgauaauuccacaggucaggugcugaccuucaacggccuugaagacacuauacagggggauuacaucgucgacugugugacaggacuguaucaaucagauauuggcguuggugugggguugggaaagacccaccaugaccaccagcaggucaaaaauaaggcugugguaaucgaugagaaagagcgaaugauuaguuuucucgaaacgcagcaaagcgagaacgacaucaagaugcagguucugaugucugaaauagagcagcugaaaaaucagcucuccaagaagcguaacgagagaggccaagaaaagagggacgcagagaaggugaugucagauuuaauggcccggaauagcgaccugcgcaaacauaacgauauucuuacugcggaaaucagucagauggagaauaacaauaccauucagagaaacaagaacgucaugucuacaacuguggugccugcuaucuuguccgucgcccugcuaagcucgucuaucgcaccaauuauggccgcuuccccggacucacccaugauaaauccuuggccacacgccaaaaacaggguuggcaccgggauguacaaguaugaugaaaaugacgauaguggaugccggcccauccgcuacggugugagcuguauuggcuucgacuuuaugcucaaaauggauaaguacccuuucuuuaacgcauucaucgggcacaagacaccacuggaguccuuugcugacaaaauaauugagaaggaagaggaaaccugcgagaucggaacgaauaaagaauuuaaguguuucgaggagcgagccuauaucaaaggcacuugccccacaaacauuaaugcgguacauuacaucgauaacaaggguaaacuuagauaugugaaauguaaggaaaaucuggagaugaccgaagacugcgcauucuguaggaaaauuaagaaaaaggccgggcaaucuauacagguccagaagacuagcgugccuuugcaggacgcuaucugccaagagaacucagauacauacaguggaccaaaaauuccguuuaagggcguuugcaaaaucggccucaucaaguauaaagaauguaaguucaagaccuccagcuacgagacggugucuuucauuacccugaaagagaaggggaaaauauauaucgaacacuuaaugcugaagaauauugaggucgugacaaacguaucauuuguuugcuacgaacaugccggacaggacgagcaggagguggaacaccgggcacucaaacgugucagugugaaugauuguaagaucgucgacaacagcaaacagaagauuugcacuggugaucacaucuucugugagaaguacgacugcuccaccucuuaucccgaugugacauguauacaugcuccuggcucggggccacuuuacaucaaucugaugggaagcuggauuaaaccccaaugcguuggcuaugaacgcguguugguagacagagaggucaagcagccucuacuggccccagaacagaacugugauacuugcguguccgagugucucgacgaggguguucacaucaaaucaaccggguuugaaauuacaagugcgguggccugcucucauggcagcugcaucuccgcacaccaggaggcuucaaccagcgucauagugcccuacccgggacugcuugccucuguaggcgggaggauuggaauccaucugucccacacuucugauagcgcuucugugcacaugguugucguguguccuccccgggacuccugcgccgcacauaacuguuugcucugcuaucacgguauucugaauuaccaaugucauucaacguuaagugccauccugacgagcuuccuacucauacuguuuaucuauaccguguucucggucacuaccaacaugcuuuacguuuugcgacugauuccaaagcagcucaaauccccugugggcuggcugcgccuuuuuaucaauuggcuguugacagcucucagaauuaagaccaggaacgugauggggcggaucaaucagcgcauaggauggguagaucaccacgacgucgaaagacccaggcaucgugagccaaugcggcgauucaagacuacacuguuacugacgcuaauuaugaugaccggcgguaacgcgugcucuaauacugugguugcaaacagcaaacagacaagaugugugcaagaagggucaaguaccaagugcuccaucacagccacuaucacccucagggcuggcgucauuggagccgagucuuguuuuaucauuaaaggccccauggagaaucagcagaagacgauaagcaucaaaaccauuuccucagaaacagugugccgcgaggggagcaguuucuggacuucucuguacaucccuuccugucuuagcucgcggagaugccacuugguuggagacugcguggguaacaagugucaaucauggagggaugaccagcugucucgcgaauuuaguggcguaaaggauaaucauauuaugaacgagaauaaaugcuucgaacaguguggggcaaucggaugcggcuguuuuaacauaaauccauccugccucuauguccacgccuacuuaaagagcgcucgaaacgaggccgugcggguguucucuuguagcgacuggguccaucguguuuccuucgaggugaaagguccggauggggaaaccgagcugguaacacugggcucacuuggaacuaaguuuuugaacuggggcacccucagucugagccuagacgcagaagggaucucuggaacaaauuccauuucauuccuggagaguagcaaaggcgguuuugcgcucuaugaugagggguacuccgaaauccccagagagggauuccugggcgaaauuaggugcaguucggagagcgcugccaucucagcacacaaguccuguauacgcgccccuggucuuauuaaguauaaaccaaugacagaccagaucgaaugcaccgcuaguuugguggaucccuuugccaucuuccugaagggcucuuuaccucaaacucggaacgggcagacauuuaccagcacuaaagacaagaaaaccguccaggcauucacaaauggagcuauuaaggcccuccuguccauaaaccuugaugaccacgagaucguguuuauuaauaaaguuagaucaugugaugcgacguuccugaacgugucuggcugcuacagcugcgacuauggggcccaugucugugugaagguuaagaguuccgagagcgcugacuuuuucgcagaaucugaggauaaaaccacuguguugucauuuccaauccaguccggaacacacgacuacugccaaguccuccauuuccagaagccccugguagaugaaaggcuaaguuacagcuguggcucggagccgaaacugauugugaucaaggguacccucguuuauauggggguguacgacuuccgaaauaaaacaggagggucuuccacugucgugaacccuagcgaaggugccuggucaauaaguaauugguuuucuggccugcuugauugguugggcggaccaaugaaggcuauccugaagauuuuaggcuucaucgccauugggaucguaugcuuuauacucuucaugauucugauccgcaucgcagugaacuccauuaauaucaaaaagaaaaacuga

SEQ ID NO: 11072 - RNA, 3942 nt, Artificial Sequence
  derived and/or modified CDS sequence (opt3) from PTV(Adames)__KR912209.1__GP
augaucuucaccauucugaacgugcucacaagagccaugcuugucaugagcauguacucccugacuacgugggacucuucaaguaggaaugauauaugcuuuagcaacgacucccccuuggagggcuuaguuuauuacugggaaacccacucuaagaaacaugauuauaagaaacaggggucgcaaaagugucgggugggagacucagauaaaaagaugaucagcaauguaacaauuaucagucugauuuccgagauccagaagucuauaagcgaacuaucccucucaugcgguaacaaugacaacaguacuggccaggugcugaccuucaaugggcuugaggauacaauccgcggagacuacauugucgauugugugaccggccuguaucagagcgacaucgguguuggggugggauugggccgaauuaaccacgaucaucaacaggucaaaaauaaggcugugguaaucgacgaaaaagagaagaugauaucucuccuggagacucagcaguccgaaaacgauauuaaaacacaaguucugaugucagagaucgaacagcucaagaaucaguuaagcaagcguagaaacgagaggggccaggagaaacgggacgcagaaaagcugaugagugaccuuauggcccgcaauucugauuugagaaaccacaaugugauucugaccgacgagaucucccaaaucaaaaacaacauuacgauacauaggaaucggaacaugaugagcacuaccgucgugccugcgauccuaucgguggcucuccugucuuccucagucgggccaauuacagccgcaccgcccgauaguacuaugaucaauccuuggccacacgccaagaaccgcguuggaaccgguauguacaaauaugacgaaaaugaugagagcggcugccgacccauaagauacgggguguccuguauuggauuugacuucaugcuuaagauggauaaauacccuuucuucaacgcuuuuaucggccacaagacaccacuggaaucuuucgcagacaagaucauugagaaagaggaagagaccugcgaaaucgguacgaauaaggaguuuaaauguuucgaagagagggccuauauuaaggggacuugccccacaaacauaaaugcuguacauuacaucgauaacaaaggaaaguugcgguaugugaaguguaaagagaaucucgaaaugaccgaggacugcgccuuuugucguaagauuaaaaagaaagcgggccagagcguccaggugcaaaagacuucaguuccucugcaggaugcaaucugccaggaaaacagugacaucuacuccggcccaaagauuccguucaaaggggugugcaagauaggauuaaucaaauauaaggaguguaaauuuaagacaagcucuuacgaaaccauuucauucaucacgcugaaggguaaaggcaagauuuauaucgagcaccucaugcuuaaaaauauagaggucgugaccaacguaaguuucguuugcuacgaacaugccgggcaggacgagcaagaaguggagcaccgcgcucugaagagagucagcgugaaugauuguaaaaucgucgacaacuccaagcagaaaauuugcacaggagaucacaucuuuugugagaaguacgacugcucuacuucguaucccgaugugaccuguauucauacaccuggcagcgguccauuguacaucaaccuaaugggguccuggauaaagccccagugcguuggcuaugaaagggugcugguagaccgggaggucaaacagccucuccuggugccagaacaaaauugugauacuugcguuucagagugucuugacgaaggagugcacauuaagaguaccggcuucgagaucacaucugccgucgcaugcagccauggguccugcauuucagcucaccaggaggccagcaccucugugaucauacccuacccgggacuguuggcguccguagguggccgaaucgggauucaucucagucacacuagcgauucugccuccgugcacaugguugucguguguccuccccgcgacucaugcgcagcucauaacugucuguuaugcuaucacggaauccugaauuaccagugucauaguacgcuaagcgccauucucacaucguuucugcuuaucuuguucauauauaccgcuuuuuccgugacuaccaacguccuguacguucucagacugauuccaaaacagcuuaagucuccugugggcuggcugaaauuguucgugaauuggcuccugacagccuuaaggaucaagacccggcgcguaauggguagaaucaaccaaaggauugggugggucgaucaccacgacguggaacguccccggcaucgagagccaaugagaagguuuaagacuacacugcuacucacgcugaucaugguuaccggcggaaaugcaugcagcaacacuguggucgccaauucaaaacagacacgcugugugcaggaaggcaguaacaccaagugcuccauuacagcuacuauaacccuucgggcggggguuaucggagcagagucuuguuucauuaucaaaggucccauggaaaaucagcaaaagacgauuagcaucaaaaccauauccucagagacagugugcagagagggcagcaguuuuuggacuucuuuguacaucccuuccugucugagcucgaggcgcugccaccucguaggggauugcgucggaaacaagugucagucauggcgagacgaccagcugucucgggaauuuaguggcgugaaggauaaucauauuaugaacgagaauaaaugcuuugaacaauguggugccaucgggugcggcuguuucaacauuaacccauccugcuuauaugugcacgcuuaccugaagucugcccguaaugaggcagucagaguguuuucuuguagcgacugggugcauaggguauccuucgaagugaaaggaccggauggcgagauggagcuugucaccuuggggucacucggaacaaaguuccugaacuggggcacucuaagucugagccucgacgccgaagguaucucugggaccaauuccauaucauuucuggagaguagcaaaggaggcuucgcucuuuaugaugaagguuacuccgagauuccccgcgagggcuuuuugggggaaauccggugcagcucggagagcgccgcaaucucagcgcacaaguccuguauuagagcuccuggacugauaaaguauaaaccaaugacggaccagaucgaaugcacagccaguuuaguggaucccuucgcaauuuuucucaagggcucucugccucagaccaggaacgggcagacuuucacaagcaccaaagacaagaaaacuguucaagccuuuaccaauggagcuaucaaggcccuucuguccauuaacuuggaugaccacgagaucauauucaucaauaaagugaagucaugugaugcaacauuucucaacgucucuggcugcuacagcugcgacuauggugcucauguguguguuaaggugaaaaguuccgaaagcgccgauuucuuugcggagucugaggacaagacgaccguccugucauucccaauucaguccgggacucgagacuacugccagguacuacacuuucagaaaccccugguggaugaacgccucaguuacagcuguggaucggagccgaagcugaucguuauuaaaggcacacuuguguauaugggugucuacgacuuccgggauaagaccggcgggucuuccacagugaucaauccuagcgaaggaacuuggucaauaaguaacugguucucuggcuugcuggacugguuagggggaccaaugaaggccauucucaaaauccugggcuuuaucgcuauugguaucguaugcuucauacuuuuuaugauucugaucagaauugcaguuaauuccaucaacauaaagaaaaagaauuga

SEQ ID NO: 11073 - RNA, 3942 nt, Artificial Sequence
  derived and/or modified CDS sequence (opt3) from PTV(Balliet)__KR912213.1__GP
augaucuucaccauucugaacgugcucacaagagccaugcuugucaugagcauguacucccugacuacgugggacucuaccucaaggaaugauaugugcuuuaguaacgacagccccuuggagggcuuaguuuauuacugggaaacacacuccaagaaacaugauuauaagaaacaggagucucaacggugucgcgugggggacucggauaagaaaaugauaacuaauguaaccaucauuucacugaucagcgaaauucagaagaguaucuccgagcuaucucucagcugcggaaacgacgauaauuccacaggucaggugcugaccuucaacggccuugaagacacuauacgaggggauuacaucgucgacugugugacaggacuguaucagucagauauuggcguuggugugggguugggacguacccaccauggccaccaacagaugaagaauaaagcugucgugaucgacgagaaggagagaaugauuagucuccuggaaacgcagcagagcgagaacgauaucaaaaugcaaguacugaugucugaaauagagcagcucaagaaucaguuauccaaaaagaggaacgagcggggccaggaaaagcgcgacgcagagaaaguuaugucagaccugauggccagaaauagcgaucuuaggaagcauaacgacauuuugacugcggaaaucagucaaaugaaaaauaagaacaccauucagcggaauaaaaacacagugucuacuaccgucgugccugcuauccuguccguggcccuacucagcucgucugucgcaccaaucauugccgcuccgcccgauuccccuaugauaaacccauggccccacgcaaagaaucgcguugggacaggaauguacaaauaugacgagaacgaugacucagguugccgaccuaucagauacggcgugaguuguauuggguuugauuucaugcugaagauggacaaguacccauuuuucaaugccuuuaucggacacaaaacgccccuugagagcuucgcugauaagauaauugaaaaagaggaagagaccugcgaaaucggcacuaacaaggaguuuaaauguuucgaagagagggccuauaucaaggguacaugcccuaccaauauuaacgcgguacauuacaucgacaauaaggggaaacugcgguaugugaaguguaaagagaacuuggaaaugacugaggauugcgcauuuugucguaagauuaaaaagaaggccggacaguccguccaagugcagaaaacaucuguuccacuccaggacgcuauaugccaggaaaauagcgacaccuacucaggcccgaagauccccuucaaaggcgugugcaagauugggcugaucaaauauaaggaguguaaguuuaaaacgaguuccuacgaaaccgucagcuucaucacauuaaaggagaaaggaaagauuuauauagagcaccugaugcucaaaaacaucgaagugguaacuaauguuucuuucgugugcuacgagcaugucggucaagaugaacaggagguggagcaccgcgcccuuaagagagucucagugaacgacuguaaaauuguugauaauaguaagcagaagaucugcaccggcgaccacguguuuugugaaaaauacgauugcagcacauccuauccugacguaacuuguauucaugcaccagggucuggaccccuguacaucaacuugaugggcucguggauaaagccucagugcgucgguuaugagagggugcuaguugaucgggaagugaaacaaccacugcucgcucccgagcagaauugugauaccugcgucagcgaaugucuggacgagggggugcacaucaaguccacaggcuucgagauuaccucagccguagcgugcagucauggaucuugcaucagcgcccaccaggaaccguccacuucagugauuguuccuuaccccggccuucuggcaagcgucgggggacgaaucgguauacauuugucucacacguccgacagugcuagcgugcacaugguggucguuuguccaccucgcgauucuugcgccgcucauaacugucuccugugcuaucacggcauuuuaaacuaccagugucauuccacacugucagccauccuaaccaguuuucuccugauucuuuucaucuauacuguguuuagcgugaccacaaauauauuguacguacugagacucauccccaaacaacugaagucgccagucggguggcuuaagcuguucauuaacugguugcucaccgcacugaggaucaaaacucggaaugugaugcgcagaauuaaccagaggaucggauggguugaccaccacgauguggagcguccccggcaucgagaaccuaugagaagguuuaagacaacguuacugcuaacccucauaaugaugacuggcgguaaugccugcuccaacacagucguggcuaauucuaaacagacccgcuguguucaggaggggagcaacacaaagugcucaauuacugcgaccaucacgcugcgggcaggcgugaucggagccgaaaguuguuucauuaucaaaggcccaauggagaaucaacagaagaccauuuccauaaagacaaucucuagcgagacuguaugcagagaaggguccucauuuuggaccagccuuuacauuccgaguuguuugucuuccaggcgcugccaccuggucggagacugcguggguaacaaaugucagagcuggcgagacgaucaacucucgcgggaguucucaggcgugaaggacaaucauaucaugaacgaaaauaaaugcuuugagcaguguggggcuauuggaugcggcuguuucaacaucaaucccucuugccuguauguccacgccuacuuaaagagugcacguaacgaagccguuagaguguuuuccuguagcgauuggguacauagggugucuuucgaggucaaagguccugacggggagacagaacuggugacucuuggcagcuugggaaccaaguuccucaacuggggcacgcugucccuaucacuggaugcugaggggauaaguggaacaaauagcaucucuuuucucgaauccucaaagggcgguuucgcccuguaugacgagggguacaacgagauuccacgcgaaggauuucuuggcgagauccggugcaguagcgaauccgcagcgauuucugcucacaaaucguguaucagagcccccgguuugauaaaguauaaaccuaugaccgaucagauugagugcacugcaagccugguugacccauucgccaucuuuuuaaagggcucacucccccagacaaggaaugggcaaaccuucacuuccaccaaagauaagaaaacagugcaggcuuuuacgaacggagccaucaaggcacugcuuaguauuaaucuggacgaucacgaaauagucuucaucaacaaggugaaaaauugugacgcuaccuuuuugaacguuucuggcugcuacagcugcgauuauggggcccaugugugugucaagguaaaauccucagagucugcggacuucuuugccgagagcgaagacaagacuacagugcucaguuucccgauucaguccggaacccacgauuacugccagguucugcauuuucaaaaaccucuaguggacgagcgacugagcuacucuuguggcucagaaccaaagcucaucgucauuaaggguacacugguguauauggggguauacgauuuccgcaauaaaacuggaggcuccaguaccguggucaaccccagcgagggugcuuggucgaucucuaauugguucuccggccuuuuggacugguuagggggaccuaugaaggcaauacugaaaauccucggcuuuauugccaucgggauuguuugcuucgugcuguuuaugauccuuauacggauugcugugaacagcaucaauaucaagaaaaagaacuga

SEQ ID NO: 11074 - RNA, 3942 nt, Artificial Sequence
  derived and/or modified CDS sequence (opt3) from PTV(PaAR2381)__KP272005.1__GP
augaucuucaccauucugaacauacucacaagagccaugcuugugaugagcauguacucccugacuacgugggacucuaccucaaggaaugauaugugcuuuaguaacgacagccccuuggagggcuuagucuauuacugggaaacacacuccaagaaacaugauuauaagaaacaggagucucaaaagugucggguuggggacucggauaaaaagaugaucucaaaugugacuauuaucagccugauuagugaaauccagaaguccauaucugagcuaagccucuccugcggaaacgacgauaauucaaccggucagguacugacauucaacggccuugaagacaccauccgcggggauuacauuguggacugugucacuggacuguaucagagugauaucggcguggguguuggguugggacgaacacaccaugaccaccaucaagugaaaaauaaggcugucgugauugaugagaaagagcguaugaucagccuccuggaaacccagcagucugagaacgacauaaagaugcagguacugauguccgaaauugagcaacucaaaaaucaguuaucaagaaagaggaacgagcggggccaggaaaagcgcgacgcagagaaaguuaugagcgaucugauggccagaaauagugaccuuaggaagcacaacgauaucuugacggcggaaauuucucagaugaaauacaauaacacuauccaacgguccaagaaugugaugagcaccacagucgugccugcuauccugucgguggcccuacucucuuccucagucgcaccaauuauggccgcuccgcccgacaguccuaugauaaacccauggccccacgcgaaaaaccgcguuggcacugggauguauaaguacgaugacaaugaugacagcggaugccgaccuaucagauacgguguguccuguauuggcuuugauuucaugcugaaaauggacaaguauccauuuuucaacgccuuuaucgggcauaagacaccccuugagucuuucgcugauaaaauaauugaaaaggaggaggaaaccugcgagaucggaaccaauaaagaauuuaaguguuucgaggaaagggccuacaucaaaggcacgugcccuacuaacauuaaugcgguacacuauaucgacaacaaggguaagcugcgguacgugaaauguaaggagaauuuggagaugacagaagacugcgcauuuugucguaaaauuaagaaaaaggccgggcagagcguccaggugcaaaagaccucaguuccacuccaggaugcuauaugccaggagaacagugacaauuauuccggaccgaaaauccccuucaagggcgugugccgcauuggccugaucaaauacaaggaauguaaauuuaagacuagcucuuaugagacagucucauucaucaccuuaaaggaaaaagggaagauuuacauagagcaucugaugcucaaaaacaucgaggugguaacgaauguuaguuucgugugcuacgaacacgccggacaggaugagcaagaagucgagcacagagcacuuaagagggugagcgucaacgacuguaaaauuguggauaauuccaagcagaaaaucugcaccggugaccauguguuuugugagaaguaugauugcucuacaucguacccugacguuacuuguauucacgcuccaggcagcgggccccuguauaucaacuugaugggauccuggauaaagccucagugcguaggcuacgaacggguccuaguggaucgagagguuaaacagccacugcucgcccccgaacaaaauugugauaccugcgugucagagugucuggacgaagguguccauaucaagaguacaggguucgagauuacuucugcgguggccugcagccacggcuccugcaucucagcacaucaggaggcuagcaccucuguaauugugccguauccuggacuucuggccuccguuggcgggcgcaucggaauacacuugagucacacaagcgacucugcuuccguccauauggugguggucugucccccaagagauucaugcgaagcccacaacugucuccugugcuaccaugguauuuuaaacuaucagugucacaguacccugagcgcaauccuaacuucguuucuccugauucuuuucaucuacacgguguuuuccguuacaaccaauauguuguacgugcugaggcucauaccuaaacagcugaagucucccguaggcuggcuuaaacuguucaucaacugguugcucacugcccugcggauuaagacccgcaaugucauggggagaaucaaccaaaggauuggauggguggaccaccaugacguugagcguccacggcaccgagaacccaugagaagguuuaagacaaccuuacugcuaacucucaucaugaugacaggcgguaaugcuugcagcaacacgguggucgcaaauucaaaacagacccgcugugugcaggaggggaguaacacuaagugcuccauaacagcaaccauuacacugcgggccggcguuaucggagcugaaucuuguuucaucauuaaaggcccuauggagaaucagcaaaagacuaucagcauuaaaaccauauccucagagacggugugcagagaagggagcaguuuuuggaccucucuuuauaucccauccuguuugagcucgaggcgcugccaucugguaggagauugcgucgguaacaagugucagucauggcgagacgaucagcucucucgggaguucaguggcgugaaggacaaucacauuaugaacgaaaauaaaugcuuugagcaauguggggccaucggaugcggcuguuucaacauuaauccguccugccuguacgugcaugcauauuuaaagagcgcccguaacgaagcugucagaguguuuucuuguagcgauuggguucacaggguauccuucgaggugaaaggucccgacggggagacagaacuggucacucuuggcucauugggaaccaaguuccucaacuggggcacacugagucuaagccuggaugccgaggggaucucuggaacuaauuccauaucauuucucgaaaguagcaaaggcgguuucgcacuguacgacgagggguauuccgagaucccucgcgaaggauuucuuggcgagauucgguguucuucggaaagcgcggcuaucucagcccacaaguccugcauuagagcaccagguuugaucaaguacaaacccaugaccgaucagauagagugcacggccagucugguggacccuuucgcuaucuuuuuaaagggcucucucccacagacaaggaacgggcagaccuucacuagcacaaaagauaagaaaaccguucaagccuuuacuaauggagcaauuaaggcucugcuuuccaucaaccuggacgaucaugaaauuguguucauaaauaaagucaagucaugugacgccaccuuuuugaacgugucuggcugcuauagcugcgacuacggggcgcacguuugugugaaggucaaaaguuccgagagcgccgauuucuuugcugagucugaagacaagacaacgguacucucauuccccauccaguccggaacccaugauuacugccaggugcugcacuuucagaaaccgcuaguugacgagcgacugaguuauagcuguggcucggaaccuaagcucauugugaucaaagguacucuggucuacauggggguguaugauuuccgcaauaagacaggagggucuuccaccguagugaacccaagcgagggugcauggucaauuaguaauugguucucuggccuuuuggacuggcugggcggacccaugaaggccaucuuaaaaauacucggcuuuaucgcuauugggaucgucugcuucauucuguuuaugaucaugauacggauugccguuaacuccaucaauaucaagaaaaagaacuga

SEQ ID NO: 11075 - RNA, 3942 nt, Artificial Sequence
  derived and/or modified CDS sequence (opt3) from PTV(PAN483391)__KP272008.1__GP
augaucuucaccauucugaacauacucacaagagccaugcuugugaugagcauguacucccugacuacgugggacucuaccucaaggaaugauaugugcuuuaguaacgacagccccuuggagggcuuagucuauuacugggaaacacacuccaagaaacaugauuauaagaaacaggagucucaacggugucgcguuggggacucggauaagaaaaugaucacuaaugugaccauuaucucacugauuagcgaaauccagaagaguauauccgagcuaucucucagcugcggaaacgacgauaauuccacaggucagguacugaccuucaacggccuugaagacacuauccgaggggauuacauuguggacugugucacaggacuguaucagucagauaucggcguggguguuggguugggacguacccaccaugaccaccaacaggugaagaauaaagcugucgugauugaugagaaggagagaaugaucagucuccuggaaacgcagcagagcgagaacgacauaaaaaugcaaguacugaugucugaaauugagcagcucaagaaucaguuauccaaaaagaggaacgagcggggccaggaaaagcgcgacgcagagaaaguuaugucagaucugauggccagaaauagcgaccuuaggaagcauaacgauaucuugacugcggaaauuagucaaaugaaauacgacaauaccauccagcggaacaagaaugugaugucuacaacugucgugccugcuauccuguccguggcccuacucagcucgucuauugcaccaauaauggccgcuuccccggauucacccaugaucaacccuuggccacacgcuaaaaaccgcgucggcaccgggauguauaaguacgacgagaaugaugacaguggaugccgacccauuagauacgguguuagcuguaucggcuuugauuucaugcugaaaauggacaaguauccauuuuucaacgccuuuauagggcacaagacaccucuugaauccuucgcugauaaaauuaucgagaaggaggaagagaccugcgaaaucggaacgaauaaagaguuuaaguguuucgaagagagggccuacauuaaaggcacuugccccacaaacaucaaugcggugcauuauauugacaacaaggguaagcugcgguacguaaaauguaaggagaauuuggaaaugaccgaggacugcgcauuuugucguaaaauaaagaaaaaggccgggcagucugugcaaguccagaagacuagcgugccucuccaggaugcuaucugccaggaaaacucagacacauauaguggaccaaaaauuccguucaagggcguuugcaaaaucggccugaucaaguacaaagaguguaaguuuaagaccuccagcuaugaaacggugucuuucauuaccuuaaaagagaaggggaaaauauacaucgagcaccugaugcucaagaauauugaagucgugacaaacguaucauucguuugcuacgagcaugccggacaagaugaacaggagguggagcaccgcgcacuuaaaagagucagugugaaugacuguaagaucgucgauaacagcaaacagaagauuugcacuggugaccacguguuuugugaaaaguaugauugcuccaccucuuaccccgacguuacauguauccaugcuccuggcucggggccacuguauauaaauuugaugggaagcuggaucaaaccccagugcgugggcuacgagaagguacuggucgauagggaagugaaacaaccucugcucgccccagagcagaacugugacacuugcguuuccgaaugucuggaugagggugugcacauuaagucaaccggguucgagaucacaagugcggucgccugcucucauggcagcugcauuuccgcacaccaggaagcaucaaccagcgugaucguacccuauccgggacuucuggccucugugggcgggaaaauagguauucauuugucccacacuucagacagcgcuucuguucacauggucgugguguguccuccccgggauuccugcgccgcacauaauugucuccugugcuaccacggaaucuuaaacuaucagugucauucaacgcugagugccauucuaacuagcuuucuccugauccuuuucauauacaccgucuuuucgguuacuaccaacauguuguacgugcugcgacucaucccaaagcaacugaaguccccugugggcuggcuucgccuguucauuaauugguugcucacagcucugagaaucaaaaccaggaacguaauggggcggauuaaucagcgcaucggaugggucgaccaccacgacguggagagacccaggcaucgugaaccaaugcggcgauuuaagacuacauuacugcuaacgcucauaaugaugaccggcgguaacgcgugcucuaauacuguuguggcaaacagcaaacagacaagauguguccaggaggggucaaauaccaagugcaguauuacagccacuaucacccugaaagcuggcgugaucggagccgaauccuguuucauuaucaagggccccauggagaaccaacagaagacgauuucuauaaaaaccaucagcuccgagacaguuugcagggaagggaguagcuuuuggacaagucuuuauauuccuucuuguuuguccagccgccggugccaccuggugggagauugcguagguaauaagugucagucguggagagacgaucaacucucaagggaguucucuggcgucaaagacaaccauaucaugaaugaaaacaagugcuuugagcaguguggggcaauuggaugcggcuguuucaauaucaacccaaguugccuguacgugcacgccuauuuaaaauccgcucgcaaugaagccgugcgagucuuuagcuguucugauuggguucaucgggugagcuucgagguaaaggguccggacggggagaccgaacuggugacacuuggcuccuugggaacuaaguuccucaacuggggcacccugucacuaagucuggaugcagaggggauaagcggaacgaacucuaucuccuuucucgaaucaaguaaaggcgguuucgcgcuguacgacgagggguauagcgagauuccccgugaaggauuucuuggcgagaucagaugcuccucugaaucggcugccauuagcgcacacaagucauguaucagggccccugguuugauaaaauacaagccaaugacagaucagauugagugcaccgcuucccuggucgaccccuucgccaucuuuuuaaaaggcagucucccucagacucgcaaugggcaaacauucaccucuacuaaggauaaaaagaccgugcaggcauuuacaaacggagcuaucaaggcccugcuuagcauuaaucuggacgaucacgaaauaguuuucaucaacaaagugcgguccugugacgcgacguuuuugaaugucucaggcugcuauucuugcgacuacggggcccauguguguguuaaggugaaaagcagugaguccgcugauuucuuugcagagagcgaagacaagaccacuguccucucuuucccaauucagucaggaacacacgauuacugccagguacugcauuuucaaaaaccccuaguggacgagagacuguccuauaguuguggcagcgaaccgaagcucaucguuauuaaggguacccugguguacaugggggucuaugauuucaggaacaaaacaggaggcucgucuacugugguaaauccuuccgagggugccuggagcaucucaaacugguucaguggccuuuuggacuggcuagggggaccaaugaaggcuauauuaaaaauccucggcuuuauugccaucgggauugugugcuucauccuguuuaugauacuuauucgaaucgcagucaauucuaucaacauuaagaaaaagaauuga

SEQ ID NO: 11076 - RNA, 3942 nt, Artificial Sequence
  derived and/or modified CDS sequence (opt3) from PTV(GML902876)__KP272011.1__GP
augaucuucaccauucugaacgugcucacaagagccaugcuugucaugagcauguacucccugacuacgugggacucuaccucaaggaaugauaugugcuuuaguaacgacagccccuuggagggcuuaguuuauuacugggaaacacacuccaagaaacaugauuauaagaaacaggagucucaaaagugucgggugggggacucggauaaaaagaugauaucaaauguaacuaucauuagccugaucagugaaauucagaaguccaucucugagcuaagccucuccugcggaaacgacgauaauucaaccggucaggugcugacauucaacggccuugaagacaccauacgcggggauuacaucgucgacugugugacuggacuguaucagagugauauuggcguuggugugggguugggacgaacacaccaugaccaccaucaagucaaaaauaaggcugugguaaucgaugagaaagagcguaugauuagccuccuggaaacccagcagucugagaacgacaucaagaugcagguucugauguccgaaauagagcaacucaaaaaucaguuaucaagaaagaggaacgagcggggccaggaaaagcgcgacgcagagaaagugaugagcgaucugauggccagaaauagugaccuuaggaagcacaacgauauuuugacggcggaaaucucucagauggagaauaacaauacuauucaacggaacaaaaacgucauguccaccacaguggugccugcuauccugagcgucgcccuacucucgucuuccaucgcaccaauuauggccgcuucaccggacagucccaugauaaauccuuggccacacgcaaagaaccgcguuggcacugggauguacaaauaugaugaaaaugacgauagcggaugccgacccaucagauacgguguguccuguauuggcuuugacuucaugcugaagauggauaaauacccuuucuucaacgccuuuaucgggcauaagaccccacuugagucuuucgcugacaagauaauugagaaagaagaggaaacaugcgagaucggaaccaauaaggaauuuaaauguuucgaggagagggccuauaucaagggcacgugccccacuaacauuaaugcgguacacuacaucgauaacaaagguaagcugcgguaugugaaguguaaagaaaauuuggagaugacagaagacugcgcauuuugucguaagauuaaaaagaaagccgggcagagcauacagguccaaaagaccucagugccucuccaggacgcuaucugccaggagaacagugauacuuacuccggaccaaagauuccguucaaaggcguuugcaagaucggccugaucaaauauaaggaauguaaauuuaagacaagcucuuacgagaccgugucauucauuacguuaaaggagaaagggaagauauauaucgaacaucugaugcucaaaaauauugaggucgugaccaacguaaguuucguuugcuacgaacacgccggacaggacgagcaagagguggaacaccgcgcacuuaagagagucagcgugaaugauuguaaaaucgucgacaacuccaagcagaaaauuugcacaggugaucauaucuuuugugagaaguacgacugcucuacuucguaucccgaugugaccuguauacacgcuccuggcagcgggccacuguacaucaauuugaugggauccuggauuaagccccagugcguuggcuaugaaagggugcuaguagaccgggaggucaaacagccucugcucgccccagaacaaaacugugauacaugcgugucagagugucuggacgaggguguucauaucaagaguacuggguucgaaauuaccucugcgguggccugcagccacggcuccugcaucucagcacaucaggaggcuagcacaucugucauagugcccuacccgggacuucuggccuccguaggcgggcgaauuggaauccacuugagucacaccagcgauucugcuuccgugcauaugguugucguguguccuccccgcgacucaugcgccgcacacaacugucuccugugcuaucaugguauuuuaaauuaccagugucacaguacucugagcgccauccuaacgucguuucuccugauacuuuucaucuauacaguguuuuccgucaccacuaacauguuguacguucugagacucauuccaaaacagcugaagucuccugugggcuggcuuaggcuguucaucaauugguugcucaccgcucugcggauuaaaacacgcaacgugauggggagaaucaaucaaaggauaggauggguagaucaccaugacgucgaacguccccggcaccgagagccaaugagaagguuuaagaccacuuuacugcuaacacucauuaugaugacgggcgguaacgcgugcagcaauaccgugguugcaaacucaaagcagacucgcugugugcaggaagggaguuccacaaaaugcucuaucaccgccacaaucacucugcgggcuggcgucauuggagccgagagcuguuucaucauuaagggccccauggagaaucagcagaaaaccauauccaucaagacgauuucaagcgaaaccgugugcagagaggggaguucuuuuuggacaucccuuuacaucccuagcuguuugucgucaaggcgcugccaucugguuggagacugcguggguaacaaaugucaaucuuggcgagaugaccagcucagucgggaauuuuccggcguaaaggauaaucacauuaugaacgagaauaagugcuuugaacaauguggggcaaucggaugcggcuguuucaacauaaauccaagcugccuguauguccaugccuacuuaaaaucugcucguaacgaggccgugagaguguuuagcuguuccgacuggguccacaggguuucauucgaggugaaggguccggauggggaaacugagcugguagcacuuggcaguuugggaaccaaauuccucaacuggggcacacugagccuaucucuggacgcggaagggaucuccggaacuaauucaauuaguuuucucgagagcuccaagggcgguuucgcucuguaugaugagggguacucugaaaucccccgcgagggauuucuuggcgaaauucggugcucgagcgagucagccgcaaucuccgcccacaaaaguuguauaagagcuccugguuugauuaaguauaagccaaugaccgaccagaucgaaugcacggccucucugguggaucccuucgcaaucuuuuuaaaaggcagccucccucagacaaggaacgggcagaccuucacuuccacaaaggacaaaaagaccguccaggcuuuuacuaauggagccauuaaagcgcugcuuucaauaaaccuggaugaccaugagaucguguucauuaauaagguuaaaucuugugaugccaccuuuuugaacgugagcggcugcuacaguugcgacuauggggcucacgucugugugaagguuaaguccagcgagucugcagacuucuuugccgaaucagaggauaaaacaacggugcucuccuucccaauccaaaguggaacccaugacuacugccagguccugcacuuucagaagccccuaguagaugaacgacugagcuacucguguggcucugagccgaaacucauugugaucaaggguacucugguuuauauggggguguacgacuuccgcaauaaaacaggaggcuccagcaccgucgugaacccuucagaaggugcuuggaguauaucuaauugguucuccggccuuuuggauugguuagggggaccaaugaaggccauccugaagauucucggcuuuaucgcaauugggaucguaugcuucauacuguuuaugauuaugauccggaucgcggugaacagcauuaauaucaaaaagaaaaacuga

SEQ ID NO: 11077 - RNA, 3942 nt, Artificial Sequence
  derived and/or modified CDS sequence (opt3) from PTV(PAN479603)__KP272014.1__GP
augaucuucaccauucugaacauacucacaagagccaugcuugugaugagcauguacucccugacuacgugggacucuaccucaaggaaugauaugugcuuuaguaacgacagccccuuggagggcuuagucuauuacugggaaacacacuccaagcggcaugauuauaaaaagcaggagucucaaaaaugucgcguuggggacucggauaagaaaaugaucucaaaugugacuauuaucagccugauuagugaaauccagaaguccauaucugagcuaagccucuccugcggaaacgacgauaauucaaccggucagguacugacauucaacggccuugaagacaccauccgaggggauuacauuguggacugugucacuggacuguaucagagugauaucggcguggguguuggguugggacguacacaccaugaccaccaucaagugaagaauaaagcugucgugauugaugagaaggagagaaugaucagccuccuggaaacccagcagucugagaacgacauaaaaaugcagguacugauguccgaaauugagcaacucaagaaucaguuaucaaggaaacggaacgagcgcggccaggaaaagagagacgcagagaagguuaugagcgaucugauggccaggaauagugaccuucggaaacacaacgauaucuugacggcggaaauuucucagaugaaguacgacaauacuauccaacgcaacaaaaaugugauguccaccacagucgugccugcuauccugagcguggcccuacucucgucuuccgucgcaccaauuauagccgcuccgcccgauucaccuaugaucaacccauggccccacgcaaagaaccgaguuggcacugggauguauaaauacgacgauaaugacgauaguggaugcagaccuauuagguacggugugagcuguaucggcuuugacuucaugcugaagauggauaaauauccauuuuucaacgccuuuauagggcauaagacuccccuugaguccuucgcugacaagauuaucgaaaaagaggaggaaacaugcgagaucggaaccaauaaggaauuuaaauguuucgaggaacgggccuacauuaagggcacgugcccuacuaacaucaaugcgguacacuauauugacaacaaagguaagcugcguuacgugaaguguaaagagaauuuggagaugacagaagauugcgcauuuugucgcaagaucaaaaagaaagccgggcagucuguccaggugcaaaagaccagcguuccacuccaggacgcuauaugccaggagaacucagauacuuauaguggaccgaagauucccuucaaaggcgugugcaagaucggccugaucaaauacaaggaauguaaauuuaagacauccagcuaugagaccgucucuuucauuacguuaaaggaaaaagggaagauauacaucgagcaucugaugcucaaaaauauugaggugguaaccaacguuucauucgugugcuacgaacacgccggacaggacgagcaagaagucgagcacagagcacuuaagagggugagugucaaugauuguaaaaucguggacaacagcaagcagaaaauuugcacaggugaucauguauuuugugagaaguaugacugcuccacuucuuacccugaugugaccuguauccacgcuccaggcucggggccccuguauauaaauuugaugggaagcuggaucaagccucagugcguaggcuacgaacggguccuaguggaccgagagguuaaacagccacugcucgcccccgaacaaaacugugauacaugcguguccgagugucuggacgaagguguccauauuaagucaacuggguucgagaucaccagugcgguggccugcucucacggcagcugcauuuccgcacaucaggaggcuucaacaagcguaaucgugccguauccuggacuucuggccucuguuggcgggcgcauagggauucacuugucccacaccagugauagcgcuucuguccauauggugguggucugucccccaagagacuccugcgccgcacacaauugucuccugugcuaccaugguaucuuaaacuaucagugucacucaacucugagugccauucuaacgagcuuucuccugauccuuuucauauacacaguuuuuagcgugaccacuaacauguuguacgugcugaggcucaucccuaaacagcugaagucccccguaggcuggcuuaaacuguucauuaauugguugcucaccacacugcggaucaagacccgcaacgucauggggagaauuaaucaaaggaucggauggguggaccacuuugauguugaacguccacggcaucgagagcccaugagaagguucaagacuacauuacugcuaacgcucauaaugaugaccggcgguaacgcuugcucuaauacuguggucgcgaacagcaaacagacacgcugugugcaggaagggucaaauaccaagugcaguauuacagcaacuaucacccugcgggccggcguuaucggagcugaguccuguuuuauuaucaaaggcccuauggaaaaccagcaaaagacgauuucuauaaaaaccaucagcuccgagacagugugcagagaggggucaucguucuggaccagucuuuauauuccaucuuguuuguccagcaggcgcugccaccugguaggagacugcgucgguaauaagugucagucguggcgagaugaccagcucucacgggaauuuucuggcgugaaggauaaccauaucaugaaugagaacaaaugcuucgaacaauguggggccauuggaugcggcuguuuuaauaucaacccgaguugccuguacgugcacgcauauuuaaaguccgcccguaaugaggcugucagaguuuucagcuguucugacugggugcauaggguuagcuucgaagugaaaggucccgauggggagaccgagcuggucacacuuggcuccuugggaacuaaguuucucaacuggggcacccugucacuaagucuggacgccgaagggauaagcggaacgaacucuaucuccuuccucgagucaaguaaaggcgguuuugcacuguacgaugaaggguauagcgagauuccucgcgagggauuccuuggcgaaauccggugcuccucugagucggcggcuauuagcgcccacaagucauguaucagagcaccagguuugauaaaguacaaacccaugacagaccagauugaaugcaccgccucccugguggauccuuuugcuaucuucuuaaagggcagucucccacagacuaggaaugggcagacauuuaccucuacuaaagacaagaaaaccguucaagccuucacaaacggagcaaucaaggcucugcuuagcauuaaucuggaugaccacgagauaguguuuaucaaccgagucaaauccugugacgccacguucuugaaugugucaggcugcuauucuugcgauuacggggcgcauguuugugugaaggucaagagcagugaauccgccgacuuuuucgcugagagcgaggauaaaaccacuguacucucuuuucccauucagucaggaacacacgacuacugccaggugcugcauuuccagaagccgcuaguugaugaacgccuguccuauaguuguggcagcgagccuaaacucaucgugauuaaggguacccuggucuacauggggguguaugacuuccggaacaaaacaggaggcucgucuacuguagugaauccauccgaaggugcauggagcaucucaaacugguuuaguggccuuuuggauuggcugggaggacccaugaaggccauauuaaagauccucggcuucauugcuaucgggauugucugcuuuauccuguucaugauacuuauuagaaucgccguuaauucuaucaacauuaaaaagaaaaauuga

SEQ ID NO: 11078 - RNA, 3942 nt, Artificial Sequence
  derived and/or modified CDS sequence (opt3) from PTV(PAN478718)__KP272017.1__GP
augaucuucaccauucugaacgugcucacaagagccaugcuugucaugagcauguacucccugacuacgugggacucuucaaguaggaaugauaugugcuuuagcaacgacucccccuuggagggcuuaguuuauuacugggaaacccacucuaagaaacaugauuauaagaaacaggagucgcaacggugucgcgugggggacucagauaagaaaaugauaacaaauguaacuaucauuagccugaucagugaaauucagaaguccaucucugagcuaagccucuccugcggaaacgacgauaauucaaccggucaggugcugacauucaacggccuugaagacaccauacgaggggauuacaucgucgacugugugacuggacuguaucagagugauauuggcguuggugugggguugggacguacacaccaugaccaccaacaggucaagaauaaagcugugguaaucgaugagaaggagagaaugauuagccuccuggaaacccagcagucugagaacgacaucaaaaugcaaguucugauguccgaaauagagcagcucaagaaucaguuaagcaaaaagaggaacgagcggggccaggaaaagcgcgacgcagagaaagugaugucagaucugauggccagaaauagugaccuuaggaagcauaacgauauuuugacggcggaaaucucucaaaugaaauacaauaacacuauucagcggaauaagaacaucauguccaccacagucgugccugcuauccugagcguggcccuacucucgucuuccgucgcaccaauuauggccgcuccgcccgacucaccuaugauaaacccauggccccacgccaaaaaucgcguuggcacugggauguauaaguacgaugacaacgaugacaguggaugccgaccuaucagauacggugugagcuguauuggcuuugauuucaugcugaaaauggacaaguauccauuuuucaaugcauuuaucgggcacaagacaccccuugaguccuucgcugauaaaauaauugaaaaggaggaggaaaccugcgagaucggaaccaacaaagaauuuaaguguuucgaggaaagggccuacaucaaaggcacgugcccuacuaauauuaacgcgguacauuauaucgacaauaaggguaagcugcgguacgugaaauguaaggagaacuuggagaugacagaagacugcgcauuuugucguaaaauuaagaaaaaggccgggcagucuguccaagugcagaagaccagcguuccacuccaggaugcuauaugccaggaaaauucagacacuuauaguggaccgaaaauccccuucaagggcgugugcaaaauuggccugaucaaguacaaagaauguaaguuuaagacauccagcuaugagaccgucucuuucaucacguuaaaagaaaaggggaaaauuuacauagagcaccugaugcucaagaacaucgaggugguaaccaauguuucauucgugugcuacgaacaugccggacaagaugagcaggaagucgagcaccgcgcacuuaaaagagugagugucaacgacuguaagauuguggauagcuccaaacagaagaucugcacaggugaccacguguuuugugagaaguaugauugcucuacuucguacccugacgugaccuguauucaugcuccaggcagcgggccccuguauaucaauuugaugggauccuggauaaaaccucagugcguaggcuacgaaaggguccuaguggaucgggagguuaagcaaccacugcucgcccccgaacagaacugugacacaugcgugucagagugucuggaugaagguguccacaucaaaaguacuggguucgagauuaccucugcgguggccugcagccauggcuccugcaucucagcacaccaggaggcuagcacaucuguaauugugccguauccuggacuucuggccuccguuggcgggcgaaucggaauacauuugagucacaccagcgacucugcuuccguccacauggugguggucugucccccacgcgauucaugcgccgcacauaauugucuccugugcuaccacgguauuuuaaacuaucagugucauaguacucugagcgccauccuaacgucguuucuccugauucuuuucaucuacacaguguuuuccguuaccacuaacauguuguacgugcugagacucauaccuaagcaacugaaaucucccguaggcuggcuuaagcuguucaucaauugguugcucaccgcucugaggauuaagacacggaacgucauggggcgcaucaaucagagaauuggauggguggaccaccacgacguugaaaggccacgucaucgggagcccaugcgaagauuuaaaaccacuuuacugcuaacacucaucaugaugacgggcgguaacgcgugcagcaauaccguggucgcaaacucaaagcagacuaggugugugcaggaagggaguaauacaaaaugcuccauaaccgccacaauuacucugcgcgcuggcguuaucggagccgagucuuguuucaucgugaagggcccuauggaaaaccaacagaaaaccauuagcaucaagacgauuuccucagagaccguaugccgggaggggagcaguuuuuggacaucucuuuauauaccauccuguuugagcucgagaaggugccaccuggucggagauugcguggguaauaagugucagucauggcgcgacgaucaacucucucgagaguucaguggcgugaaagacaaccauaucaugaaugagaacaagugcuuugaacaguguggggcaauuggaugcggcuguuucaauaucaacccguccugccuguacguccacgccuauuuaaaaagcgcucggaaugaggccguucguguguuuucuuguagcgauuggguacauagaguguccuucgaagucaagggucccgacggggagacugagcuggugacccuuggcucauugggaacaaaauuccucaacuggggcacucugagucuaagccuggaugcagaagggauuucuggaaccaacuccaucucauuucucgagaguagcaagggcgguuucgcgcuguacgacgaaggguauuccgagauaccuagggagggauuucuuggcgaaauccgcuguucuucggagagcgcugccauuucagcacacaaguccugcauccgggccccagguuugauuaaauacaagcccaugacggaucagaucgaaugcacagcuagucugguugacccuuucgccauauuuuuaaaaggcucucucccacagaccagaaaugggcaaacuuucacaagcaccaaggauaaaaagacugugcaggcauuuaccaacggagcuauuaaagcccugcuuuccaucaaucuggacgaucacgagaucgucuucauuaacaaggugauaucaugugacgcgacauuuuugaauguuucuggcugcuauagcugcgacuacggggcccaugugugugucaagguaaaaaguuccgaaagcgcugauuucuuugcagagucugaggacaagacgaccgugcucucauuccccauccaguccggaacucacgauuacugccagguucugcauuuucaaaaaccgcuaguggacgaaaggcugaguuauagcuguggcucggagccuaagcucauugucaucaaagguacacugguguacauggggguauaugauuuccgaaacaagaccggagggucuuccacaguggucaauccaagcgaaggugccuggucaauuaguaacugguucucuggccuuuuggacuggcugggcggacccaugaaggcuaucuuaaaaauacucggcuuuaucgccauugggaucguuugcuucauucuguuuaugauccuuauacgcauugcaguuaauuccaucaacaucaagaaaaagaauuga

SEQ ID NO: 11079 - RNA, 3942 nt, Artificial Sequence
  derived and/or modified CDS sequence (opt3) from PTV(Balliet)__KP272023.1__GP
augaucuucaccauucugaacgugcucacaagagccaugcuugucaugagcauguacucccugacuacgugggacucuaccucaaggaaugauaugugcuuuaguaacgacagccccuuggagggcuuaguuuauuacugggaaacacacuccaagaaacaugauuauaagaaacagaagucucaacggugucgcgugggggacucggauaaaaagaugauaacuaauguaaccaucauuucacugaucagcgagauucagaagaguaucuccgaacuaucucucagcugcggaaacgacgauaauuccacaggucaggugcugaccuucaacggccuugaggacacuauacgaggggauuacaucgucgacugugugacaggacuguaucagucagauauuggcguuggugugggguugggacguacccaccauggccaccaacagaugaaaaauaaggcugucgugaucgacgaaaaagagagaaugauucuccugcuggagacgcagcagagugaaaacgauaucaagaugcaaguacucaugagcgagauagaacagcugaaaaaucagcugucuaagaagaggaacgagcggggccaggagaaacgcgacgcagaaaagguuauguccgaccuuauggccagaaauucagauuugaggaaacauaacgacauucugacugcggagaucagccaaaugaagaauaaaaacaccauucagcggaauaagaacacagugaguacuaccgucgugccugcuauccuaucuguggcccuccuguccagcucggucgcaccaaucauugccgcuccgcccgauucuccuaugauaaacccauggccccacgcgaaaaaucgcguugggacaggaauguacaaguaugacgaaaacgaugacuccgguugccgaccuaucagauacggcgugucauguauuggguuugauuucaugcuuaagauggacaaauacccauuuuucaaugccuuuaucggacacaagacccccuuagagaguuucgcugauaaaauaauugaaaaggaggaggaaacgugcgagaucggcacuaacaaagaauuuaaguguuucgaggaaagggccuauaucaaggguacaugcccuaccaauauuaacgcgguacauuacaucgacaauaaagggaaguugcgguaugugaaauguaaggagaaccucgagaugacugaagauugcgcauuuugucguaaaauuaagaagaaagccggacagagcguccaagugcagaagacauccguuccacugcaggacgcuauaugccaggaaaauucugacaccuacagcggcccgaaaauccccuucaagggcgugugcaaaauuggguuaaucaaguauaaggaauguaaauuuaagacgucaaguuacgagaccgucuccuucaucacacugaaagaaaagggaaaaauuuauauagagcaccucaugcuuaagaacaucgaggugguaacuaauguuagcuucgugugcuacgaacaugccggucaagaugagcaggaagucgagcacaaagcacugaagcgcgugucugucaacgacuguaagauuguggauaauucaaaacagaagaucugcaccggcgaccacguauuuugugagaaauacgauugcaguacaagcuauccugacgugacuuguauucaugcuccaggguccggacccuuguacaucaaccuaaugggcucuuggauaaagccucagugcguagguuaugaaagaguccugguggauagggagguuaaacaaccacuccuggcccccgaacagaauugugauaccugcgugucggagugucuugacgaagggguccacaucaagagcacaggcuucgagauuaccuccgcgguggccugcucacauggaaguugcaucucugcacaccaggagccgagcacuuccguaauugugccuuaccccggccuguuggcuucaguugggggacggaucgguauacaucucagccacacgucugacuccgccaguguccacauggugguggucuguccaccucgagauagcugcgcugcccauaacugucuguuaugcuaucacggcauucugaacuaccagugucauucuacacuauccgcaauccucaccucauuucugcuuauuuuguucaucuauacuguuuuuagugugaccacaaauauacuguacgugcuccgccugauccccaagcaacuuaaaagcccaguaggguggcugaaguuguucauuaacuggcuccugaccgccuuaagaaucaaaacuaggaaugucaugggacggauuaaccagcgcaucggcuggguggaccaccacgauguugaaagacccaggcaucgugagccuaugcggcgauuuaagacaacgcugcuacucacccugauaaugaugacuggugggaaugcuugcucgaacacaguggucgcaaauuccaaacagaccagaugugugcaggaaggcucuaacacaaagugcagcauuacugcaaccaucacgcuuagggccggaguuaucggcgcugagucauguuucauuaucaaggggccaauggaaaaucaacagaaaaccauuaguauaaagacaaucuccucugagacugugugccgcgagggaagcuccuuuuggaccucauuguacauuccgagcugucugaguucucggagaugccaccucguaggugacugcgucggcaacaaaugucaguccuggagggacgaucaacugagccgcgaguucucgggggugaaggacaaucauaucaugaacgagaauaaaugcuuugaacaguguggagccauuggcugcgguuguuucaacaucaaucccucaugcuuauaugugcacgcauaccugaagucugcccgaaacgaggcuguccggguuuuuaguuguuccgauugggugcaucguguuagcuucgaagugaaggggccugacggcgagacagagcuugucacuuugggaucucucggcaccaaauuccugaacugggggacgcuaagccugucccucgaugccgaaggaauaucaggcacaaauaguaucagcuuucuggagucuuccaaggguggguucgcacuuuaugacgaaggauacaacgagauuccaagagagggcuuuuugggugaaaucaggugcucaagugagagcgcggcuauuuccgcccacaaaucuuguauccgcgcacccggccugauaaaguauaaaccuaugaccgaucagauugaaugcacugccucguuaguggacccauucgcuaucuuucucaaggggagccugccccagacacggaauggacaaaccuucacuucaaccaaagauaagaagacaguucaggccuuuacgaacggcgcaaucaaagcccuucuguccauuaauuuggacgaucacgagauaguguucaucaacaaggucaaaaauugugacgcuaccuuucucaacgugagugggugcuacucuugcgauuauggagcgcauguuugugugaaggucaaaagcuccgaaucagccgacuucuuugcugagucugaggacaagacuacaguacugagcuucccgauucagaguggcacccacgauuacugccaggugcuacauuuucaaaagccucugguugacgaaagacucuccuacagcugugguucugagccaaaacugaucgugauuaaggggacacuugucuauaugggaguguacgauuucaggaauaaaacuggcgguucauccaccguagugaaccccagugaaggcgcauggagcaucucgaauugguucucuggguugcuggacugguuaggaggcccuaugaaggccauacucaaaauccugggguuuauugcuaucggaauugucugcuucguucuuuuuaugauccugauacgaauugccgugaacuccaucaauaucaagaagaaaaacuga

SEQ ID NO: 11080 - RNA, 3942 nt, Artificial Sequence
  derived and/or modified CDS sequence (opt3) from PTV(Adames)__KP272029.1__GP
augaucuucaccauucugaacgugcucacaagagccaugcuugucaugagcauguacucccugacuacgugggacucuucaaguaggaaugauauaugcuuuagcaacgacucccccuuggagggcuuaguuuauuacugggaaacccacucuaagaaacaugauuauaagaaacaggggucgcaaaagugucgggugggagacucagauaaaaagaugaucagcaauguaacaauuaucagucugauuuccgagauccagaagucuauaagcgaacuaucccucucaugcgguaacaaugacaacaguacuggccaggugcugaccuucaaugggcuugaggauacaauccgcggagacuacauugucgauugugugaccggccuguaucagagcgacaucgguguuggggugggauugggccgaauuaaccacgaucaucaacaggucaaaaauaaggcugugguaaucgacgaaaaagagaagaugauaucucuccuggagacucagcaguccgaaaacgauauuaaaacacaaguucugaugucagagaucgaacagcucaagaaucaguuaagcaagcguagaaacgagaggggccaggagaaacgggacgcagaaaagcugaugagugaccuuauggcccgcaauucugauuugagaaaccacaaugugauucugaccgacgagaucucccaaaucaaaaacaacauuacgauacauaggaaucggaacaugaugagcacuaccgucgugccugcgauccuaucgguggcucuccugucuuccucagucgggccaauuacagccgcaccgcccgauaguacuaugaucaauccuuggccacacgccaagaaccgcguuggaaccgguauguacaaauaugacgaaaaugaugagagcggcugccgacccauaagauacgggguguccuguauuggauuugacuucaugcuuaagauggauaaauacccuuucuucaacgcuuuuaucggccacaagacaccacuggaaucuuucgcagacaagaucauugagaaagaggaagagaccugcgaaaucgguacgaauaaggaguuuaaauguuucgaagagagggccuauauuaaggggacuugccccacaaacauaaaugcuguacauuacaucgauaacaaaggaaaguugcgguaugugaaguguaaagagaaucucgaaaugaccgaggacugcgccuuuugucguaagauuaaaaagaaagcgggccagagcguccaggugcaaaagacuucaguuccucugcaggaugcaaucugccaggaaaacagugacaucuacuccggcccaaagauuccguucaaaggggugugcaagauaggauuaaucaaauauaaggaguguaaauuuaagacaagcucuuacgaaaccauuucauucaucacgcugaaggguaaaggcaagauuuauaucgagcaccucaugcuuaaaaauauagaggucgugaccaacguaaguuucguuugcuacgaacaugccgggcaggacgagcaagaaguggagcaccgcgcucugaagagagucagcgugaaugauuguaaaaucgucgacaacuccaagcagaaaauuugcacaggagaucacaucuuuugugagaaguacgacugcucuacuucguaucccgaugugaccuguauucauacaccuggcagcgguccauuguacaucaaccuaaugggguccuggauaaagccccagugcguuggcuaugaaagggugcugguagaccgggaggucaaacagccucuccuggugccagaacaaaauugugauacuugcguuucagagugucuugacgaaggagugcacauuaagaguaccggcuucgagaucacaucugccgucgcaugcagccauggguccugcauuucagcucaccaggaggccagcaccucugugaucauacccuacccgggacuguuggcguccguagguggccgaaucgggauucaucucagucacacuagcgauucugccuccgugcacaugguugucguguguccuccccgcgacucaugcgcagcucauaacugucuguuaugcuaucacggaauccugaauuaccagugucauaguacgcuaagcgccauucucacaucguuucugcuuaucuuguucauauauaccgcuuuuuccgugacuaccaacguccuguacguucucagacugauuccaaaacagcuuaagucuccugugggcuggcugaaauuguucgugaauuggcuccugacagccuuaaggaucaagacccggcgcguaauggguagaaucaaccaaaggauugggugggucgaucaccacgacguggaacguccccggcaucgagagccaaugagaagguuuaagacuacacugcuacucacgcugaucaugguuaccggcggaaaugcaugcagcaacacuguggucgccaauucaaaacagacacgcugugugcaggaaggcaguaacaccaagugcuccauuacagcuacuauaacccuucgggcggggguuaucggagcagagucuuguuucauuaucaaaggucccauggaaaaucagcaaaagacgauuagcaucaaaaccauauccucagagacagugugcagagagggcagcaguuuuuggacuucuuuguacaucccuuccugucugagcucgaggcgcugccaccucguaggggauugcgucggaaacaagugucagucauggcgagacgaccagcugucucgggaauuuaguggcgugaaggauaaucauauuaugaacgagaauaaaugcuuugaacaauguggugccaucgggugcggcuguuucaacauuaacccauccugcuuauaugugcacgcuuaccugaagucugcccguaaugaggcagucagaguuuuuagcuguagcgacugggugcauaggguauccuucgaagugaaaggaccggauggcgagauggagcuugucaccuuggggucacucggaacaaaguuccugaacuggggcacucuaagucugagccucgacgccgaagguaucucugggaccaauuccauaucauuucuggagaguagcaaaggaggcuucgcucuuuaugaugaagguuacuccgagauuccccgcgagggcuuuuugggggaaauccgguguucuucggagagcgccgcaaucucagcgcacaaguccugcauuagagcuccuggacugauaaaguauaaaccaaugacggaccagaucgaaugcacagccaguuuaguggaucccuucgcaauuuuucucaagggcucucugccucagaccaggaacgggcagacuuucacaagcaccaaagacaagaaaacuguucaagccuuuaccaauggagcuaucaaggcccuucuguccauuaacuuggaugaccacgagaucauauucaucaauaaagugaagucaugugaugcaacauuucucaacgucucuggcugcuacagcugcgacuauggugcucauguguguguuaaggugaaaaguuccgaaagcgccgauuucuuugcggagucugaggacaagacgaccguccugucauucccaauucaguccgggacucgagacuacugccagguacuacacuuucagaaaccccugguggaugaacgccucaguuacagcuguggaucggagccgaagcugaucguuauuaaaggcacacuuguguauaugggugucuacgacuuccggaauaagaccggcgggucuuccacagugaucaacccuagcgaaggaacuuggucaauaaguaauugguucucuggcuugcuggauugguuagggggaccaaugaaggccauucucaaaauccugggcuuuaucgcuauugguaucguaugcuucauacuuuuuaugauucugaucagaauugcagugaacuccaucaauauaaagaaaaagaacuga

SEQ ID NO: 11081 - RNA, 3942 nt, Artificial Sequence
  derived and/or modified CDS sequence (opt3) from PTV(GML488831)__KP272032.1__GP
augaucuucaccauucugaacgugcucacaagagccaugcuugucaugagcauguacucccugacuacgugggacucuaccucaaggaaugauaugugcuuuaguaacgacagccccuuggagggcuuaguuuauuacugggaaacacacuccaagaaacaugauuauaagaaacaggagucucaacggugucgcgugggggacucggauaagaaaaugauaacuaauguaaccaucauuucacugaucagcgaaauucagaagaguaucuccgagcuaucucucagcugcggaaacgacgauaauuccacaggucaggugcugaccuucaacggccuugaagacacuauacgaggggauuacaucgucgacugugugacaggacuguaucagucagauauuggcguuggugugggguugggacgugcucaccaugaccaccaacaggucaagaauaaagcagugguaaucgaugagaaggagagaaugauuagucuccuggaaacccagcagagcgagaacgacaucaaaaugcaaguucugaugucugaaauagagcagcucaagaaucaguuauccaaaaagaggaacgagcggggccaggaaaagcgcgacgccgagaaagugaugucagaucugauggcgagaaauagcgaccuuaggaagcauaacgauauuuugacggcugaaaucagucaaaugaaauacaauaacacuauucagcggucuaagaaugucauguccaccacaguggugccugccauccugagcgucgcacuacucucgucuuccguugccccaaucauggcugcaccgcccgacucaccuaugauuaacccauggccccacgccaaaaaccgcgugggcacugggauguauaaguacgaugacaaugaugacaguggaugccgaccuauaagauacgguguaagcuguaucggcuuugauuucaugcugaaaauggacaaguauccauuuuucaacgcuuuuauugggcacaagacaccccuugaguccuucgccgauaaaaucauagaaaaggaggaggaaaccugcgagauuggaaccaauaaagaauuuaaguguuucgaggaaagggcguacaucaaaggcacgugcccuacuaacaucaaugcagugcauuauauugacaacaaggguaagcugcgguacgucaaauguaaggagaauuuggagaugacagaagacugcgccuuuugucguaaaaucaagaaaaaggcugggcagucugugcaaguucagaagaccagcgugucacuccaggaugccauuugccaggagaacagugacaauuauuccggaccaaaaauaccguucaagggcgucugcaaaaucggccugauuaaguacaaagaauguaaguuuaagacuagcucuuaugagacagugucauucaucaccuuaaaagaaaaggggaaaaucuacauugagcaccugaugcucaagaacauagagguaguuacgaaugugaguuucgucugcuacgaacaugcaggacaagaugagcaggaaguggagcaccgcgcucuuaaaagagucagcgugaacgacuguaagaucguugauaauuccaaacagaagauuugcaccggugaccacguguuuugugagaaguaugauugcucuacaucguaccccgacguaacuuguauccaugccccuggcagcgggccacuguauauuaacuugaugggauccuggaucaaaccccagugcgucggcuacgaaagggugcuaguugaucgggaggugaagcaaccucugcucgcgccagaacagaauugugauaccugcgucucagagugucuggacgaaggugugcacauaaaaaguacaggguucgagaucacuucugccguagcaugcagccauggcuccugcauuucagcucaccaggaggccagcaccucugugaucguucccuauccgggacuucuggcuuccgucggcgggcgaauuggaauccauuugagucacacaagcgacucugccuccgugcacaugguggucguuuguccuccccgcgauucaugcgcagcccauaacugucuccugugcuaccacgguauauuaaacuaucagugucauaguacccugagcgcuauucuaacuucguuucuccugauccuuuucauuuacacgguguuuuccgugacaaccaauauguuguacguacugagacucaucccaaagcaacugaaaucuccugucggcuggcuuaagcuguucauaaacugguugcucacugcgcugaggaucaagacccggaaugugauggggcgcauuaaccagagaaucggauggguugaccaccacgacguggaaaggccccgucaucgggagccaaugcgaagauuuaaaacaaccuuacugcuaacucucauuaugaugacaggcgguaaugcaugcagcaacacggucguggccaauucaaagcagaccagguguguucaggaagggaguaacacuaaaugcuccaucacagcuaccauaacacugcgcgccggcgugauuggagcagagucuuguuucaucaucaagggccccauggaaaaucaacagaaaacuauuagcaucaagaccauuuccucagagacgguaugccgggaggggagcaguuuuuggaccucucuuuauauaccuuccuguuugagcucgagaaggugccaccuggucggagauugcguggguaacaagugucagucauggcgcgacgaucaacucucucgagaguucaguggcgugaaagacaaucauaucaugaacgaaaauaagugcuuugaacaguguggggccauuggaugcggcuguuucaacaucaauccauccugccuguacguccacgcuuauuuaaaaagcgcccggaacgaggcaguucguguguuuucuuguagcgauuggguacauagaguguccuucgaagucaaggguccggacggggagacagagcuggugacucuuggcucauugggaaccaaauuccucaacuggggcacacugagucuaagccuggaugcggaagggauuucuggaacuaauuccaucucauuucucgagaguagcaagggcgguuucgcucuguacgacgaaggguauuccgagauacccagggagggauuucuuggcgaaauccgcuguucuucggagagcgccgcaauuucagcccacaaguccugcauccgggcuccugguuugauuaaauacaagccaaugaccgaucagaucgaaugcacggccagucugguugaccccuucgcaauauuuuuaaaaggcucucucccucagacaagaaacgggcaaaccuucacuagcacaaaggauaaaaagaccgugcaggcuuuuacuaauggagccauuaaagcgcugcuuuccaucaaccuggacgaucacgagaucgucuucauuaauaaggugaggucaugugacgccaccuuuuugaacguuucuggcugcuauagcugcgacuacggggcucaugugugugucaagguaaaaaguuccgaaagcgcagauuucuuugccgagucugaggacaagacaacggugcucucauucccaauacaguccggaacccacgauuacugccagguucugcauuuucaaaaaccccuaguggacgaacgacugaguuauagcuguggcucggagccgaagcucaucgucauuaaagguacucugguguacaucgggguauaugauuuccgcaauaagacaggagggucuuccaccguggucaacccuagcgaaggugcuuggucaauuaguaauugguucucuggccuuuuggacuggcugggcggaccaaugaaggccaucuuaaaaauacucggcuuuaucgcaauugggaucguuugcuucauucuguuuaugauccuuauacggauugcggugaacuccaucaauaucaagaaaaagaacuga

SEQ ID NO: 11082 - RNA, 3942 nt, Artificial Sequence
  derived and/or modified CDS sequence (opt3) from PTV(GML488778)__KP272038.1__GP
augaucuucaccauucugaacgugcucauaagagccaugcuugugaugagcauguacucccugacaacuugggacucuacgucaaggaaugauaugugcuuuaguaacgacagccccuuggagggcuuaguuuauuacugggaaacccacuccaagaaacaugauuauaagaaacaggagucucaacggugucgcgugggggacucggauaagaaaaugaucacaaauguaacuauuaucucacugauuagcgaaauccagaagaguauauccgagcuaucucucagcugcggaaacgacgauaauuccaccggucaggugcugacauucaacggccuugaagacaccauccgaggggauuacauugucgacugugugacuggacuguaucagucagauaucggcguuggugugggguugggacguacacaccaugaccaccaacaggucaagaauaaagcugugguaauugaugagaaggagagaaugaucagucuccuggaaacccagcagagcgagaacgacauaaaaaugcaaguucugaugucugaaauugagcagcucaagaaucaguuauccaaaaagaggaacgagcggggccaggaaaagcgcgacgcagagaaagugaugucagaucugauggccagaaauagcgaccuuaggaagcauaacggcaucuugacggcggaaauuagucaaaugaaauacaauaacacuguccagcggucuaagaaugugauguccaccacaguggucccugcuauccugagcguugcccuacucucgucuuccguggcaccaaucauggccgcuccgcccgauucaccuaugauuaacccauggccccacgccaaaaaccgcguagggacuggaauguauaaguacgacgauaaugacgauagugguugccgaccuauaagauacggcgugagcuguaucggguuugacuucaugcugaaaauggauaaguauccauuuuucaacgcauuuauuggacacaagacaccccuugaguccuucgcugacaaaaucauagaaaaggaggaggaaaccugcgagauuggcaccaauaaagaauuuaaguguuucgaggaaagggccuacaucaaagguacgugcccuacuaacaucaaugcgguccauuauauugauaacaaggggaagcugcgguacgugaaauguaaggagaauuuggagaugacagaagacugcgcauuuugucguaaaaucaagaaaaaggccggacagucuguucaagugcagaagaccagcgucucacuccaggacgcuauuugccaggagaacagugauaauuauuccggcccaaaaauaccguucaagggcgugugcaaaaucgggcugauuaaguacaaagaauguaaguuuaagacuagcucuuaugagacaguaucauucaucaccuuaaaagaaaagggaaaaaucuacauugagcaccugaugcucaagaacauagagguugugacgaaugucaguuucgugugcuacgaacaugccggucaagacgagcaggaagucgagcaccgcgcacuuaaaagagugagcguuaacgauuguaagaucguggacuccucuaaacagaagauuugcaccggcgaucacguauuuugugagaaguucgacugcucgacaagcuaucccgaugucacuuguauccaugcuccuggguccggaccacuguacauuaauuugaugggcucauggaucaaaccccagugcguggguuaugaaaggguucuaguggaccgggaggucaagcaaccucugcucgccccagaacagaacugugauaccugcgugagugagugucuggacgaagggguacacauaaaaucuacaggcuuugagaucacuagcgcgguggccugcucccauggaucaugcauuagcgcacaccaggaggcuucuaccuccguuaucguccccuacccgggccuucuggccagugucgggggacgaauugguauccauuugagccacacaucugauuccgcuucagugcacauggugguuguguguccuccccgcgacaguugcgccgcacauaauugucuccugugcuaucacggcauauuaaacuaccagugucauagcacccugucggccauucuaacuuccuuccuccugauccuuuuuauuuauacgguguucucuguaacaaccaacauguuguacguccugagacucaucccaaagcaacugaaaagcccugugggguggcuuaagcuguuuauaaauugguugcucacugcucugaggaucaagacccggaacguuaugggacgcauuaaucagagaaucggcuggguggaucaccacgacgucgaaaggccccgucaucgggagccaaugcgaagauucaaaacaaccuuacugcuaacucucauuaugaugacaggugggaacgcgugcucaaauacggugguugcaaacaguaagcagaccaggugugugcaggaaggcuccaauacuaaaugcucuaucacagccaccauaacacugcgcgcuggaguaauuggcgccgagagcuguuuuaucaucaagucccccauggaaaaccaacagaaaacuauuucaaucaagaccauuagcagugagacggucugccgggaggggucuuccuucuggaccagccuuuacauaccuucguguuugucaucuagaaggugccaccuggugggagacugcguggguaauaagugucagaguuggcgcgaugaccaacucucccgagaauuuagcggcgucaaagauaaccauaucaugaaugagaacaagugcuucgaacaguguggggcaauuggaugcggcuguuuuaauaucaacccaucuugccuguauguucacgccuacuuaaaaagcgcucggaaugaggccgugcguguauucuccuguucagacugggugcauagagucaguuucgaagugaaggguccggauggggagacagagcugguuacucuuggcagcuugggaaccaaauuucucaacuggggcacacugucucuaucccuggacgcagaagggauuucaggaacuaacaguaucagcuuccucgaguccucuaagggcgguuuugcgcuguaugaugaaggguacucggagauacccagggagggauuccuuggcgaaauccgcugcagcucagaguccgcugccauuagugcacacaagucuuguauccgggccccugguuugauuaaauauaagccaaugaccgaccagaucgaaugcacggcuagccugguggaucccuuugccauauucuuaaaaggcucccucccucagacaagaaaugggcaaaccuuuacuucaacaaaggacaaaaagaccguccaggcauucacuaacggagcuauuaaagcccugcuuucuaucaaucuggaugaccacgagaucauuuuuauaaacaaggugaggagcugugaugcgaccuucuugaauguuaguggcugcuacuccugcgacuauggggcccaugugugugucaagguaaaaagcucugaaucagcugacuuuuucgcagaguccgaggauaagacaacggugcucaguuuuccaauccagagcggaacccacgacuacugccagguucugcauuuccaaaaaccccuaguggaugaacgacugucguacucuuguggcuccgagccgaagcucauugucaucaaagguacucugguguauauggggguauacgacuuccgcaacaagacaggaggcagcucaaccguggucaauccuagugaaggugccuggucuauuuccaacugguuuagcggccuuuuggauugguuagggggaccaaugaaggcuaucauaaaaauccugggcuucauugccaucgggguugugugcuuuauucucuucaugauccugauacggauugcagucaauucaaucaacaucaagaaaaagaauuga

SEQ ID NO: 11083 - RNA, 3945 nt, Artificial Sequence
  derived and/or modified CDS sequence (opt3) from PTV(Adames)__DQ363407.1__GP
augaucuucaccauucugaacgugcucacaagagccaugcuugucaugagcauguacucccugacuacgugggacucuucaaguaggaaugauauaugcuuuagcaacgacucccccuuggagggcuuaguuuauuacugggaaacccacucuaagaaacaugauuauaagaaacaggggucgcaaaagugucgggugggagacucagauaaaaagaugaucagcaauguaacaauuaucagucugauuuccgagauccagaagucuauaagcgaacuaucccucucaugcgguaacaaugacaacaguacuggccaggugcugaccuucaaugggcuugaggauacaauccgcggagacuacauugucgauugugugaccggccuguaucagagcgacaucgguguuggggugggauugggccgaauuaaccacgaucaucaacaggucaaaaauaaggcugugguaaucgacgaaaaagagaagaugauaucucuccuggagacucagcaguccgaaaacgauauuaaaacacaaguucugaugucagagaucgaacagcucaagaaucaguuaagcaagcguagaaacgagaggggccaggagaaacgggacgcagaaaagcugaugagugaccuuauggcccgcaauucugauuugagaaaccacaaugugauucugaccgacgagaucucccaaaucaaaaacaacauuacgauacauaggaaucggaacaugaugagcacuaccgucgugccugcgauccuaucgguggcucuccugucuuccucagucgggccaauuacagccgcaccgcccgauaguacuaugaucaauccuuggccacacgccaagaaccgcguuggaaccgguauguacaaauaugacgaaaaugaugagagcggcugccgacccauaagauacgggguguccuguauuggauuugacuucaugcuuaagauggauaaauacccuuucuucaacgcuuuuaucggccacaagacaccacuggaaucuuucgcagacaagaucauugagaaagaggaagagaccugcgaaaucgguacgaauaaggaguuuaaauguuucgaagagagggccuauauuaaggggacuugccccacaaacauaaaugcuguacauuacaucgauaacaaaggaaaguugcgguaugugaaguguaaagagaaucucgaaaugaccgaggacugcgccuuuugucguaagauuaaaaagaaagcgggccagagcguccaggugcaaaagacuucaguuccucugcaggaugcaaucugccaggaaaacagugacaucuacuccggcccaaagauuccguucaaaggggugugcaagauaggauuaaucaaauauaaggaguguaaauuuaagacaagcucuuacgaaaccauuucauucaucacgcugaaggguaaaggcaagauuuauaucgagcaccucaugcuuaaaaauauagaggucgugaccaacguaaguuucguuugcuacgaacaugccgggcaggacgaugagcaagaaguggagcaccgcgcucugaagagagucagcgugaaugacuguaaaaucgucgauaacuccaagcagaaaauuugcacaggagaccacaucuuuugugagaaguacgauugcucuacuucguaucccgacgugaccuguauucauacaccuggcagcgguccauuguacaucaaccuaaugggguccuggauaaagccccagugcguuggcuaugaaagggugcugguagaucgggaggucaaacagccucuccuggugccagaacaaaauugugacacuugcguuucagagugucuugaugaaggagugcacauuaagaguaccggcuucgagaucacaucugccgucgcaugcagccauggguccugcauuucagcucaccaggaggccagcaccucugugaucauacccuacccgggacuguuggcguccguagguggccgaaucgggauucaucucagucacacuagcgacucugccuccgugcacaugguugucguguguccuccccgcgauucaugcgcagcucauaacugucuguuaugcuaucacggaauccugaauuaccagugucauaguacgcuaagcgccauucucacaucguuucugcuuaucuuguucauauauaccgcuuuuuccgugacuaccaacguccuguacguucucagacugauuccaaaacagcuuaagucuccugugggcuggcugaaauuguucgugaauuggcuccugacagccuuaaggaucaagacccggcgcguaauggguagaaucaaccaaaggauugggugggucgaccaccacgauguggaacguccccggcaucgagagccaaugagaagguuuaagacuacacugcuacucacgcugaucaugguuaccggcggaaaugcaugcagcaacacuguggucgccaauucaaaacagacacgcugugugcaggaaggcaguaacaccaagugcuccauuacagcuacuauaacccuucgggcggggguuaucggagcagagucuuguuucauuaucaaaggucccauggaaaaucagcaaaagacgauuagcaucaaaaccauauccucagagacagugugcagagagggcagcaguuuuuggacuucuuuguacaucccuuccugucugagcucgaggcgcugccaccucguaggggacugcgucggaaacaagugucagucauggcgagacgaucagcugucucgggaauuuaguggcgugaaggacaaucauauuaugaacgagaauaaaugcuuugaacaauguggugccaucgggugcggcuguuucaacauuaacccauccugcuuauaugugcacgcuuaccugaagucugcccguaaugaggcagucagaguguuuucuuguagcgauugggugcauaggguauccuucgaagugaaaggaccggacggcgagauggagcuugucaccuuggggucacucggaacaaaguuccugaacuggggcacucuaagucugagccucgaugccgaagguaucucugggaccaauuccauaucauuucuggagaguagcaaaggaggcuucgcucuuuaugacgaagguuacuccgagauuccccgcgagggcuuuuugggggaaauccggugcagcucggagagcgccgcaaucucagcgcacaaguccuguauuagagcuccuggacugauaaaguauaaaccaaugacggaucagaucgaaugcacagccaguuuaguggaccccuucgcaauuuuucucaagggcucucugccucagaccaggaacgggcagacuuucacaagcaccaaagauaagaaaacuguucaagccuuuaccaauggagcuaucaaggcccuucuguccauuaacuuggacgaucacgagaucauauucaucaauaaagugaagucaugugacgcaacauuucucaacgucucuggcugcuacagcugcgauuauggugcucauguguguguuaaggugaaaaguuccgaaagcgccgacuucuuugcggagucugaggacaagacgaccguccugucauucccaauucaguccgggacucgagauuacugccagguacuacacuuucagaaaccccugguggacgaacgccucaguuacagcuguggaucggagccgaagcugaucguuauuaaaggcacacuuguguauaugggugucuacgauuuccgggacaagaccggcgggucuuccacagugaucaauccuagcgaaggaacuuggucaauaaguaacugguucucuggcuugcuggauugguuagggggaccaaugaaggccauucucaaaauccugggcuuuaucgcuauugguaucguaugcuucauacuuuuuaugauucugaucagaauugcaguuaauuccaucaacauaaagaaaaagaauuga

SEQ ID NO: 11084 - RNA, 3942 nt, Artificial Sequence
  derived and/or modified CDS sequence (opt3) from PTV__M11156.1__GP
augaucuucaccauucugaacgugcucacaagagccaugcuugucaugagcauguacucccugacuacgugggacucuaccucaaggaaugauaugugcuuuaguaacgacagccccuuggagggcuuaguuuauuacugggaaacacacuccaagcggcaugauuauaaaaagcaggagucucaacgcugucgagugggggacucggauaaaaagaugauaacuaauguaaccaucauuucacugaucagcgaaauucagaaaaguaucuccgagcuaucucucagcugcgugaacgacgauaauuccacaggacagguccugaccuucaacggucuugaagacacuauacguggcgauuacaucguggacuguguuacagggcuguaucagucagauauuggagugggcgucgguuuggggagaacccaccauggacaccaacagaugaagaauaaggcugugguaaucgacgagaaagagaggaugauuagucuccuggaaacgcagcagagcgagaacgauaucaagaugcaaguucugaugucugaaauagagcagcucaaaaaucaguuauccaagaaacggaacgagcgcggccaggaaaagagagacgcagagaaggugaugucagaccugauggccaggaauagcgaucuucggaaacauaacgacauuuugacugcggaaaucagucaaaugaagaauaaaaacaccauucagcgcaauaagaacacagucucuacuaccguggugccugcuauccuguccgucgcccuacucagcucgucuguugcaccaaucauugccgcuccgcccgauuccccuaugauaaacccauggccccacgccaaaaaucgagugggcacagggauguacaaguaugacgagaacgaugacucaggaugcagaccuaucagguacgguguaaguuguauuggcuuugauuucaugcugaaaauggacaaguacccauuuuucaaugcauuuaucgggcacaagacccccuuggagagcuucgcugauaaaauaauugagaaggaggaagagacgugcgaaaucggaacuaacaaagaguuuaaguguuucgaagaacgggccuauaucaaaggcacaugcccuaccaauauuaacgcggugcauuacaucgacaauaaggguaagcugcguuaugucaaauguaaggagaacuuggaaaugacugaggauugcgcauuuugucgcaaaauuaagaaaaaggccgggcaguccgugcaaguucagaagacaucugugccacuccaggacgcuauaugccaggaaaauagcgacaccuacucaggaccgaaaauccccuucaagggcgucugcaaaauuggccugaucaaguauaaagaguguaaguuuaagacgaguuccuacgaaaccgugagcuucaucacauuaaaagagaaggggaaaauuuauauagagcaccugaugcucaagaacaucgaaguaguuacuaaugugucuuucgucugcuacgagcaugugggacaagaugaacaggaggucgagcacagagcccuuaaaagggugucaguuaacgacuguaagauuguggauaauaguaaacagaagaucugcaccggugaccacguauuuugugaaaaguacgauugcagcacauccuauccugacgucacuuguauucaugcaccaggcucugggccccuguacaucaacuugaugggaucguggauaaaaccucagugcgugggcuaugagcggguucuaguggaucgagaagucaagcaaccacugcucgcucccgagcagaauugugauaccugcgugagcgaaugucuggacgaggguguacacaucaaauccacaggguucgagauuaccucagccguggcgugcagucauggcucuugcaucagcgcccaccaggaaccguccacuucaguuauugucccuuaccccggacuucuggcaagcgugggcgggcgcaucggaauacauuugucucacacguccgacagugcuagcgugcacauggucguuguguguccaccuagagauucuugcgccgcucauaacugucuccugugcuaucacgguauuuuaaacuaccagugucauuccacacugucagccauccuaaccaguuuucuccugauucuuuucaucuauacuguguuuagcguaaccacaaauauauuguacguccugaggcucauccccaagcaacugaaaucgccagugggcuggcuuaagcuguucauuaacugguugcucaccgcacugcggaucaagacucgcaauguuaugagaaggauuaaccagcguaucggguggguggaccaccacgaugucgagcggccccgacauagagaaccuaugaggcgcuuuaaaacaacguuacugcuaacccucauaaugaugacuggaggcaaugccugcuccaacacagugguugcuaauucuaagcagacccggugugugcaggaggguagcaacacaaaaugcucaauuacugcgaccaucacgcugagagcagggguaaucggcgccgaaaguuguuucauuaucaagggaccaauggagaaucaacagaaaaccauuuccauaaagacaaucucuagcgagacugucugcagggaaggcuccucauuuuggaccagccuuuacauuccgaguuguuugucuucccgccgaugccaccuggugggggacugcgugggaaacaagugucagagcuggcgggacgaucaacucucgcgugaguucucaggugucaaagacaaucauaucaugaacgaaaauaagugcuuugagcaguguggcgcuauugggugcggauguuucaacaucaaucccucuugccuguauguucacgccuacuuaaaaagugcaagaaacgaagccgugaggguauuuuccuguagcgauugggugcaucgcgucucuuucgaggugaagggcccugacggugagacagaacugguuacucuugggagcccaggcaccaaauucuugaacuggggaacgcucucccugucacuagaugcugagggcauaagugggacaaauagcaucucuuuucuggaauccucaaagggaggcuucgcccucuaugacgaggguuacaacgagauuccccgggaaggguuucugggagagaucagaugcaguagcgaauccgcagcgauuucugcucacaagucguguaucagggccccuggccuuauaaaauauaagccaaugaccgaucagauugagugcacugcaagccuuguggaccccuucgccaucuuucugaaagguucauuaccgcagacacgaaauggccaaaccuucacuuccaccaaggauaaaaagacaguccaggcuuuuacgaacggggccaucaaagcacuccugaguauuaaucuugacgaucacgaaauaguguucaucaacaagguuaagaauugugacgcuaccuuucugaacgugucuggaugcuacagcugcgauuauggcgcccaugucuguguaaaagugaaguccucagagucugcggacuucuuugccgagagcgaagacaaaacuacaguuuugaguuucccuauucaguccgggacccacgauuacugccaggugcuccauuuucaaaagccacuggucgacgagcgccuaagcuacucuuguggaucagaacccaaacugaucgugauuaagggcacacucguaugcauggguguguaugauuuccggaauaagacugggggauccaguaccgucguuaacccuagcgagggcgcuuggucgaucucuaauugguucuccggucugcuugacugguugggcgggcccaugaaagcaauacugaagaucuuaggauuuauugccaucggcauuguguguuucgugcucuuuaugauccugauaagaauugcugucaacagcaucaauaucaaaaagaaaaacuga

SEQ ID NO: 11085 - RNA, 3852 nt, Artificial Sequence
  derived and/or modified CDS sequence (opt3) from Phlebovirus(CoAr170255)__HM566149.1__GP
auguacaagcugaucaccaacauucucaaacuuagcguggucuccgccauguauucuauaauguucugggaccccacaggcaucucaaagcugugcuugaguaauaacagcccuuuagaggggcugguuuacuauugggaaaauacuaugagagagggagaauuuaaaagggagaagcggaaaaagugucgccuagguauuuccgaaccagcuccggugucuaaccagacgaucguaucgcucauugaggaggugcaaaagucacccgcagaaaugauccugauaugcgaggccaauggcaacagcaccgggaguucccuuucuuucgauggacugagcgacaaugaaaucaaaccuuccauugucgauuguacaacuggcgaccgaaccucagauuugcgugugcucguugguaaggggaucuuugagaaaaagaugaguaugagcaacgagauugacagaguggucucucuggaagaucaccuucagagggagaaagaacucgugcagacauuccaggacuuacaucacaaugaguccgaaaagaacaagcugcuugagcaugaguuggaaaauguacggcaacagcugaaacgcgagagagaaucaaacaagaucaaaauguggaccacuaagaggccagagauaacaaccauuggacuaacgacuaccaucgcgacaauucuccuggcuagccagaguguugccucuuccgugcccaugccuggccagcuuaauacuuggccacacgcaaagaaccgggucggcgggggaguguuuaaggccaaugaugacgaugaagacagcugcaaacugaucgauuacgguaucgcuugucauggcuucgacuauuugcuccgcaccgacauuuaccccuuuuucaacgcacacgugucgcaccgaucucuguuagaggccuccaacgaggggauaauccugaaggaugaggcuucaugcgagauugaaacaaauaaggacuuuaaauguuaugaggaaagagccuuccucaaguggaguugcccucaucuugucaacagcgcgcacuuuaucgauuccaaaggaaagcugaggauaauuaaauguaaggcagaguacgagaucaccgaagacugcacguacugucggcguaucaagaaaaaggccgcucaacagaaacagguuuauaagucuagcauugccuugcaggaugcagugugccaagaaaauucagacuacuaugauggcccacgcaucacuuucacagguguaugcaaaauugggaccauggaauacaagaaguguaaacauaagaguuccagcuuugagaacauaggauucaucacuauuagagacaaaggcaaguauuacaucgagaauaugaggaccaaaaacaucgaaauggugucuaaugucucauucauuugcuauaaccacaauggccaggauacagagaaggacgugcggcuacugaagcgaguuaaaccgggggauuguaagguggucgacgacaguaaaacgaagcacugcaccggagaucauguguuuugugaaaaauacgacugcacaaagagcuaccccgaggcuacuuguaugcacgccccugguuccggcccaauacucguacugguuaugggggugugguucaaaccccagugcgucggauaugaacgcgugcuugucgagagagaggugaaggcgccuguucugauccaagaaaaggauugugauaccugcguguuugaguguuuggaagacaaaauucucaucaagucuacaggcuucaaaaugauuucggccguagcaugcagccaugguuccugcgucucaagucaccagucuccaagcacuuuucuguacaucgacuaucccggguuaaccgcuuccgugggcggagagauaggccugcaucuaucacacacagaugacagcguuucugugcacaagaaaauccauuguccggccagggauccuugcgaagcucacuccuguauugucugcuaccaugggcucgugaacuaucagugucacaccguacugaguuacagcgugguuucuuuccuuuuggucugcaugauguaucuggccuuuuucaucacuucccggcuccuguuuuuccuucgcauuaugcccagaaggcugcguaauccaaucucaugguugacgcuccugauacgguggguguuacagacacugcuagcaauucuccgacugaguuuuaagaaacuuagcgagaccaucggauggaacucgccuaauaacagacaacagauggacguggaggccaauaggcgccccuugcggagauacaggacuaccuucauucugacacuccuguuugucgguuuaaccuccgcuuguucuaacacugcgguuagcaacucaaaacagacaaagugccugcagaguggcggguccgugaaauguucuaucacggcaaccauaacucuuaaggccggaacaaucggcgcugaaagcugcuucauuaucaaagguccauccgagaaucaacagaaggugauucgcguaaagaccgucucaagcgaaacagugugucgagaggggaguucuuucuggacuggccaguuuacccccuccugcguuagcucgcggcguugccacuuggugggagauugugucggcaacagaugccaggccuggagggacgaagugguuucacgcgaguucgggaauaugaaagauaacaaugugaugucugagaacaaguguuuugaacaaugcggagcagccgguuguggcugcuucaauaucaacccuaguugucucuacguacauuccacguuuaaaagcguccggagagaggcuauaaggguguucaagugcaaugacugggugcaccgacugaccuuugaagucucugggccaagcggagagaaagaccgcauuguucuaaacucccugucaacaaaguuccuccaguggggcacuaucagucugagccuugaugccgaggguaucucugggaccaauuccuauucauuuuuggaaaguaacaagggcggauucgcaauucaugacgaggaauuuagcgagaucccgcgggaaggcuaccugggggagauuagauguuccucugagucggcggugauagcugcccacaaaagcugcaucagggcacccaauuuaauuaaguauaaaccuaugacagaucagaucgacuguacugccucacucguagauccauucgcuauuuuucugaagggaucccuuccccagagucguucuggcuacaccuucacgagcuccacagacaaaaagaccgugcaagccuucaacucagguucuaucaaagcacugauaagcaucaauauggaugaccaugaaauugaguuuuugaacgaugcugccgacugcgaugcgacuuuccucaacgucagugggugcuauuccuguaauuacggagcccaggugugcaucaagguucgcagcucuaagucauccauuuuuaguagcaacaauaacgacaauucgaucgugauaaacuucgaugcugaccagggcacacgggacuauuguagaauuauccacuuuaaugguccucuggucgaugaaacccuacacuacucuugcggcggggaguccaaacugcuccaaaugaagggaagccugaucacugugggcccauacgacuucaggaacaccacagggggaaaaucaacgauuguuaauccccaugaagagaguuggaaccuguuuucuugguucuccggcuugcuggauugguuaggugggccgcuccgagcaauacugaagaucgugcuuauuaucauuaucggaauaauccuguuuauugucguagccuuccuaauccggcucgugauuuuuaauguucuguugaaaagcaagaagaacuga

SEQ ID NO: 11086 - RNA, 3873 nt, Artificial Sequence
  derived and/or modified CDS sequence (opt3) from Phlebovirus(CoAr171616)__HM566154.1__GP
auguuccagaucauuuaccugcucaccaaacuuuaucuggugagcuccauguacucuauaauguuuugggagaacgaaaauaucucaaaauugugcuuaaguaacaauagcccccuggagggccuagucuauuacugggaaaacguuaugaaggagggggacuucaaagaagagaagaggaaaaaguguagaauuggaccuuccgaucucaagcgggugacaaaucaaacucugacgacccuuaucgaggaaguacagaaaucuccaucggagauucagcuguugugcgaagaggacgguaacaagacaggcaucucaauguuuuucgaugggcucagcgacgauauaaguacuccguccaucguggacuguaauggaaacauucgcaucucugaucugcgaguccaggugggccguggucacuuugagaaagaaaaugagauuagaaagaucgaagagauaguuacccuggaagacgaucucaggcgggagcgcgacuuaaacaaacugcuucaagauuugaauaagaaggacgccgaggaaagaaggauuaucgagcaugaacugacaaacaugcgggagcagcuacagcgcgaacgagagagaagcaaacagcaaauuaaggagcacgagaaaaucgaagugaauaaccauaaggaacccgcuacccaccucaaugucuccaaacugcuuacuaucgggcuguuggcacaacaggugggacagguaauugccacagagccuggccagcucaacaccuggauacaugcgaagaacaggaucggcaaagggcuguauaagacggaagauacugacgaggacggaugccgggguuuagauuacggcguuucaugucugggguucgacuaucuccuucguaccgauauuuacccauuuuucaauaguuuugugagccaccugucuauguuggaggcuuccacagaagaccuaaucgagaaggaaggaacuucaugcgagauagagaccaacaaagaguucaaguguuacgaagaacgcgccuuuauuaaaggcagcugcccccaccuggucaauagugcacauuuccucgauaacaaggguaaacugagaaucgugaaguguaagacagacuuugagaugaccgaagauugcacguucuguaggaaaaucaagaaaaagaacucucagcacaaacagguguucaagacuuccauugcccuucaagacgcugucugccagaauaauagcgaucuguauaacgggccucggaucguuuacucgaaugugugcaagauuggaaugguaucuuauaaacaguguaaguccaaaacaucaaguuacgagagcgugggcuuugucauauugaagggcaaagggaaguucuauaucgagaacaugaagauuaaaaauaucgaagugaucgcaaacguuuccuuuauuugccaucaguaccaaggacaggacgguaccgagaaggaacagcgaucucucaaacgcauaagcgugggcgaguguaagucagucaauccacagaaaacuaagcacugcacaggggaucacguguucugugaaaaauaugacugcaccaagaguuaccccgagguaacgugucugauggccccuggauccggcccaaucuuaguucaaauuauggguagcuggaucaagccgcagugcgugggguacgagaaaguccugguggaaagagaggucaagucucccacccuaacagaagagagggacugugauacuugcguguaugaaugucucgaggacaaaauucugaucaagucaaccggcuuuaaaaugauaagugcuguugccugcagccauggaaugugcguguccucucaccaggagccuucgacauuccuuuacaucaacuauccaggcaugagcgcguccauugggggagaaaucgguuugcaucugucacacacugaugacagucucucucugcauaagguaauuagcugucccucccggaauccuugcgauguccacucauguaucauaugcuaccacggcauuaucaacuaucagugucauaccgcacuuagcuacacaauuguggccuuuucuuucaucuccuuucuguauuugaccuucaagguuauaagucaacuccuguacacuuuuaaaguggucccaaagaaauuaaaggggcccuucuacuggaugggauaucugaucaaauggauugugaagacgauccuaggcguagugcgcaacacauuuuucaccaugagcaauagaauugguugggagaggcgugacgaaauccacgaggauauagaggcuaacccgcggcgacaucuccagagauucaagacuaccuuuguucugacaaugcuuaugauuaaugggggcuugugcuguucuaacacccuggucuccaauucaaaacagacuaggugcgugcagaguggaaacgaagugaaguguagcgucucggccacaguugugcucaaagcaggcgugaucggggcugaguccugcuucaucauuaagggaccuucugaaaaucaacacaaaaugaucagcguacgcacgcugucaagugagaccgucugucgggaaggugccuccuuuuggacuggccacuucucucccagcugcguguccucaagaaggugccauuuaguuggggagugucacggaaaccgcugccagagcuggcgagacgaucagauuagucgggaguuuggcggugugaaggacaauaaccguaugucugaaaauaaguguuucgagcaaugcggguccauaggcuguggaugcuuuaacaugaauccaagcugucuguacguccauacaacccuuaaaucggcgagaaacgaagccgugaggguuuucaagugcaaugauuggauccaccgcuugaacuuugaggugauuggcccuucaggggaaaaagacguagucacacucaacucuaugaguacuaaguuccugcaguggggaaccaucucccuaagccuggaugcagagggcauuacggguaccaauucuuauagcuuucucgaguccucaaaagggggauucgcuauccaugacgaagaguuuagugacauaccccgggaaggcuaccugggugagaucagauguagcucugaauccgccgugauuucagcucacaguagcugcaucagggccccagaucuuauuaaguauaaacccaugacagaccagaucgaguguacuuccaccuugauagauccuuucgcaauuuucaugaagggcucucugccacagacacgaucgggguacacuuuuaccagcucaaaggacaaaaagacgauccaagccuucaacacaaauuccaucaaggcuuuaauuagucucaaccuggaugaccacgagauaguguuugucucugaucagaccaauugcgaaugcacuuuccuuaaccugacaggauguuauagcugcgacuacggcgcgcauguuuguuuucgcaucaaguccgauaaaaaggggguguucguaucaaauaccgaggcaaaggacauuucuuuuggauucgaaguguugacuggcacccacgauuacugccagauccagcauuuuaacagcccgagugucuauaaaacacucuccuacagcugugguggggagucuaagcugcuagugauuaaaggaucacugaucacgauaggcccccacgacuaucggaauaagaccgguggcgccuccacuguugugaacccuagugaggaaggguggagcgucacaaauuggaucggaggcuucauuucguggcucgggggaccacugaaagcucuuuugaagaucgccgugaccauucuggcaggcguugugaucuuuuuaauaauuuacuucuuccucagacugaucgccacaaacauccuuaugaagacuaaaaagaauuga

SEQ ID NO: 11087 - RNA, 3852 nt, Artificial Sequence
  derived and/or modified CDS sequence (opt3) from Buenaventura virus(CoAr3319)__KP272002.1__GP
auguacaagcugaucaccaacauucucaaacuuagcaugguguccgccauguauucuauaauguucugggaccccacaggcaucucaaagcugugcuugaguaauaacagcccuuuagaggggcuggucuacuauugggaaaauacuaugagagagggagaauuuaaaagggagaagcggaaaaagugucgccuagguauuuccgaaccagcuccgguuucuaaccagacgaucgugucgcucauugaggagguacaaaagucacccgcagaaaugauccugauaugcgagaccagcggcaaugccacagggaguucccuuucuuucgauggacugagcgacaacgaagugaaaccuuccaucgucgauugugcgacuggcgagcgaaccucagacuugcgugugcucguugguaaggggacauuugagaaaaagaugaguaugagcaaugaaauugauagaguggucucucuggaggaccacuugcagagggaacgggagcucgugcagaccuuccaggauuuacaucacaacgaauccgagaaaaauaagcugcuugagcaugaauuggagaacguacgccaacagcugagaagggaacgggagucaaauaagguuaaaguguggacuacaaagaaaccagaagucaccacgaucggacuaacuaccacaauugcuacuauccuccuggccagccagaguauagcaucuuccgugcccaugccuggccagcuuaacaccuggccacacgccaagaaucgcgugggcgggggagucuuuaaagcuaacgacgaugacgaggauagcugcaagcugauugacuacgguaucgcaugucauggcuucgauuauuugcuccgaacagacauuuaccccuuuuucaaugcccacguuucgcacagaucuaugcuggaggcuuccaacgaagggaucaucuuaaaagacgaggccucaugcgaaauugagaccaacaaggaucugaaguguuaugaagagagggcguuucucaaauggaguugcccucaucuugugaauagcgcacacuucauagacuccaagggaaaacugcggaucauuaaguguaaagccgaguacgaaaucacggaggauugcacuuacugucgucgcauaaagaagaaagcugcccaacagaagcagguauauaaaucuagcauugcauugcaggacgcugugugccaagaaaacucagauuacuaugacggcccaagaaucacauuuaccggugucugcaagaucgggaguauggaguacaaaaaguguaagcauaaauccagcucuuucgagaaugugggauuuauuacuaucagggauaagggcaaauauuacauugaaaacaugcggauaaagaauaucgagaugguuucaaacgugaguuucauuugcuauaaucacaacggccaggacacagaaaaagauauccgacuacugaagcgcgucaagccgagcgacuguaaagugguagaugacuccaagucuaaacacugcaccggggaccauaucuucugugauaaguacgacugcacgaaaucguaccccgaggccagcuguaugcacgcgccuggauccgguccaauucucguucuggugaugggcgucugguuuaagccccagugcgugggguaugaaagaguccuuguggagagggagguuaaagugccuguacugacccaagaaaaggauugugacacaugcgucuucgagugucaggaagauaagauauugaucaaaucaacuggauuuaagaugauuagugccguggcaugcucucauggcagcugcguuuccucacaccagagcccaucuaccuuccucuacaucgacuaucccggucugacagcuuccgucgggggcgagauuggauuacaucugagucacacugaugacagcaucucugugcacaaaaagauacauuguccggcccgggauccuugcgaagcucacaauugugugaucugcuaccauggccuaauuaacuaucagugucacaccuuucucuccuacucaguagugaguuuccuguuuaucagcguucuuuauuugacauucuuuauugucucgcgccugcuccuguuccuuaaaaucaugcccaagagacugaagaauccaauauccugguugacccuccugauuagguggguguuacaaacucugaucacgauucuacgucucucuuuuaaaaagcugagcgagacaaucggguggaccacuaacgacaaucggcagcacguggaugucgaggccaaccgaagaccucuuaggcgcuaccggaccacauucauauugacccugcucuuuaucggacuggcaucagguugcaguaauacugccguuuccaacucuaaacagacaaaguguuuacagagcggcggguccgugaaaugcucaauuacggcuaccaucacucugaaggcgggaauuaucggcgcagaaagcuguuucauaauuaagggucccagugagaaccaacagagagugaucaggguaaaaacaaucucuuccgaaaccgucugccgcgaggggagcucguucuggacaggccuuuuuacuccaucaugugugucuagucgacggugccauuugguuggagacugcgugggcaaucguugucaguccuggagagaugaagucgugagcagggaguucgggaacaugaaggacaauaacgccaugucugagaauaaaugcuuugaacaguguggagcugccgguugcggcuguuucaacauuaaucccagcugccucuacguucacuccguguuuaagucaguacgccgggaggcaaucagagucuucaaauguaacgacugggugcauaggcugaccuuugaagugagugggccuagcggagagaaggaucgaauuguccuaaauucucuguccacgaaguuccuccaauggggcaccauaucacugagucuugacgccgaggguaucagcgggacaaacuccuauucuuuucuggaaucgaauaaaggcggauucgcuauucacgaugaggaauuuagcgagaucccacgcgaaggcuaccugggggagauucggugcucauccgagagugccguuaucgcagcgcauaagucuuguauaagagcuccgaacuuaaucaaauauaagcccaugacugaccagauugauugcaccgccagccucguggacccuuucgcaaucuuucugaaaggaucccuuccacagucaaggucuggcuacacauucacuagcaguaccgauaagaaaacgguacaggccuucaauuccggugcuauuaaggcccugaucagcauaaacuuggacgaucacgaaauugaguuucucucugacacagcagauugugacgcuaccuuccugaauaucucagggugcuauuccugcaacuacggagcccaaguguguaucaagguccguaguagcaaaucgucuauauuuuccagcaacaauaacgauaauucaauugugaucaacuucgacgcggaacagggcacucgcgacuauugccggauuauccacuuuaaugguccccuaguugaugagacacugcauuacaguuguggcggggaaucuaagcuccugcagaugaaaggaucccuuauuaccgugggcccuuacgacuucagaaacacuaccgggggaaagagcacagucgugaauccacacgaggagucauggaacuuguuuaguugguucagcggccuguuagauuggcucggugggccccugagggccauccuuaaaauaguucugaucgugauuaucggaauuauccuauuuauagucguaguguuccucaugcgacuggcuauuuugaauguucuguuaaaguccaagaaaaacuga

SEQ ID NO: 11088 - RNA, 3942 nt, Artificial Sequence
  derived and/or modified CDS sequence (opt3) from Cocle virus(GML244915)__KP272034.1__GP
augauguucacccaccuggacgugcucacaagagccaugcuugucaugagcauguacucccugacuacgugggauucuaucaggcggaacgacauuugcuuuucaaaugauagucccuuggagggcuuaguuuauuacugggaaacccagagcaagaugcaugaguauaaaaaggaagacucccaaaaaugucgcgugggggauucugagaagaaaaugauaucgaacguaacaaucauuucacugaucagcgaaauucagaagaguaucuccgagcuaucucucagcugcggaaaugacgauaacuccacuggucaggugcugauguucaauggccuugaggacaccauacgaggggauuacaucgucgacugucugacaggauuguaucagucagauauuggcguggguguugggaguggaaagaccaaacacgaccauacuaagcuccguaacaaagcugugaucauugaugaaaaggagaaaaugaucagccugcuggaagcacaacagucugagaaugacauaaagacacagguccucauguccgagauugaacaguuaaagacccaacugcuuaacagaaggucagagcggggccacgaaaaacgcaagaaugaggaaaucgugagcgacuugauggccagaaacagugaucugaggaaacauaaugacauucuaaaggaugagauggaccagaucaaagagaaccucacgaucuuuaagucucggaaugcgauuuccacuaccagcguaccugcuauaaugucgaucgcccugcuuucuuccucaguuaugccaauuaucgcagccgugagugauagcccgaugauaaaccccuggccucacgcuaaaaaucgcgucggcuccgggauguacaaguaugacgauaacgacgaaucuggaugccgaccaauuagauacggugugagcuguaucggcuucgaucacaugcugaagauggacaaauaccccuuuuucaacgcauuuaucgggcauaagacauugcucgagucauucguggauaaaauuaucgaaaaggaggacgaaacuugcgagauuggaaccaauaaagaguuuaaguguuucgaagagagggccuauauaaagggcacaugcccucacaacaucaaugcuguccauuaccuggacaacaaagguaaguuacgguauguuaaauguaaggaaaaucuggagaugaccgaagauugcgccuuuugucguaaaauuaagaagaaagcggggcagagugugcagguacaaaagacguccgugccacuccaggacgcaaucugccaggauaacagcgacaucuacacuggaccccgcauuccuuauaaaggcaugugcaagauaggccuugucaaauacaaggaguguaagucuaaaacaucaaguuaugagaccgugagcuucaucacucugaaggggaaaggaaagauuuacaucgaacacuugauguugaaaaauauugagguugugacaaacgucuccuuugugugcuacgaacacgccggucaaguagagcaggagguugaacauagagcucugaagagggugucugucaaugauuguaaaaucguggacucgagcaagcagaagauaugcaccggcgaucacgucuucugugagaaauaugacugcuccacgucauacccagaugugaccuguauccaggccccggggaguggaccccucuauguuaaccugaugggcucuuggauuaagccucaaugcguggguuacgaacggguacuugucgagcgagaagugaaacagccacuguugacacccgagcagaauugugacacuugcguuagcgagugucucgaugaaggggugcauaucaaguccaccggcuucgagauuacaucagcagucgcuugcagccacggaucuugcaucuccgcccaucaggaagcgaguacuagcauaauugugccuuauccaggccuguuagccucuguagggggaaaaaucggucugcaccuaucccacaccucagacagugcaagcgugcauaugauuguugucugucccccgcgcgauucgugcgcugcccacaacugucuccugugcuaccauggcaugcuuaauuaucaaugucacuccacauugucugcuauccugaccagcuuucuccugauacuuuucaucuacacuacguuuucauucauuacaaacauccuguacuugcucagacuguuaccuaagcagcugaagagucccauuggguggcuaaaacucuuuaucaauuggcuguucaccauacuuaggauucggacuaaguauuugaugggacgccugaaccagagaaucggcuggguggagaaccacgacguggaaaggccacguccucgggagcccaugcgaagauuuaaaaccacacucaugcugaccauguuaaugaucacugguggguacgccugcuccaauacagucguugcaaacucuaagcagacgaggugugugcaagagggcagcaauaccaaaugcuccgugacugccacaguaacccugaaggcuggagucauuggcgcggaaucauguuucgugaucaaggggccaauggagaaccagcagaaaacaauuagcauaaagacuguuaguucugaaaccgugugccgcgagggauccagcuuuuggacgucgcuuuauauccccucauguuugucuagucggagaugccaucucgucggugacugcgugggcaauaggugucaguccuggcgcgaagaucaacugagccgagaguucucugggguuaaagacaaccagauuaugaaugagaacaagugcuuugaacaguguggagcaaucggcugcgguuguuucaauauuaacccuagcugccuauacgugcacgccuaucugaaauccgcucggaaugaggccguacgugucuuuucauguagugauugggugcauagagugagcuucgaagucaaggggccagacggcgagaccgagcucguuacacugggaucucuuggcacuaaguucuugaacugggggacccuguccuuaucacucgaugcagaaggaaucacaggcacuaauagucugagcuuucuugaguccucuaaagguggguucgcccuguacgacgaaggauuuucggagauaccgagggaaggcuucuugggugagauccgcugcagcucagaguccgcugccauuagugcacacaagucuuguauccgggcgcccggccucauuaaauauaagccuaugaccgaucaaaucgaaugcacggcuagccugguggacccauuugccauauuccuaaaagggucccugccccagacaagaaacggacagaccuuuacuucaacaaaggauaaaaagaccguacaggcauucacuaccggcgccauuagggcucuccugucuaucaaucuugacgaucaugagaucacauuuauuagcaagaucaaaaacugugaagccacguucuugaacgugagugggugcuacuccugcgacuacggagcacacgucuguauaaagauuaaaagcucugagucagcugauuuuuaugccgaauccgaggacaagaccacugugcugaguuuaccuguuagcucgggcacacaagacuacugccaggugcuccacuuccagaaaccacuggucgaugagcgacuuucuuauuccugugguagcgaacccaagcugauggugaucaaggggacccuaguuuacaugggaguguaugacuuucgcaauaaaacaggcgguucaaguacugucguaaacccgucugaugcguccuggagcauugccaauugguucucaggccuccuggacuggcuagggggaccucugaaggcuaucuuaaaaauacucggcuucaucgcaaugggggugguuugcuuuauucuguucaugauccuuauuaagaucgccgugcggagugucaacaugaaaaagaagaauuga

SEQ ID NO: 11089 - RNA, 3873 nt, Artificial Sequence
  derived and/or modified CDS sequence (opt3) from Campana virus(VP-334K)__KP272041.1__GP
augcugcacuucaucaccauuacaacuaaguuucucgccguggcuagcauguacaaccuucuguauugggaccccaauggcuuguccagauuaugccugucuaacaauucaccucuagaggggcucgucuacuauugggaaaaccugaugaaagagagugauuucaagaaagacaagaaaaagcauuguaggauaggaacgagcguugcagccccagugaccaaugaaacacuuacuacccugaucgaggaaguacagaaguccccgucugagauuaucuugcaaugcgagucgcggaacaaugauacagguaacucaauuuacuuugacggccucgcggaugacaucgaaagccccaguauagugaauugugaguccgggaaacgcgaaucugaucugcgaguccuggugggacagggccucaagaaagagaucauuuuaaacgagaucgcugccauugaccgucaggcaagccuggaagaacaccuuagaggugaaaaggccuugaccucccugcuacaggagaucucaaaacaagaugaagcugagaggaagcggcucgagcaugaaguuaguagccugcgccagcagcuuaugaaugagagagaagagaacaagaaaaggaagaauauaccugcauucggggugucuuccacuacaucaagcagucugaugaacauuucucgggucgugaccaucggauugcucucccagcaagccauugcuaauccaagccugcccggccagguaaacacguggccucacgccaaaaaccgcaucggccagggguuauaucgaaucgacacuucggaugaagacggaugcagaggucugaauuacggcguuauuugucucggguuugaucaucuucugaggauggacuuguauccauucuuuaacgcguacgugucucaccuaucccugcucgaggcauacaccgagaauauaauccagaaggacgaaacagagugcgaaauugagggaggcaaagaguucaaguguuaugaggagcgggccuacaucaaaggugucugcccccaccguauaaagucagcucauuaucuggaucaaaaggggaaacuucgcauuaucaaguguaaagaaaaccuggaguugacugaagacugcaccuacuguagaaagaucaaaaaggauaggggacacacaaagcaaguguauaaaaccagugugccucuccaggacgccauuugccaagauaauagcgacgauuacuccggcccaaagaucucuuuuaaaggcgucugcaagauugggaugauagaguauaaagaguguaaguacaagagcucaaguuucgaaacgguuggauuuaucacuauuaaagagaaggguaaauucuacaucgaagacaugaagcugaaaaacuuagaggugacaaauaacguagcauuuaucugccaucaguauaccggccaggaugggacuacagacgaagagaaucggcaccugaagcgaauguccgugaaggauuguaaaaacgucaauagcucuaagucaaaauacugcaccggagaccacauuuucugucagguguaugacugcacgaagaguuacccggaggcuaccuguuucguugcccccggcagcgguccugugcuaguccaagugaugggguccuggauaaaaccacagugcguaggcuaugaaaagguucucguggagcgcgaagucaaaaugcccauccugacagaggaaagagauugugacacuugcguguacgaguguaaggaggaucauauucuuaucaagucuaccggauuuaacaugauuucggcggucgccugcagccacggcuccugcgugucagcacaucaggacccuaguacauucuugaauaucgaauauccagggaugucugcuagcguuggaggugagauaggcauccacauuucccauacugaugacucacugagccuccacaaaaagaucuacugucccgccagggauucuugcgaagcucacaacuguauuaugugcuaccaugggcugaucaauuaucagugucacaccgcccuuuccuacgcagugguaaguuuuauguucgucagcauagccuaugugauuuuuaacguucugcgguuggugcucgucgcucugcaugugguaccgcgcaaauuaaagucuccuaucgacuggcugauucuacucaucaaauggguguuccugcuuuuggcgaagguuauaagagcauuucugacacaccucaacaccacuaucggauggagggagcgucaaaauaacuucgccgcugaucuggaagcccagcggcgacccuuacagagauuuaagacgacaguccugcuuaugaugauguugauuuccguggugucaaguugcagcaauucggucguuuccaacucuaaacagaccagguguauccaaagcggcucaaauacuaagugcaguguguccgcaaccauuacacucaaagccggugugaucggggcugagucuuguuucguaauaaagggcccaagcgagaaccagcacaaaaccauugucauccgcacuguguccucagaaacaaucugccgggagggaagcaguuuuuggacgggccauuucaccccuucuugucuguccagcagaaggugccaccuaguuggggacugcgugggaucgcgcugucaggguuggcgagaagaugucauuucacgggaguuuggcggggugaaggacaauaaccagaugucugagaauaagugcuucgaacaauguggagccgcaggcugcgguuguuucaacaucaaucccaguugccuguacguucauacuauucuccguuccgcgagaaacgaggcugugaggguauuuaaauguaaugauuggguccacaagcugacauuccauauaaaagggccaaacggcgaagaggaagacguggugcuuaauagcuugucuaccaaguuucugagcuggggaacaaucuccuuaucacucgacagugagggcauuacugggaccaacagcuauucuuuccuggaguccucaaaaggaggcuuugccauccacgaugaagaguucagugaaauuccccgcgaggguuuucuuggggaaauccggugcagcuccgagucugcagucguuucggcccacaagagcuguauaagagcuccuggacugaucaaguacaaaccaaugacggaccagguggagugcucagccuccuugguagauccguucgcaauuuuuaucaagggcagucucccccagaccaggucugguuauacauucacuagcucccgagacaaacgcaccauucaggcuuuuaacaauggcgccaucaaggcgcugcuaacacugaaccucgaugaccaugaagugauauucucagagucugucauuacuugugaaugcaccuuucugaauaucagcgggugcuacaguuguaacuucggagcccaggugugcuucaaaaucaaguccagcggcauuggggauuuuguuucuucauccgagacgggaaauauacuuuucaguuuuccugugaaaagcggcacagaagacuacugucagauccagcacuucaacucgccaauggucucugaguccuugcaauauagcugcgguggggagucaaagcuguuacucauuaagggaagucugaucucugugggccccuacgauuaucggaauaaaaccgguggcuccagcacuguugugaacccugcugaagacucauggaguauuuuuaauuggcuuagcggguuccuggauuggcuaggaggcccacucagagcacuggucaagaucgccuuggcuauaaucggggcccuggcauuacucuuuauuacaaucaugcuggcgagguccguaauuucuaacacccuuagccguaaaaagaaaaauuga

SEQ ID NO: 11090 - RNA, 3594 nt, Artificial Sequence
  derived and/or modified CDS sequence (opt3) from RVFV(ZH-548)__DQ380206.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcugucagcccacggaaauccgugcaugaaggagaagcuagucaugaaaacgcauugucccaacgauuaucagagugcgcacuaccucaauaacgacgguaagauggccagcgugaaaugcccuccaaaguaugaacugacugaggacuguaauuucugccgacaaaugaccggcgcaucucuuaaaaagggguccuacccccugcaggauuuguuuugccagucaagcgaagacgauggaaguaaacucaagacaaagaugaaaggcgugugugaggucgguguucaggcucugaagaaaugcgacgggcaauuaucuacugcccaugaagugguaccuuucgcuguguuuaagaacuccaaaaaggucuaccuggauaagcucgaccuuaaaaccgaggagaaucuguugccagauagcuucguguguuuugaacacaagggacaguauaaaggcacaauggacucgggccagaccaagagagagcuaaaaucuuucgauauuucccagugccccaagaucgggggacacgguucaaagaaauguacgggcgacgccgcauuuugcagugccuacgaauguacugcucaauaugcgaacgcauacugcagccaugccaauggguccggaaucguucagauucaggugucuggcgucuggaagaaaccgcuguguguggguuaugagaggguaguugugaagcgggaacucagcgcuaaaccuauacaacgugucgagcccugcacaaccuguaucacuaagugcgagccacacgggcuggugguccgcucaacaggcuucaagauuaguuccgccguggcaugcgccagcggaguuugugugaccggcucucagucaccuaguacggaaaucacccuuaaauaccccgggauaagccaguccucuggaggugauauuggcguacauauggcucacgacgaccagucggucagcuccaagaucguggcccauugcccaccccaagauccuugucugguucacgacugcaucgugugugcacacggguugauuaacuaucagugccauacagcgcucucagcuuucgucgugguauuuguguucaguucuaucgccauuauaugucuggcaaucuuauacagaguucugaaaugccuaaagauugccccaaggaaaguccucaauccgcugauguggaucacugcuuuuauccgguggauuuacaagaaaaugguggcccgaguggcagauaacauaaaccaggucaaucgcgagaucggauggauggaaggcggucagcuuguuuuggggaaccccgcuccuauuccaagacacgcccccaucccuagguauagcaccuaccugaugcuccugcuuauuguguccuaugcgucagccuguagcgagcugauccaggcuucuucccggauaacaacuugcaguaccgagggcgugaauacaaagugucgcuugagcggaaccgcacucaucagagccggcucuguaggggcugaagccugccugauguuaaagggagucaaagaggaccaaacuaaguuccugaaaauuaagacgguguccucagaacuaaguugcagggagggucagagcuacuggacaggcucguuuuccccaaaaugucucucuagccgucggugccaucugguuggggaaugucacgugaaccgaugccuuucauggagagauaaugagaccagugcagaguucuccuuugucggagaaucuacuaccaugagggagaacaaguguuucgaacagugcggcgguuggggguguggcugcuuuaaugugaaccccagcuguuuguucguucacacauaucugcaauccgugcgcaaggaggcgcuccggguauuuaauugcaucgacuggguccauaaacugaccuuagaaauuacugauuucgacggaucagugagcacaaucgaucugggcgccaguucuuccagauuuacgaacugggggagcgugucgcuuucauuggacgcugagggaauaucuggcaguaauuccuucagcuucauugagucuccggguaagggguacgccaucgucgaugaaccuuuuagcgagauuccaaggcagggauuccucggcgaaauccgcuguaacuccgagucaaguguucugagcgcacacgaaucuugccuacgagcucccaaucugauauccuauaaaccuaugaucgaccagcucgagugcaccacuaaccugauugaucccuuugugguauucgagcgggguucacuuccacagacacguaaugacaagaccuuugccgcaaguaaaggcaacagaggggugcaagccuucagcaagggauccguccaggcugacuugacacugauguuugauaacuucgaaguggacuuuguuggcgcggccgugucuugugaugcagcuuucuuaaaucucacugggugcuacucguguaacgccggagccagggucugccugagcaucaccucaacgggcaccgguucccuuagugcucauaauaaggacgggucucugcacauuguguugccuagcgagaacggaacaaaagaucagugucaaauccuccauuuuacuguucccgaaguggaggaggaguucauguacuccugcgacggcgaugagcgcccacugcuagucaaggguacccugauagcaauugacccguuugaugaccggagagaagccggcggggagucaacaguagugaauccuaaaucuggaagcuggaacuucuucgauugguuuaguggccucauguccugguucgggggaccccugaagacuauccuuuugaucugucuguauguugcguuaagcauuggccucuuuuuccugcuuaucuaccuggguaggaccgggcuaucuaaaauguggcucgcugccacgaagaaggcaucauga

SEQ ID NO: 11091 - RNA, 3594 nt, Artificial Sequence
  derived and/or modified CDS sequence (opt3) from RVFV(ZS-6365)__DQ380205.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauggacucgggccagaccaagagagaguugaaaucuuucgauauuucccaaugccccaagaucgggggacacgguucaaagaaauguacgggcgacgccgcauuuugcagugccuacgaauguacugcucaguaugcgaacgcauacugcagccaugccaauggguccggaaucguucagauucaagugucuggcgucuggaagaaaccgcuauguguggguuaugagaggguaguugugaagcgggaacugagcgcuaaaccuauacagcgugucgagcccugcacaaccuguaucacuaagugcgagccacacgggcucgugguccgcucaacaggcuucaagauuaguuccgccguggcaugcgccagcggaguuugugugaccggcucucagucaccuaguacggaaaucacccugaaauaccccgggauaagccaguccucuggaggugauauuggcguacauauggcucacgacgaccaaucggucagcuccaagaucguggcccauugcccaccccaggauccuugucuuguucacgggugcaucgugugugcacacggacugauuaacuaucagugccauacagcguugucagcuuucgucgugguauuuguguucaguucuaucgccauuauaugucucgcaauccuguacagaguuuuaaaaugccugaagauugccccaaggaaaguccuaaauccgcucauguggaucacugcuuuuauccgguggauuuacaagaaaaugguggcccgaguggcagacaacauaaaccaggucaaucgcgagaucggcuggauggaaggugggcaacugguucuuggcaaccccgcuccuauuccaagacacgcccccaucccuagguauagcaccuacuugaugcugcuccugauuguguccuaugcgucagccuguagcgagcuuauccaggcuucuucccggauaacaacuugcaguaccgagggagugaauacaaagugucgccugagcggcaccgcauugaucagagccgggucuguaggagcugaagccugccucaugcugaagggugucaaagaggaucagacuaaguucuuaaaaauuaagacgguguccucagaacugaguugcagggagggccagagcuacuggacagggucguuuuccccaaaaugucuaucuagccgucggugccaucucguuggagaaugucacgugaaccgaugccugucauggagagacaaugagaccagugcagaguucuccuuugucggcgaaucuacuaccaugagggagaacaaguguuucgaacaaugcgguggguggggcuguggaugcuuuaaugugaaccccagcugucuuuucguucacacauauuugcaguccgugcgcaaggaggcgcugcggguauuuaauugcaucgauuggguccauaaacucacccuggaaauuacugacuucgauggcucagugagcacaaucgacuuaggggccaguucuuccagauuuacgaacuggggaagcgugucgcugucacuugaugcugagggcauaucugguaguaauuccuucagcuucauugagucuccggggaagggauacgccaucgucgacgaaccuuuuagcgagauuccaaggcagggcuucuugggugaaauccgcuguaacuccgagucaaguguucucagcgcacacgaaucuugccugcgagcucccaaucuaauauccuauaaaccuaugaucgaucagcuggagugcaccacuaaccucauugaccccuuugugguauucgagcggggcucacugccacaaacacguaaugauaagaccuuugccgcaaguaaagggaacagaggagugcaggccuucagcaagggcuccguccaggcugaccuuacauugauguuugacaacuucgaaguggauuuuguuggggcggccgugucuugugacgcagcuuuccugaauuuaacuggaugcuacucguguaacgccggcgccagggucugccucagcaucaccucaacggguaccgggucccugagugcucauaauaaggauggaucucuucacauugugcugccuagcgagaacggcacaaaagaccaaugucagaucuugcauuuuacuguucccgaaguggaggaggaguucauguacuccugcgauggugacgagcgcccacuccuggucaagggcacccuaauagcaauugauccguuugacgaucggagagaagccgggggagagucaacaguagugaauccuaaaucuggcagcuggaacuucuucgacugguuuagugggcugauguccugguucggaggcccccucaagacuauccugcuuaucuguuuguauguugcgcugagcauugguuuauuuuuccuccugaucuaccuugggaggaccggacugucuaaaauguggcuagcugccacgaagaaggcaucauga

SEQ ID NO: 11092 - RNA, 3594 nt, Artificial Sequence
  derived and/or modified CDS sequence (opt3) from RVFV(CAR-R1622)__DQ380219.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauggacucgggccagaccaagagagaguugaaaucuuucgauauuucccaaugccccaagaucgggggacacgguucaaagaaauguacgggcgacgccgcauuuugcagugccuacgaauguacugcucaguaugcgaacgcauacugcagccaugccaauggguccggaaucguucagauucaagugucuggcgucuggaagaaaccgcuauguguggguuaugagaggguaguugugaagcgggaacugagcgcuaaaccuauacagcgugucgagcccugcacaaccuguaucacuaagugcgagccacacgggcucgugguccgcucaacaggcuucaagauuaguuccgccguggcaugcgccagcggaguuugugugaccggcucucagucaccuaguacggaaaucacccugaaauaccccgggauaagccaguccucuggaggugauauuggcguacauauggcucacgacgaccaaucggucagcuccaagaucguggcccauugcccaccccaggauccuugucuuguucacgggugcaucgugugugcacacggacugauuaacuaucagugccauacagcguugucagcuuucgucgugguauuuguguucaguucuaucgccauuauaugucucgcaauccuguacagaguuuuaaaaugccugaagauugccccaaggaaaguccuaaauccgcucauguggaucacugcuuuuauccgguggguguacaagaaaaugguggcccgagucgcagacaacauuaaccagguuaaucgcgagauaggcuggauggaaggugggcaacuggugcuuggcaaccccgcuccuaucccaagacacgcccccauuccuagguauagcaccuacuugaugcugcuccugaucguguccuaugcgucagccuguagcgagcuuauucaggcuucuucccggaucacaacuugcaguaccgagggaguaaauacaaagugucgccugagcggcaccgcauugauaagagccgggucugucggagcugaagccugccucaugcugaagggugugaaagaggaucagacuaaguucuuaaaaaucaagacgguuuccucagaacugaguugcagggagggccagagcuacuggacagggucguuuuccccaaaaugucuaucuagccgucggugccaucucgugggagaaugucacgucaaccgaugccugucauggagagacaaugagaccagugcagaguucuccuuugugggcgaaucuacuaccaugagggagaacaaguguuucgaacaaugcgguggguggggcuguggaugcuuuaauguuaaccccagcugucuuuucgugcacacauauuugcaguccguacgcaaggaggcgcugcgggucuuuaauugcauugauugggugcauaaacucacccuggaaaucacugacuucgauggcucagugagcacaauugacuuaggggccaguucuuccagauuuacgaacuggggaagcgucucgcugucacuugaugcugagggcaucucugguaguaauuccuucagcuucauagagucuccggggaagggauacgccauuguugacgaaccuuuuagcgagaucccaaggcagggcuucuugggugaaauucgcuguaacuccgagucaagugugcucagcgcacacgaaucuugccugcgagcucccaaucuaaucuccuauaaaccuaugauagaucagcuggagugcaccacuaaccucaucgaccccuuuguaguguucgagcggggcucacugccacaaacacguaaugauaagaccuuugccgcaaguaaagggaacagaggaguccaggccuucagcaagggcuccgugcaggcugaccuuacauugauguuugacaacuucgaaguugauuuugugggggcggccgucucuugugacgcagcuuuccugaauuuaacuggaugcuacucguguaacgccggcgccagggugugccucagcauuaccucaacggguaccgggacacuguccgcucauaauaaggauggaagucuucacaucguucugccuucugagaacggcacuaaagaccaaugucagauuuugcauuuuaccgugcccgaagucgaggaggaguucauguacagcugcgauggugacgagcgcccacuccugguaaagggcacacuaaucgcaauagauccguuugacgaucggagagaagccgggggagaguccacugugguuaauccuaaaucaggcucuuggaacuucuucgacugguuuagcgggcugaugaguugguucggaggcccccucaagaccauucugcuuaucuguuuguauguggcgcuguccaucgguuuauuuuuccuccugauuuaccuugggaggacgggacugagcaaaauguggcuagcugccacaaagaaggcaucuuga

SEQ ID NO: 11093 - RNA, 3594 nt, Artificial Sequence
  derived and/or modified CDS sequence (opt3) from RVFV(2250/74)__DQ380209.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauggacucgggccagaccaagagagaguugaaaucuuucgauauuucccaaugccccaagaucgggggacacgguucaaagaaauguacgggcgacgccgcauuuugcagugccuacgaauguacugcucaguaugcgaacgcauacugcagccaugccaauggguccggaaucguucagauucaagugucuggcgucuggaagaaaccgcuauguguggguuaugagaggguaguugugaagcgggaacugagcgcuaaaccuauacagcgugucgagcccugcacaaccuguaucacuaagugcgagccacacgggcucgugguccgcucaacaggcuucaagauuaguuccgccguggcaugcgccagcggaguuugugugaccggcucucagucaccuaguacggaaaucacccugaaauaccccgggauaagccaguccucuggaggugauauuggcguacauauggcucacgacgaccaaucggucagcuccaagaucguggcccauugcccaccccaggauccuugucuuguucacgggugcaucgugugugcacacggacugauuaacuaucagugccauacagcguugucagcuuucgucgugguauuuguguucaguucuaucgccauuauaugucucgcaauccuguacagaguuuuaaaaugccugaagauugccccaaggaaaguccuaaauccgcucauguggaucacugcuuuuauccgguggauuuacaagaaaaugguggcccgaguggcagacaacauaaaccaggucaaucgcgagaucggcuggauggaaggugggcaacugguucuuggcaaccccgcuccuauuccaagacacgcccccaucccuagguauagcaccuacuugaugcugcuccugauuguguccuaugcgucagccuguagcgagcuuauccaggcuucuucccggauaacaacuugcaguaccgagggagugaauacaaagugucgccugagcggcaccgcauugaucagagccgggucuguaggagcugaagccugccucaugcugaagggugucaaagaggaucagacuaaguucuuaaaaauuaagacgguguccucagaacugaguugcagggagggccagagcuacuggacagggucguuuuccccaaaaugucuaucuagccgucggugccaucucguuggagaaugucacgugaaccgaugccugucauggagagacaaugagaccagugcagaguucuccuuugucggcgaaucuacuaccaugagggagaacaaguguuucgaacaaugcgguggguggggcuguggaugcuuuaaugugaaccccagcugucuuuucguucacacauauuugcaguccgugcgcaaggaggcgcugcggguauuuaauugcaucgauuggguccauaaacucacccuggaaauuacugacuucgauggcucagugagcacaaucgacuuaggggccaguucuuccagauuuacgaacuggggaagcgugucgcugucacuugaugcugagggcauaucugguaguaauuccuucagcuucauugagucuccggggaagggauacgccaucgucgacgaaccuuuuagcgagauuccaaggcagggcuucuugggugaaauccgcuguaacuccgagucaaguguucucagcgcacacgaaucuugccugcgagcucccaaucuaauauccuauaaaccuaugaucgaucagcuggagugcaccacuaaccucauugaccccuuugugguauucgagcggggcucacugccacaaacacguaaugauaagaccuuugccgcaaguaaagggaacagaggagugcaggccuucagcaagggcuccguccaggcugaccuuacauugauguuugacaacuucgaaguggauuuuguuggggcggccgugucuugugacgcagcuuuccugaauuuaacuggaugcuacucguguaacgccggcgccaaggucugccucagcaucaccucaacggguaccgggucccugagugcucauaauaaagauggaucucuucacauugugcugccuagcgagaacggcacaaaggaccaaugucagaucuugcauuuuacuguucccgaaguggaggaggaguucauguacuccugcgauggugacgagaggccacuccuggucaaaggcacccuaauagcaauugauccguuugacgaucgccgggaagccgggggagagucaacaguagugaauccuaagucuggcagcuggaacuucuucgacugguuuagugggcugauguccugguucggaggcccccucaaaacuauccugcuuaucuguuuguauguugcgcugagcauugguuuauuuuuccuccugaucuaccuugggagaaccggacugucuaagauguggcuagcugccacgaagaaagcaucauga

SEQ ID NO: 11094 - RNA, 3594 nt, Artificial Sequence
  derived and/or modified CDS sequence (opt3) from RVFV(T1)__DQ380201.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauggacucgggccagaccaagagagaguugaaaucuuucgauauuucccaaugccccaagaucgggggacacgguucaaagaaauguacgggcgacgccgcauuuugcagugccuacgaauguacugcucaguaugcgaacgcauacugcagccaugccaauggguccggaaucguucagauucaagugucuggcgucuggaagaaaccgcuauguguggguuaugagaggguaguugugaagcgggaacugagcgcuaaaccuauacagcgugucgagcccugcacaaccuguaucacuaagugcgagccacacgggcucgugguccgcucaacaggcuucaagauuaguuccgccguggcaugcgccagcggaguuugugugaccggcucucagucaccuaguacggaaaucacccugaaauaccccgggauaagccaguccucuggaggugauauuggcguacauauggcucacgacgaccaaucggucagcuccaagaucguggcccauugcccaccccaggauccuugucuuguucacgggugcaucgugugugcacacggacugauuaacuaucagugccauacagcguugucagcuuucgucgugguauuuguguucaguucuaucgccauuauaugucucgcaguucuguacagagucuuaaaaugccugaagaucgccccaaggaaagugcuaaauccgcucauguggauuacugcuuuuauccgguggaucuacaagaaaaugguggcccgagucgcagacaacauuaaccagguuaaucgcgagauaggcuggauggaaggugggcaacuggugcuuggcaaccccgcuccuaucccaagacacgcccccauuccuagguauagcaccuacuugaugcugcuccugaucguguccuaugcgucagccuguagcgagcuuauucaggcuucuucccggaucacaacuugcaguaccgagggaguaaauacaaagugucgccugagcggcaccgcauugauaagagccgggucugucggagcugaagccugccucaugcugaagggugugaaagaggaucagacuaaguucuuaaaaaucaagacgguuuccucagaacugaguugcagggagggccagagcuacuggacagggucguuuuccccaaaaugucuaucuagccgucggugccaucucgugggagaaugucacgucaaccgaugccugucauggagagacaaugagaccagugcagaguucuccuuugugggcgaaucuacuaccaugagggagaacaaguguuucgaacaaugcgguggguggggcuguggaugcuuuaauguuaaccccagcugucuuuucgugcacacauauuugcaguccguacgcaaggaggcgcugcgggucuuuaauugcauugauugggugcauaaacucacccuggaaaucacugacuucgauggcucagugagcacaauugacuuaggggccaguucuuccagauuuacgaacuggggaagcgucucgcugucacuugaugcugagggcaucucugguaguaauuccuucagcuucauagagucuccggggaagggauacgccauuguugacgaaccuuuuagcgagaucccaaggcagggcuucuugggugaaauucgcuguaacuccgagucaagugugcucagcgcacacgaaucuugccugcgagcucccaaucuaaucuccuauaaaccuaugauagaucagcuggagugcaccacuaaccucaucgaccccuuuguaguguucgagcggggcucacugccacaaacacguaaugauaagaccuuugccgcaaguaaagggaacagaggaguccaggccuucagcaagggcuccgugcaggcugaccuuacauugauguuugacaacuucgaaguugauuuugugggggcggccgucucuugugacgcagcuuuccugaauuuaacuggaugcuacucguguaacgccggcgccagggugugccucagcauuaccucaacggguaccgggucccugagugcucauaauaaggauggaucucuucacaucguucugccuagcgagaacggcacaaaagaccaaugucagauuuugcauuuuacugugcccgaagucgaggaggaguucauguacuccugcgauggugacgagcgcccacuccugguaaagggcacccuaaucgcaauagauccguuugacgaucggagagaagccgggggagagucaacagugguuaauccuaaaucuggcagcuggaacuucuucgacugguuuagugggcugauguccugguucggaggcccccucaagacuauucugcuuaucuguuuguauguggcgcugagcaucgguuuauuuuuccuccugauuuaccuugggaggaccggacugucuaaaauguggcuagcugccacgaagaaggcaucauga

SEQ ID NO: 11095 - RNA, 3594 nt, Artificial Sequence
  derived and/or modified CDS sequence (opt3) from RVFV(1853/78)__DQ380220.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauggacucgggccagaccaagagagaguugaaaucuuucgauauuucccaaugccccaagaucgggggacacgguucaaagaaauguacgggcgacgccgcauuuugcagugccuacgaauguacugcucaguaugcgaacgcauacugcagccaugccaauggguccggaguugugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugauauaggcguccauauggcucacgacgaccaaucggugagcuccaagauuguugcccauugcccaccccaggauccuugucuugugcacgggugcaucgucugugcacacggacugaucaacuaucagugccauacagcguugucagcuuucgugguaguguuuguuuucaguucuauugccaucauuugucucgcaauacuguacagagucuuaaaaugccugaagaucgccccaaggaaagugcuaaauccgcucauguggauuacugcuuuuauccgguggguguacaagaaaauggucgcccgaguugcagacaacaucaaccaggugaaucgcgagauuggcuggauggaaggugggcaacuggugcuuggcaaccccgcuccuauaccaagacacgcccccaucccuagguauagcaccuacuugaugcugcuccugauuguauccuaugcgucagccuguagcgagcuuauccaggcuucuucccggauuacaacuugcaguaccgagggagucaauacaaagugucgccugagcggcaccgcauugaucagagccgggucugugggagcugaagccugccucaugcugaaggguguuaaagaggaucagacuaaguucuuaaaaauaaagacgguguccucagaacugaguugcagggagggccagagcuacuggacagggucguuuuccccaaaaugucuaucuagccgucggugccaucucgucggagaaugucacgugaaccgaugccugucauggagagacaaugagaccagugcagaguucuccuuuguuggcgaaucuacuaccaugagggagaacaaguguuucgaacaaugcgguggguggggcuguggaugcuuuaaugugaaccccagcugucuuuucguacacacauauuugcaguccguccgcaaggaggcgcugcggguguuuaauugcaucgauugggugcauaaacucacccuggaaauuacugacuucgauggcucagucagcacaaucgacuuaggggccaguucuuccagauuuacgaacuggggaagcguuucgcugucacuugaugcugagggcauuucugguaguaauuccuucagcuucaucgagucuccggggaagggauacgccauaguggacgaaccuuuuagcgagauuccaaggcagggcuucuugggugaaauccgcuguaacuccgagucaaguguacucagcgcacacgaaucuugccugcgagcucccaaucuaauuuccuauaaaccuaugaucgaucagcuggagugcaccacuaaccucauagaccccuuuguggucuucgagcggggcucacugccacaaacacguaaugauaagaccuuugccgcaaguaaagggaacagaggagugcaggccuucagcaagggcuccguucaggcugaccuuacauugauguuugacaacuucgaaguggauuuugucggggcggccgugucuugugacgcagcuuuccugaauuuaacuggaugcuacucguguaacgccggcgccaggguuugccucagcaucaccucaacggguaccgggacacuguccgcucauaauaaggauggaagucuucacauugugcugccuucugagaacggcacuaaagaccaaugucagaucuugcauuuuaccguccccgaaguagaggaggaguucauguacagcugcgauggugacgagcgcccacuccuggugaagggcacacuaauugcaaucgauccguuugacgaucggagagaagccgggggagaguccacuguugugaauccuaaaucaggcucuuggaacuucuucgacugguuuagcgggcugaugaguugguucggaggcccccucaagaccauacugcuuauuuguuuguaugucgcgcuguccaucgguuuauuuuuccuccugaucuaccuugggaggacgggacugagcaaaauguggcuagcugccacaaagaaggcaucuuga

SEQ ID NO: 11096 - RNA, 3594 nt, Artificial Sequence
  derived and/or modified CDS sequence (opt3) from RVFV(MP-12)__DQ380208.1__GP
auguacgugcugcucaccauccuuacaagcguccugguuugcgaggccauuauaagaguguccuugucuucaacuagggaagagacguguuucggcgacaguaccaaccccgaaaugaucgagggggcuugggauagcuuacgggaagaggagaugccugaagaacuguccugcucuauuucgggaauccgcgaaguaaagacaucaagccaggagcuauaucgagcacucaaagccauuaucgcggcugacggucugaauaacauaacuugucacggcaaggauccagaggacaaaaucagucuuauuaaggggccgccccauaaaaagcgugugggaaucgucagaugcgaaaggcggcgcgaugccaagcaaauuggcagagagaccauggcagguaucgccaugacagugcugccugcuuuggcaguuuuugcccucgcuccaguggucuucgccgaagacccccaccugaggaaucggccugggaaaggacauaacuacauagauggcaugacccaggaggacgcgacuuguaagccagugacauaugcaggcgccugcuccucuuuugauguacugcucgaaaaagggaaguuccccuuauuucagagcuacgcucaccaucgcacccugcuugaggccguucacgacacgauuaucgcaaaagcugauccuccauccugugacuugcugucagcccacggaaauccgugcaugaaggagaagcuagugaugaaaacucauugucccaacgauuaucagagugcgcaccaucucaauaacgacgguaagauggccagcgucaaaugcccuccaaaguacgaacugaccgaggacuguaauuucugccgacaaaugacaggcgcaucucuuaaaaagggguccuauccccugcaggauuuguuuugccagucaagcgaagacgauggaaguaaacucaagacuaagaugaaaggcgugugugagguggguguccaggcucugaagaaaugcgacgggcaauuaucuaccgcccacgaaguugugccuuucgcuguauuuaagaacuccaaaaagguguaccuggauaagcucgaccuuaaaacagaggagaaucuguugccagauagcuucgucuguuuugaacacaagggacaguacaaaggcaccauggacucgggccagacgaagagagagcuaaaaucuuucgauauuucccagugccccaagaucgggggacaugguucaaagaaauguacuggcgacgccgcauuuugcagugccuaugaauguacagcucaauacgcgaacgcauauugcagccacgccaauggguccggaaucgugcagauucagguuucuggcguguggaagaaaccgcugugugucgguuacgagagggugguaguuaagcgggaacucagcgcuaaaccuauacaacguguggagcccugcaccacuuguaucacaaagugcgagccacaugggcuggucgugcgcucaaccggcuucaagauuaguuccgccgucgcaugcgccagcggaguguguguuacgggcucucagucaccuaguaccgaaaucacacuuaaauaucccgggauaagccaguccucuggaggugauauuggcgugcacauggcucaugacgaccagucgguaagcuccaagaucgucgcccacugcccaccccaagauccuugucuggugcacgacugcaucguuugugcacauggguugauuaacuaccagugccacacugcgcucucagcuuucguggucguguuuguauucaguucuaucgccauuauaugucuggcaaucuuauauagagugcugaaaugccuaaagauugccccaaggaaaguucucaauccgcugauguggaucaccgcuuuuauccgguggauuuacaagaaaauggucgcccgaguggcagauaacauaaaccaggugaaucgcgagaucggauggauggaaggcggucagcuugucuuggggaaccccgcuccuauuccaagacaugcccccaucccuagguacagcacauaucugaugcuccugcuuauuguuuccuacgcgucagccuguagcgagcugauccaagcuaguucccggauaacuaccugcaguacagagggcgugaauaccaagugucgcuugagcggaacugcacucaucagagccggcucugugggggcugaagccugccugauguuaaagggaguaaaagaggaccagacgaaguuccugaaacuaaagacagucuccucagaacucaguugcagggagggucagagcuauuggaccggcucguuuuccccaaaaugucugucuagccgucggugccaccuugugggggaaugucacguuaaccgaugcuugucauggagagauaaugagacuucugcagaguucuccuuugugggagaaucuaccacaaugagggagaacaaguguuucgaacagugcggcgguuggggguguggcugcuuuaaugucaaccccagcugucuguucgugcauaccuaccuccaauccguucgcaaggaggcgcugcggguguuuaauugcauugacuggguacacaaauuaacucuggaaaucacagauuucgacggaucagucagcacgauugaucuuggcgccaguucuuccagauuuaccaacugggggagcgugucguugucacucgacgcugagggaaucucuggcaguaauuccuucagcuucauagagucuccggguaagggguaugccauuguggaugaaccuuuuagcgagaucccaaggcagggauuccugggcgaaauucgcuguaacuccgagucaaguguccuaagcgcacaugaaucuugccugcgagcucccaaucucaucuccuacaaaccuaugauagaccagcuggagugcacuacaaaccuuaucgaucccuuuguuguguucgagcgggguucauugccacagacccguaaugacaagacauuugccgcaaguaaaggcaacagagggguacaagccuucagcaagggauccgugcaggcugaccugacuuuaauguuugauaacuucgaagucgacuuugugggcgcggccguuucuugugaugcagcuuuccucaaucugaccgggugcuauucguguaacgccggagccagggugugccuuagcauuacgucaaccggcacagguucccugagugcucacaauaaggacgggucuuugcauaucguccucccuagcgagaacggaacuaaagaucagugucaaauucugcacuuuaccgugcccgaaguugaggaggaguucauguacuccugcgacggcgaugagcgcccacuacuggugaaggguacacucaucgcaauagacccguuugaugaccggagagaagccggcggggagucaacugucguaaauccuaaaucuggaagcuggaacuucuucgauugguuuaguggccugauguccugguucgggggaccccuuaagaccauuuugcugaucuguuuauacguggcgcucagcaucggccuguuuuuccuucugauuuaucuaggugggacgggacucucuaaaauguggcuggcugccacaaagaaggcaucauga

SEQ ID NO: 11097 - RNA, 3594 nt, Artificial Sequence
  derived and/or modified CDS sequence (opt3) from RVFV(ZM-657)__DQ380204.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauggacucgggccagaccaagagagaguugaaaucuuucgauauuucccaaugccccaagaucgggggacacgguucaaagaaauguacgggcgacgccgcauuuugcagugccuacgaauguacugcucaguaugcgaaggcauacugcagccaugccaacggguccggaaucguucagauucaagugucuggcgucuggaaaaagccgcuauguguggguuaugagaggguaguugugaaacgggaacugagcgcuaagccuauacagcgugucgagcccugcacaaccuguaucacuaagugcgagccacacgggcucgugguccgcucaacaggcuucaaaauuaguuccgccguggcaugcgccagcggaguuugugugaccggcucucagucaccuaguacggaaaucacccugaaguaccccgggauaagccaguccucuggaggugauauuggcguacauauggcucacgacgaccaaucggucagcuccaaaaucguggcccauugcccaccccaggauccuugucuuguucacgggugcaucgugugugcacacggacugauuaauuaucagugccauacagcguugucagcuuucgucgugguauuuguguucaguucuaucgccauuauaugucucgcaauccuguacagaguuuuaaagugccugaaaauugccccaaggaagguccuaaacccgcucauguggaucacugcuuuuauccgguggauuuacaaaaagaugguggcccgaguggcagacaauauaaaccaggucaaccgcgagaucggcuggauggaaggugggcaacugguucuuggcaaucccgcuccuauuccaagacacgcccccaucccuagguauagcaccuacuugaugcugcuccugauuguguccuaugcgucagccuguagcgagcuuauccaggcuucuucccggauaacaacuugcaguaccgagggagugaacacaaagugucgccugagcggcaccgcauugaucagagccgggucuguaggagcugaagccugccucaugcugaaaggugucaaggaggaucagacuaaauucuuaaagauuaaaacgguguccucagaacugaguugcagggagggccagagcuacuggacagggucguuuuccccaaagugucuaucuagccgucggugccaucucguuggagaaugucacgugaaucgaugccugucauggagagacaacgagaccagugcagaguucuccuuugucggcgaaucuacuaccaugagggagaauaaguguuucgaacaaugcgguggguggggcuguggaugcuuuaacgugaaucccagcugucuuuucguucacacauauuugcaguccgugcgcaaagaggcgcugcggguauuuaacugcaucgauuggguccauaagcucacccuggaaauuacugacuucgauggcucagugagcacaaucgacuuaggggccaguucuuccagauuuacgaauuggggaagcgugucgcugucacuugaugcugagggcauaucugguaguaacuccuucagcuucauugagucuccggggaaaggauacgccaucgucgacgaaccuuuuagcgagauuccaaggcagggcuucuugggugaaauccgcuguaauuccgagucaaguguucucagcgcacacgaaucuugccugcgagcucccaaccuaauauccuauaagccuaugaucgaucagcuggagugcaccacuaaucucauugaccccuuugugguauucgagcggggcucacugccacaaacacguaacgauaaaaccuuugccgcaaguaaggggaauagaggagugcaggccuucagcaagggcuccguccaggcugaccuuacauugauguuugacaacuucgaaguggauuuuguuggggcggccgugucuugugacgcagcuuuccugaacuuaacuggaugcuacucguguaaugccggcgccagggucugccucagcaucaccucaacggguaccgggucccugagugcucauaacaaagauggaucucuucacauugugcugccuagcgagaauggcacaaaggaccaaugucagaucuugcauuuuacuguucccgaaguggaggaggaguucauguacuccugcgauggugacgagcgcccacuccuggucaaaggcacccuaauagcaauugauccguuugacgaucggagagaagccgggggagagucaacaguagugaacccuaagucuggcagcuggaauuucuucgacugguuuagugggcugauguccugguucggaggcccccucaaaacuauccugcuuaucuguuuguauguugcgcugagcauugguuuauuuuuccuccugaucuaccuugggaggaccggacugucuaagauguggcuagcugccacgaagaaagcaucauga

SEQ ID NO: 11098 - RNA, 3594 nt, Artificial Sequence
  derived and/or modified CDS sequence (opt3) from RVFV(ZH-501-777)__DQ380202.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauggaccccggccagaccaagagagaguugaaaucguucgauauuucucaaugcccgaagaucgggggacacgguuccaagaaauguacgggcgacgccgcauuuugcucagccuacgaauguacugcucaguaugcgaacgcauacugcagucaugccaaugggagcggaaucguucagauucaaguguccggcgucuggaagaaaccucuauguguggguuaugagaggguaguugugaagcgggaacugucugcuaaacccauacagcgugucgagccaugcacaaccuguaucacuaagugcgagccucacgggcucgugguccgcagcacaggcuucaagauuucaagugccguggcaugcgccuccggaguuugugugaccggcagccagucucccucaacggaaaucacccugaaauacccagggauaagucagagcuccggaggugauauuggcguacauauggcucacgacgaccaaucugucucgagcaagaucguggcccauugucccccucaggauccaugccuuguucacgggugcaucgugugugcacacggacugauuaacuaucagugccauacagcguuguccgcuuucgucgugguauuuguguucucaaguaucgccauuauaugucucgcaguucuguacagagucuuaaaaugccugaagaucgccccgaggaaagugcuaaauccccucauguggauuacugcuuuuauccgguggaucuacaagaaaaugguggcccgagucgcagacaacauuaaccagguuaaucgcgagauaggcuggauggaaggugggcaacuggugcuuggcaacccugcuccaauccccagacacgccccuauuccaagguauucuaccuacuugaugcugcuccugaucgugagcuaugcguccgccuguucagagcuuauucaggcuagcucucggaucacaacuugcuccaccgagggaguaaauacaaagugucgccugaguggcaccgcauugauaagagccgggagcgucggagcugaagccugccucaugcugaagggugugaaagaggaucagacuaaguucuuaaaaaucaagacgguuucuuccgaacugucaugcagggagggccagaguuacuggacagggagcuuuucgcccaaaugucuauccucucgucggugccaucucgugggagaaugucacgucaaccgaugccugagcuggagagacaaugagaccucagcagaguucaguuuugugggcgaauccacuaccaugagggagaacaaguguuucgaacaaugcgguggguggggcuguggaugcuuuaauguuaacccgucuugucuuuucgugcacacauauuugcagagcguacgcaaggaggcgcugcgggucuuuaauugcauugauugggugcauaaacucacccuggaaaucacugacuucgauggcuccgugucaacaauugacuuaggggccagcaguucuagauuuacgaacuggggauccgucagccugucgcuugaugcugagggcaucucagguucuaauaguuucuccuucauagagagcccugggaagggauacgccauuguugacgaaccauuuucugagauccccaggcagggcuucuugggugaaauucgcuguaacagcgaguccucagugcucagugcacacgaaagcugccugcgagcuccuaaucuaaucucuuauaaacccaugauagaucagcuggagugcaccacuaaccucaucgacccauuuguaguguucgagcggggcucccugccucaaacacguaaugauaagaccuuugccgcaucaaaagggaacagaggaguccaggccuucaguaagggcagcgugcaggcugaccuuacauugauguuugacaacuucgaaguugauuuugugggggcggccgucuccugugacgcagcuuuccugaauuuaacuggaugcuacucuuguaacgccggcgccagggugugccucucgauuaccagcacggguaccgggucacuguccgcucauaauaaggauggaagucuucacaucguucugcccucugagaacggcacaaaagaccaaugucagauuuugcauuuuacugugccagaagucgaggaggaguucauguacagcugcgauggugacgagcgcccgcuccugguaaagggcacccuaaucgcaauagauccuuuugacgaucggagagaagccgggggagaguccacagugguuaaucccaaaucaggcucuuggaacuucuucgacugguuuagcgggcugaugaguugguucggaggcccacucaagacuauucugcuuaucuguuuguauguggcgcuguccaucgguuuauuuuuccuccugauuuaccuugggaggaccggacugagcaaaauguggcuagcugccacgaagaaggcaucuuga

SEQ ID NO: 11099 - RNA, 3594 nt, Artificial Sequence
  derived and/or modified CDS sequence (opt3) from RVFV(OS-3)__DQ380184.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauggacucgggccagaccaagagagaguugaaaucuuucgauauuucccaaugccccaagaucgggggacacgguucaaagaaauguacgggcgacgccgcauuuugcagugccuacgaauguacugcucaguaugcgaacgcauacugcagccaugccaauggguccggaguugugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugauauaggcguccauauggcucacgacgaccaaucggugagcuccaagauuguugcccauugcccaccccaggauccuugucuugugcacgggugcaucgucugugcacacggacugaucaacuaucagugccauacagcguugucagcuuucgugguaguguuuguuuucaguucugucgccauuaucugucucgcaauucuguacaaaguguuaaagugccugaaaauagccccaagaaaggugcuaaauccgcucauguggaucacugcuuuuauuaggugggucuacaaaaagaugguugcccggguggcagacaacaucaaccaggugaaucgagagaucggcuggauggaaggugggcaacuggcucuuggcaaccccgccccuauuccacgccacgcgcccauaccuagauauagcaccuacuugaugcugcuccugaucguauccuaugccucagcuuguagcgagcuuauucaggcaucuuccaggaucacaacuugcaguaccgagggagucaauacaaagugucggcugagcggcaccgccuugauucgcgcugggucugugggagccgaagcaugccucaugcugaaagguguuaaggaggaucagacuaaauucuuaaagaucaaaacgguguccucagaacugaguugcagagagggccagagcuacuggacagggucguuuuccccaaagugucuaucuagcaggcguugccaucucgucggagaaugucacgugaaccggugccugucauggcgagacaaugagaccagugcggaguucuccuuuguuggcgaaucuacuaccaugagagagaacaaguguuucgaacaaugcgguggguggggcuguggaugcuuuaaugugaaccccagcugucuuuucguacacacauauuugcaguccgucaggaaagaggcccugcgcguguuuaauugcauagauugggugcauaagcucacccuggaaaucacugacuucgauggcucagucagcacaauugacuuaggggcuaguucuucccgguuuacgaacuggggaagcguuucgcugucacuugaugccgagggcaucucugguaguaauuccuucagcuucauugagucuccggggaaaggauacgcaaucguggacgaaccuuuuagcgagauaccaagacagggcuucuugggugaaauuagguguaacuccgagucaaguguacucagcgcucacgaaucuugccugcgcgcccccaaucuaaucuccuauaagccuaugauugaucagcuggagugcaccacuaaccucaucgaccccuuuguggucuucgagcgaggcucacugccacaaacacggaaugauaaaaccuuugcagccaguaaggggaaccguggagugcaggcuuucagcaagggcuccguucaggcggaccuuacauugauguuugacaacuucgaaguggauuuugucggggccgcagugucuugugacgcugccuuccugaauuuaacuggaugcuacucguguaacgccggcgcuagaguuugccucagcauaaccucaacggguaccgggacacuguccgcacauaauaaagauggaagucuucacaucgugcugccuucugagaacggcacuaaggaccaaugucagauuuugcauuuuaccguccccgaaguagaggaggaguucauguacagcugcgauggugacgagaggccacuccuggugaaaggcacacuaaucgccauugauccguuugacgaucgccgggaagcugggggagaguccacuguugugaauccuaagucaggcucuuggaacuucuucgacugguuuagcgggcugaugaguugguucggaggcccccucaaaaccauccugcuuauauguuuguaugucgcgcuguccauugguuuauuuuuccuccugaucuaccuugggagaacgggacugagcaagauguggcuagccgcaacaaagaaagccucuuga

SEQ ID NO: 11100 - RNA, 3594 nt, Artificial Sequence
  derived and/or modified CDS sequence (opt3) from RVFV(Sudan 86-2010)__JQ820489.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggguauucgcgaagucaagaccucaagccaggagcuauaucgagcacucaaagccaucauugcggcugacggacugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaaaaauuccaagaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugacauaggcguccauauggcucacgaugaccaaucggugagcuccaagauuguugcccauugcccaccccaggacccuugucuugugcacgggugcaucgucugugcacacggacugaucaauuaucagugccauacagcguugucagcuuucgugguaguguuuguuuucaguucuauugccaucauuugucucgcaauacuguacagagucuuaaaaugccugaagaucgccccaaggaaagugcuaaacccgcucauguggauuacugcuuuuauccgguggguguacaagaaaauggucgcccgaguugcagauaacaucaaucaggugaaccgcgagauuggcuggauggaaggugggcaacuggugcuuggcaaucccgcuccuauaccaagacacgcccccaucccuagguauagcaccuacuugaugcugcuccugauuguauccuaugcgucagccuguagcgagcuuauccaggcuucuucccggauuacaacuugcaguaccgagggagucaacacaaagugucgccugagcggcaccgcauugaucagagccgggucugugggagcugaagccugccucaugcugaaggguguuaaagaggaccagacuaaguucuuaaaaauaaagacgguguccucagaacugaguugcagggagggccagagcuacuggacagggucguuuuccccaaaaugucuaucuagccgucggugccaucucgucggagaaugucacgugaaucgaugccugucauggagagauaacgagaccagugcagaguucuccuuuguuggcgaaucuacuaccaugagggagaauaaguguuucgaacaaugcgguggguggggcuguggaugcuuuaacgugaaucccagcugucuuuucguacacacauauuugcaguccguccgcaaggaggcgcugcggguguuuaacugcaucgacugggugcauaaacucacccuggaaauuacugauuucgacggcucagucagcacaaucgauuuaggggccaguucuuccagauuuacgaauuggggaagcguuucgcugucacuugacgcugagggcauuucugguaguaacuccuucagcuucaucgagucuccggggaagggauacgccauaguggaugaaccuuuuagcgagauuccaaggcagggcuucuugggugaaauccgcuguaauuccgagucaaguguacucagcgcacacgaaucuugccugcgagcucccaaccuaauuuccuauaaaccuaugaucgaccagcuggagugcaccacuaaucucauagaucccuuugugaucuucgagcggggcucacugccacaaacacguaacgacaagaccuuugccgcaaguaaagggaacagaggaguccaggccuucagcaagggcuccgugcaggcugaucuuacauugauguuugacaauuucgaaguugacuuugugggggcggccgucucuugugaugcagcuuuccugaacuuaacuggaugcuacucguguaaugccggcgccagggugugccucagcauuaccucaacggguaccgggacacuguccgcucauaacaaggacggaagucuucacaucguucugccuucugagaauggcacuaaagaucaaugucagauuuugcauuuuaccgugcccgaagucgaggaggaguucauguacagcugcgacggugaugagcgcccacuccugguaaagggcacacuaaucgcaauagacccguuugaugaccggagagaagccgggggagaguccacugugguuaacccuaaaucaggcucuuggaauuucuucgauugguuuagcgggcugaugaguugguucggaggcccccucaagaccauucugcuuaucuguuuguauguggcgcuguccaucgguuuauuuuuccuccugauuuaccuugggaggacgggacugagcaaaauguggcuagcugccacaaagaaggcaucuuga

SEQ ID NO: 11101 - RNA, 3594 nt, Artificial Sequence
  derived and/or modified CDS sequence (opt3) from RVFV(T-46 (228113))__DQ380199.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaaaggacucgggccagaccaaaagagaguugaagucuuucgauauuucccaaugccccaagaucgggggacacgguaguaaaaaguguacgggcgacgccgcauuuugcucagccuacgaauguacugcucaguaugcgaacgcauacugcagccaugccaauggguccggaaucguucagauucaagugucuggcgucuggaaaaagccgcuauguguggguuaugagaggguaguugugaaacgggaacugagcgcuaagccuauacagcgugucgagcccugcacaaccuguaucacuaagugcgagccacacgggcucgugguccgcucaacaggcuucaaaauuaguuccgccguggcaugcgccagcggaguuugugugaccggcucucagucaccuaguacggaaaucacccugaaguaccccgggauaagccaguccucuggaggugauauuggcguacauauggcucacgacgaccaaucggucagcuccaaaaucguggcccauugcccaccccaggauccuugucuuguucacgggugcaucgugugugcacacggacugauuaacuaucagugccauacagcguugucagcuuucgucgugguauuuguguucaguucuaucgccauuauaugucucgcaguucuguacagagucuuaaagugccugaaaaucgccccaaggaaggugcuaaauccgcucauguggauuacugcuuuuauccgguggaucuacaaaaagaugguggcccgagucgcagacaacauuaaccagguuaaucgcgagauaggcuggauggaaggugggcaacuggugcuuggcaaccccgcuccuaucccaagacacgcccccauuccuagguauagcaccuacuugaugcugcuccugaucguguccuaugcgucagccuguagcgagcuuauucaggcuucuucccggaucacaacuugcaguaccgagggaguaaauacaaagugucgccugagcggcaccgcauugauaagagccgggucugucggagcugaagccugccucaugcugaaaggugugaaggaggaucagacuaaauucuuaaagaucaaaacgguuuccucagaacugaguugcagggagggccagagcuacuggacagggucguuuuccccaaagugucuaucuagccgucggugccaucucgugggagaaugucacgucaaccgaugccugucauggagagacaaugagaccagugcagaguucuccuuugugggcgaaucuacuaccaugagggagaacaaguguuucgaacaaugcgguggguggggcuguggaugcuuuaauguuaaccccagcugucuuuucgugcacacauauuugcaguccguacgcaaagaggcgcugcgggucuuuaauugcauugauugggugcauaagcucacccuggaaaucacugacuucgauggcucagugagcacaauugacuuaggggccaguucuuccagauuuacgaacuggggaagcgucucgcugucacuugaugcugagggcaucucugguaguaauuccuucagcuucauagagucuccggggaaaggauacgccauuguugacgaaccuuuuagcgagaucccaaggcagggcuucuugggugaaauucgcuguaacuccgagucaagugugcucagcgcacacgaaucuugccugcgagcucccaaucuaaucuccuauaagccuaugauagaucagcuggagugcaccacuaaccucaucgaccccuuuguaguguucgagcggggcucacugccacaaacacguaaugauaaaaccuuugccgcaaguaaggggaacagaggaguccaggccuucagcaagggcuccgugcaggcugaccuuacauugauguuugacaacuucgaaguugauuuugugggggcggccgucucuugugacgcagcuuuccugaauuuaacuggaugcuacucguguaacgccggcgccagggugugccucagcauuaccucaacggguaccgggucccugagugcucauaauaaagauggaucucuucacaucguucugccuagcgagaacggcacaaaggaccaaugucagauuuugcauuuuacugugcccgaagucgaggaggaguucauguacuccugcgauggugacgagcgcccacuccugguaaaaggcacccuaaucgcaauagauccguuugacgaucggagagaagccgggggagagucaacagugguuaauccuaagucuggcagcuggaacuucuucgacugguuuagugggcugauguccugguucggaggcccccucaaaacuauucugcuuaucuguuuguauguggcgcugagcaucgguuuauuuuuccuccugauuuaccuugggaggaccggacugucuaagauguggcuagcugccacgaagaaagcaucauga

SEQ ID NO: 11102 - RNA, 3594 nt, Artificial Sequence
  derived and/or modified CDS sequence (opt3) from RVFV(2007000094)__EU574055.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggguauucgcgaagucaagaccucaagccaggagcuauaucgagcacucaaagccaucauugcggcugacggacugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaaaaauuccaagaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugacauaggcguccauauggcucacgaugaccaaucggugagcuccaagauuguugcccauugcccaccccaggacccuugucuugugcacgggugcaucgucugugcacacggacugaucaauuaucagugccauacagcguugucagcuuucgugguaguguuuguuuucaguucuauugccaucauuugucucgcaauacuguacagagucuuaaaaugccugaagaucgccccaaggaaagugcuaaacccgcucauguggauuacugcuuuuauccgguggguguacaagaaaauggucgcccgaguugcagauaacaucaaucaggugaaccgcgagauuggcuggauggaaggugggcaacuggugcuuggcaaucccgcuccuauaccaagacacgcccccaucccuagguauagcaccuacuugaugcugcuccugauuguauccuaugcgucagccuguagcgagcuuauccaggcuucuucccggauuacaacuugcaguaccgagggagucaacacaaagugucgccugagcggcaccgcauugaucagagccgggucugugggagcugaagccugccucaugcugaaggguguuaaagaggaccagacuaaguucuuaaaaauaaagacgguguccucagaacugaguugcagggagggccagagcuacuggacagggucguuuuccccaaaaugucuaucuagccgucggugccaucucgucggagaaugucacgugaaucgaugccugucauggagagauaacgagaccagugcagaguucuccuuuguuggcgaaucuacuaccaugagggagaauaaguguuucgaacaaugcgguggguggggcuguggaugcuuuaacgugaaucccagcugucuuuucguacacacauauuugcaguccguccgcaaggaggcgcugcggguguuuaacugcaucgacugggugcauaaacucacccuggaaauuacugauuucgacggcucagucagcacaaucgauuuaggggccaguucuuccagauuuacgaauuggggaagcguuucgcugucacuugacgcugagggcauuucugguaguaacuccuucagcuucaucgagucuccggggaagggauacgccauaguggaugaaccuuuuagcgagauuccaaggcagggcuucuugggugaaauccgcuguaauuccgagucaaguguacucagcgcacacgaaucuugccugcgagcucccaaccuaauuuccuauaaaccuaugaucgaccagcuggagugcaccacuaaucucauagaucccuuuguggucuucgagcggggcucacugccacaaacacguaacgacaagaccuuugccgcaaguaaagggaacagaggagugcaggccuucagcaagggcuccguucaggcugaucuuacauugauguuugacaauuucgaaguggacuuugucggggcggccgugucuugugaugcagcuuuccugaacuuaacuggaugcuacucguguaaugccggcgccaggguuugccucagcaucaccucaacggguaccgggacacuguccgcucauaacaaggacggaagucuucacauugugcugccuucugagaauggcacuaaagaucaaugucagaucuugcauuuuaccguccccgaaguagaggaggaguucauguacagcugcgacggugaugagcgcccacuccuggugaagggcacacuaauugcaaucgacccguuugaugaccggagagaagccgggggagaguccacuguugugaacccuaaaucaggcucuuggaauuucuucgauugguuuagcgggcugaugaguugguucggaggcccccucaagaccauacugcuuauuuguuuguaugucgcgcuguccaucgguuuauuuuuccuccugaucuaccuugggaggacgggacugagcaaaauguggcuagcugccacaaagaaggcaucuuga

SEQ ID NO: 11103 - RNA, 3594 nt, Artificial Sequence
  derived and/or modified CDS sequence (opt3) from RVFV(ZC-3349)__DQ380207.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauggacucgggccagaccaagagagaguugaaaucuuucgauauuucccaaugccccaagaucgggggacacgguucaaagaaauguacgggcgacgccgcauuuugcagugccuacgaauguacugcucaguaugcgaacgcauacugcagccaugccaauggguccggaaucguucagauucaagugucuggcgucuggaagaaaccgcuauguguggguuaugagaggguaguugugaagcgggaacugagcgcuaaaccuauacagcgugucgagcccugcacaaccuguaucacuaagugcgagccacacgggcucgugguccgcucaacaggcuucaagauuaguuccgccguggcaugcgccagcggaguuugugugaccggcucucagucaccuaguacggaaaucacccugaaauaccccgggauaagccaguccucuggaggugauauuggcguacauauggcucacgacgaccaagccgucucgagcaagaucguggcacauugcccaccccaggauccuugucuuguucacgggugcaucgugugugcgcacggacugauuaacuaucagugccauacagcuuuguccgccuucgucgugguauuuguguucucaaguaucgcaauuauaugucucgccauccuguacagaguuuuaaaaugccugaagauugcuccaaggaaaguccuaaauccgcucauguggaucacugccuuuauccgguggauuuacaagaaaaugguggcacgaguggcugacaacauaaaccacgucaaucgcgagaucggcuggauggaaggugggcagcugguucuuggcaaccccgccccuauuccaagacaugcgcccaucccuagguauucuaccuacuugaugcugcuccugauugugagcuaugccuccgcuuguucagagcuuauccaagcaagcucucggauaacaacuugcuccaccgagggagugaauacaaagugucgccugaguggcaccgccuugaucagagcugggagcguaggagccgaagcaugccucaugcugaagggugucaaagaggaucagacuaaguucuuaaaaauuaagacggugucuuccgaacugucaugcagggagggccagaguuacuggacagggagcuuuucgccaaaaugucuauccucucgucggugccaccucguuggagaaugucacgugaaccgaugccugagcuggagagacaaugagaccucagcggaguucaguuuugucggcgaauccacuaccaugagggagaacaaguguuucgaacagugcgguggguggggcuguggaugcuuuaaugugaaccccucuugucuuuucguucauacauauuugcaaagcgugcgcaaggaggcccugcggguauuuaauugcaucgauuggguccacaaacucacccuggaaauuacugacuucgauggcuccgugucaacaaucgacuuaggggcuagcaguucuagauuuacgaacuggggauccgugagccugucgcuugaugccgagggcauaucagguucuaauaguuucuccuucauugagagcccggggaagggauacgcaaucgucgacgaaccuuuuucugagauuccaaggcagggcuucuugggugaaauccgcuguaacagcgaguccucaguucucagugcucaugaaagcugccugaaagcccccaaucuaauaucuuauaagccuaugaucgaucagcuggagugcaccacuaaccucauugaccccuuugugguauucgagcgaggcucccugccacagacacggaaugauaaaaccuuugcagccucaaaggggaaccguggagugcaagcguucaguaagggcagcguccaggcggaccuuacauugauguuugacaacuucgaaguggauuuuguuggggccgcaguguccugugacgcugccuuccugaauuuaacuggaugcuacucuuguaacgccggcgcuagagucugccucucgaucaccagcacggguaccgggucacuguccgcacacaauaaagauggaagucuucauauugugcugccuucugagaacggcacaaaggaccagugucaaaucuugcacuuuacuguucccgaaguggaggaggaguucauguacagcugcgauggugacgagaggccacuccuggucaaaggcacccuaauagccauugauccguuugacgaucgccgggaagcugggggagaguccacaguagugaauccuaagucaggcucuuggaacuucuucgacugguuuagcgggcugaugaguugguucggaggcccccucaaaacuauccugcuuaucuguuuguauguugcucuguccauugguuuauuuuuccuccugaucuaccuugggagaaccggacugagcaagauguggcuagccgcaacgaagaaagccucuuga

SEQ ID NO: 11104 - RNA, 3594 nt, Artificial Sequence
  derived and/or modified CDS sequence (opt3) from RVFV(2007001602)__EU574043.1__GP
auguacgugcugcucaccauccuuauuagcguccugguuugcgaggccgugauaagaguauccaucucuucaacaagggaagagacuuguuucggcgacaguacgaaccccgaaaugauugagggggcuugggauagcuugcgggaagaggagaugccugaagaguuauccugcucugugucgggaauccgcgaagucaagaccucaagccaggagcuguaucgagcacuaaaagccauuaucgcggcugacggucucaauaacauaacaugucacggcaagaauccagaggauaaaaucagucugauuaaggggccgccccauaaaaagcgugugggaaucguuagaugcgaaaggcggcgcgacgccaagcaaauuggcagagagacuauggcagguaucgccaugaccgugcuuccugcucuggcagucuuugccuuggcuccagugguauucgccgaagauccccaccucaggaaccggccugggaaaggacauaauuacauagacggcaugacacaggaggaugcgaccuguaagccaguuacuuaugcaggcgccugcuccucuuuugacgugcugcuggaaaaagggaaguucccccucuuucagagcuacgcucaccaucgcacauuacuggaggccguccacgauaccauuaucgcaaaagcugacccuccauccugugaucuucagucagcccacggaaacccgugcaugaaggagaaguuggugaugaaaacgcauugucccaaugacuaucaaagugcgcacuaccugaacaaugaugguaagauggccagcgugaaaugcccuccaaaguaugaacuaacugaggacuguaacuucugccgacagaugaccggcgcaucucucaaaaagggguccuacccccugcaggaccuuuucugccagucaagcgaagaugacggaaguaaacugaagacaaagaugaaaggcgucugugagguuggugugcaagcguugaagaaaugcgaugggcagcucucuacugcccaugaaguagugccuuucgcugucuuuaagaauaguaaaaagguguaccuggacaaguuagaucugaaaaccgaggagaaccuccuuccagacagcuucguuuguuuugaacacaagggacaguauaaaggcacaauggauucgggccagaccaagagagagcugaaaucuuucgacauuucccaaugccccaagaucgggggacacgguucaaagaaauguacgggcgaugccgcauuuugcagugccuacgaauguacugcucaguaugcgaaugcauacugcagccaugccaacggguccggaaucgugcagauucaagucucuggcguguggaagaaaccguuguguguagguuaugagaggguuguggucaagcgggaacuaagcgcuaaaccuauacagcguguggagcccugcacaaccuguaucacuaagugcgagccacacgggcuggucgugcgcucaacaggcuucaagauuaguuccgccguugcaugcgccagcggaguguguguaaccggcucucagucaccuaguacggaaaucacccucaaauaccccgggauaagccaguccucuggaggugacauuggcguccauauggcucacgaugaccaaucggugagcuccaagaucguugcccauugcccaccccaggacccuugucuggugcacgggugcaucgucugugcacacggacuuauuaauuaucagugccauacagcgcugucagcuuucgugguaaucuuuguguucaguucuacugccauuauauguuuggcaguucucuacagaguccugaaaugcuuaaagaucgccccaaggaaagugcugaacccgcuaauguggauuaccgcuuuuauccgguggguguacaagaaaauggucgcccgaguugcagauaacaucaaucaggugaaccgcgagauuggcuggauggaaggugggcaacucgcucugggcaaucccgccccuauaccaagacacgcgcccaucccuagguauagcacauaccuuauguugcugcucauuguguccuaugccucagcuuguagcgagcugauccaggcaucuucccggauuacuaccugcaguacagagggaguaaacaccaagugucgccuuagcggcacugcccugaucagagcugggucugucggagccgaagcaugcuugaugcucaagggugugaaagaggaccagacgaaguuccugaaaauaaagacaguuuccucagaauuaaguugcagggagggccagagcuacuggaccgggucguuuuccccaaaaugucugucuagccgucggugccaucuagugggagaaugucacgucaaucgaugccucucauggagagauaacgagacuuccgcggaguucuccuuugugggcgaaucuaccacaaugagggagaauaaguguuucgaacaaugcgguggguggggcuguggaugcuuuaacguuaaucccagcugucuguucgugcacaccuaucuucaguccguacgcaaggaggccuugcgggucuuuaacugcaucgacugggugcauaaacugacucucgaaauuacagauuucgacggcucagugagcacgaucgaucugggggcuaguucuuccagauuuaccaauuggggaagcgucucguuaucacuggacgccgagggcauuucugguaguaacuccuucagcuucaucgagucuccggggaagggauacgcaauaguugaugaaccuuuuagcgagauuccaaggcagggcuuccuuggugaaauccgcuguaauuccgagucaaguguguugagcgcucacgaaucuugccuccgagcccccaaccugguauccuauaaaccuaugauugaccagcuagagugcacuacaaaucugaucgaucccuuuguggucuucgagcggggcucacucccacaaacccguaacgacaagacauuugcagccaguaaagggaacagaggagugcaggcuuucagcaagggcuccguucaggcggaucugacucuuauguuugacaauuucgaaguggacuuugucggggccgcagugucuugugaugcugccuucuugaaccugaccggaugcuacucguguaaugccggcgcuaggguuugcuuaagcauaacgucaaccgguacagggacucucuccgcacauaacaaggacggaagucugcacaucgugcuuccuucugagaauggcaccaaagaucaaugucagauucugcauuuuacaguccccgaaguagaggaggaauuuauguacagcugcgacggugaugagcgcccauugcucgugaagggcacucugaucgccauugacccguuugaugaccggagagaagcugggggagaguccaccguugugaacccuaaaucaggcucuuggaauuucuucgauugguuuagcgggcuaaugaguugguucggaggcccccugaagacgauccuccugauaugucuuuaugucgcuuuguccauuggucuguuuuucuuacucaucuaccuggggaggacaggacuuagcaaaauguggcuggccgcaaccaagaaggccucuuga

SEQ ID NO: 11105 - RNA, 3594 nt, Artificial Sequence
  derived and/or modified CDS sequence (opt3) from RVFV(1260/78)__DQ380214.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaggaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauggacucgggccagaccaagagagaguugaaaucuuucgauauuucccaaugccccaagaucgggggacacgguucaaagaaauguacgggcgacgccgcauuuugcagugccuacgaauguacugcucaguaugcgaacgcauacugcagccaugccaauggguccggaaucguucagauucaagugucuggcgucuggaagaaaccgcuauguguggguuaugagaggguaguugugaagcgggaacugagcgcuaaaccuauacagcgugucgagcccugcacaaccuguaucacuaagugcgagccacacgggcucgugguccgcucaacaggcuucaagauuaguuccgccguggcaugcgccagcggaguuugugugaccggcucucagucaccuaguacggaaaucacccugaaauaccccgggauaagccaguccucuggaggugauauuggcguacauauggcucacgacgaccaaucggucagcuccaagaucguggcccauugcccaccccaggauccuugucuuguucacgggugcaucgugugugcacacggacugauuaacuaucagugccauacagcguugucagcuuucgucgugguauuuguguucaguucuaucgccauuauaugucucgcaauccugcacagaguuuuaaaaugccugaagauugccccaaggaaaguccuaaauccgcucauguggaucacugcuuuuauccgguggguguacaagaaaaugguggcccgagucgcagacaacauuaaccagguuaaucgcgagauaggcuggauggaaggugggcaacuggugcuuggcaaccccgcuccuaucccaagacaugcccccauuccuagguacagcaccuauuugaugcugcuccugaucguguccuacgcgucagccuguagcgagcuuauucaggcuucuucccggaucacaacuugcaguaccgagggaguaaauacaaagugucgccugagcggcaccgcauugauaagagccgggucugucggagcugaagccugccucaugcugaagggugugaaagaugaccagacuaaguucuuaaaaaucaagacgguuuccucagagcugaguugcagggaaggccagagcuauuggacagggucguuuuccccaaaaugucuaucuagccgucggugccaccucgugggagagugucacgucaaccgaugccugucauggagagauaaugaaaccagugcagaguucuccuuugugggcgagucuacuaccaugagggaaaacaaguguuucgagcaaugcgguggguggggcuguggaugcuuuaauguuaaccccagcugucuuuucgugcauacauacuugcaguccguacgcaaggaagcgcugcgggucuuuaauugcauugacugggugcacaaacucacccuggagaucacugauuucgacggcucagugagcacaauugauuuaggggccaguucuuccagauuuacgaacuggggaagcgucucgcugucacuugacgcugaaggcaucucugguaguaauuccuucagcuucauagagucuccggggaagggauaugccauuguugaugagccuuuuagcgaaaucccaaggcagggcuucuugggugagauucgcuguaacuccgaaucaagugugcucagcgcacaugagucuugccugcgagcucccaaucuaaucuccuacaaaccuaugauagaccagcuggaaugcaccacuaaccucaucgaucccuuuguaguguucgagcggggcucacugccacaaacacguaaugacaagaccuuugccgcaaguaaagggaacagaggaguccaggccuucagcaagggcuccgugcaggcugaccuuacauugauguuugauaacuucgagguugacuuugugggggcggccgucucuugugaugcagcuuuccugaauuuaacuggaugcuauucguguaacgccggcgccagggugugccucagcauuaccucaacggguaccgggacacuguccgcucacaauaaggacggaagucuucauaucguucugccuucugaaaacggcacuaaagaucaaugucagauuuugcacuuuaccgugcccgaggucgaagaggaguucauguacagcugcgacggugaugaacgcccacuccugguaaagggcacacuaaucgcaauagacccguuugaugaccggagagaggccgggggagaauccacugugguuaauccuaaaucaggcucuuggaacuucuucgauugguuuagcgggcugaugaguugguucggaggcccccucaagaccauucugcuuaucuguuuguacguggcgcuguccaucgguuuauuuuuccuccugauuuaucuugggaggacgggacugagcaaaauguggcuagcugccacaaagaaggcaucuuga

SEQ ID NO: 11106 - RNA, 3594 nt, Artificial Sequence
  derived and/or modified CDS sequence (opt3) from RVFV(2007000324)__JF326195.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggggauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaagaauaguaaaaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugacauaggcguccauauggcucacgaugaccaaucggugagcuccaagauuguugcccauugcccaccccaggacccuugucuugugcacgggugcaucgucugugcacacggacugaucaauuaucagugccauacagcguugucagcuuucgugguaauuuuuguguucaguucuacugccaucauuugucucgcaguucuguacagagucuuaaaaugccugaagauagccccaaggaaagugcuaaacccgcucauguggaucaccgcuuuuauucgguggguguacaagaaaauggucgcccgaguugcagauaacaucaaucaggugaaccgcgagaucggcuggauggaaggugggcaacuggcucuuggcaaucccgccccuauuccaagacacgcgcccauaccuagguauagcacauacuugaugcugcuccugaucguguccuaugccucagcuuguagcgagcuuauucaggcaucuucccggaucacuaccugcaguacagagggaguaaacaccaagugucgccugagcggcacugccuugauuagagcugggucugucggagccgaagcaugccucaugcugaagggugugaaagaggaccagacgaaguucuuaaaaaucaagacaguuuccucagaacugaguugcagggagggccagagcuacuggaccgggucguuuuccccaaaaugucuaucuagccgucggugccaucucgugggagaaugucacgucaaucgaugccugucauggagagauaacgagacuuccgcggaguucuccuuugugggcgaaucuaccacaaugagggagaauaaguguuucgaacaaugcgguggguggggcuguggaugcuuuaacguuaaucccagcugucuuuucgugcacaccuauuugcaguccguacgcaaggaggcccugcgggucuuuaacugcauagacugggugcauaaacucacucuggaaaucacagauuucgacggcucagugagcacgauugauuuaggggcuaguucuuccagauuuaccaauuggggaagcgucucgcugucacuugacgccgagggcaucucugguaguaacuccuucagcuucauugagucuccggggaagggauacgcaaucguugaugaaccuuuuagcgagauaccaaggcagggcuucuugggugaaauucgcuguaauuccgagucaagugugcucagcgcucacgaaucuugccugcgagcccccaaccuaguauccuauaaaccuaugaucgaccagcuggagugcacuacaaaucucauugaucccuuuguggucuucgagcggggcucacugccacaaacccguaacgacaagacauuugcagccaguaaagggaacagaggagugcaggcuuucagcaagggcuccguucaggcggaucuuacuuugauguuugacaauuucgaaguggacuuugucggggccgcagugucuugugaugcugccuuccugaacuuaaccggaugcuacucguguaaugccggcgcuaggguuugccucagcaucacgucaaccgguacagggacucuguccgcacauaacaaggacggaagucuucacauagugcugccuucugagaauggcaccaaagaucaaugucagaucuugcauuuuacaguccccgaaguagaggaggaguucauguacagcugcgacggugaugagcgcccacuccuggugaagggcacucuaauugccaucgacccguuugaugaccggagagaagcgggaggagaguccaccguugugaacccuaaaucaggcucuuggaauuucuucgauugguuuagcgggcugaugaguugguucggaggcccccucaagacgauucugcuuaucuguuuguaugucgcucuguccauagguuuauuuuuccuccugauuuaccuugggaggacaggacugagcaaaauguggcuagccgcaaccaagaaggccucuuga

SEQ ID NO: 11107 - RNA, 3594 nt, Artificial Sequence
  derived and/or modified CDS sequence (opt3) from RVFV(KEN/Gar-Msq/131B-04/06)__HM586972.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuucgggaagaggagaugccugaagaguuauccugcucugugucggggauucgcgaagucaagaccucaagccaggagcuguaucgagcacuaaaagccaucauugcggcugacggucucaauaacaucacaugucacggcaagaauccagaggauaaaauaagucugaucaaggggccgccccauaaaaagcgugugggaauuguuagaugcgaaaggcggcgcgacgccaagcaaaucggcagagagacuauggcagguauugccaugaccgugcuuccugcucuggcagucuucgccuuggcuccagugguauuugccgaagauccccaccucaggaaccggccugggaaaggacauaauuacaucgacggcaugacacaggaggaugcgaccuguaagccaguuacuuaugcaggcgccugcuccucuuucgacgugcugcuggaaaaagggaaguuuccccucuuccagagcuacgcucaccaucgcacauuacuggaggccguccacgauaccauaauugcaaaagcugacccuccauccugugaucuucagucagcccacggaaacccgugcaugaaggagaaguuggugaugaaaacgcauugucccaaugacuaucaaagugcgcacuaccugaacaaugaugguaagauggccagcgugaaaugcccuccaaaguaugaacuaacugaggacuguaacuuuugccgacagaugaccggcgcaucucucaaaaagggguccuacccccugcaggaccuuuucugccagucaagcgaagaugacggaaguaaacugaagacaaagaugaaaggcgucugugagguuggugugcaggcuuugaagaaaugcgaugggcaacucucuacugcccaugaaguagugccuuuugcugucuucaagaauaguaaaaagguguaccuggacaaguuagaucugaaaaccgaggagaaccuccuuccagacagcuuuguuuguuucgaacacaagggacaguauaaaggcacaauggauucgggccagaccaagagagagcugaaaucuuuugacaucucccaaugccccaagauugggggacacgguucaaagaaauguacgggcgaugccgcauucugcagugccuacgaauguacugcucaguaugcgaaugcauacugcagccaugccaacggguccggaaucgugcagauccaagucucuggcguguggaagaaaccguuguguguagguuaugagaggguuguggucaagcgggaacuaagcgcuaaaccuauucagcguguggagcccugcacaaccuguauaacuaagugcgagccacacgggcuggucgugcgcucaacaggcuucaagaucaguuccgccguugcaugcgccagcggaguguguguaaccggcucucagucaccuaguacggaaauuacccucaaauaccccgggaucagccaguccucuggaggugacauaggcguccauauggcucacgaugaccaaucggugagcuccaagauuguugcccauugcccaccccaggacccuugucuggugcacgggugcaucgucugugcacacggacuuaucaauuaucagugccauacagcgcugucagcuuuugugguaauuuucguguuuaguucuacugccaucauuuguuuggcaguucucuacagaguccugaaaugcuuaaagauagccccaaggaaagugcugaacccgcuaauguggaucaccgcuuucauucgguggguguacaagaaaauggucgcccgaguugcagauaacaucaaucaggugaaccgcgagaucggcuggauggaaggugggcaacucgcucugggcaaucccgccccuauuccaagacacgcgcccauaccuagguauagcacauaccuuauguugcugcucaucguguccuaugccucagcuuguagcgagcugauucaggcaucuucccggaucacuaccugcaguacagagggaguaaacaccaagugucgccuuagcggcacugcccugauuagagcugggucugucggagccgaagcaugcuugaugcucaagggugugaaagaggaccagacgaaguuucugaaaaucaagacaguuuccucagaauuaaguugcagggagggccagagcuacuggaccgggucguucuccccaaaaugucugucuagccgucggugccaucuagugggagaaugucacgucaaucgaugccucucauggagagauaacgagacuuccgcggaguuuuccuucgugggcgaaucuaccacaaugagggagaauaaguguuuugaacaaugcgguggguggggcuguggaugcuucaacguuaaucccagcugucuguuugugcacaccuaucuucaguccguacgcaaggaggccuugcgggucuucaacugcauagacugggugcauaaacugacucucgaaaucacagauuuugacggcucagugagcacgauugaucugggggcuaguucuuccagauucaccaauuggggaagcgucucguuaucacuggacgccgagggcaucucugguaguaacuccuucagcuuuauugagucuccggggaagggauacgcaaucguugaugaaccuuucagcgagauaccaaggcagggcuuucuuggugaaauucgcuguaauuccgagucaaguguguugagcgcucacgaaucuugccuccgagcccccaaccugguauccuauaaaccuaugaucgaccagcuagagugcacuacaaaucugauugaucccuucguggucuuugagcggggcucacucccacaaacccguaacgacaagacauucgcagccaguaaagggaacagaggagugcaggcuuuuagcaagggcuccguucaggcggaucugacucuuauguucgacaauuuugaaguggacuucgucggggccgcagugucuugugaugcugccuuuuugaaccugaccggaugcuacucguguaaugccggcgcuaggguuugcuuaagcaucacgucaaccgguacagggacucucuccgcacauaacaaggacggaagucugcacauagugcuuccuucugagaauggcaccaaagaucaaugucagauccugcauuucacaguccccgaaguagaggaggaauuuauguacagcugcgacggugaugagcgcccauugcucgugaagggcacucugauugccaucgacccguucgaugaccggagagaagcgggaggagaguccaccguugugaacccuaaaucaggcucuuggaauuucuuugauugguucagcgggcuaaugaguugguuuggaggcccccugaagacgauucuccugaucugucuuuaugucgcuuuguccauaggucuguucuuuuuacucauuuaccuggggaggacaggacuuagcaaaauguggcuggccgcaaccaagaaggccucuuga

SEQ ID NO: 11108 - RNA, 3594 nt, Artificial Sequence
  derived and/or modified CDS sequence (opt3) from RVFV(2007004194)__EU574031.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggguauucgcgaagucaagaccucaagccaggagcuauaucgagcacucaaagccaucauugcggcugacggacugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaagcaacgaugguaagauggccucugugaaaugcccuccaaaguaugaacucacugaggacuguaauuucugccgacagaugaccggcgcaucccugaaaaaggggucauacccccuucaggaccuguuuugccagagcagugaagaugacggaucuaaauugaagacaaagaugaaaggcgucugugagguuggugugcaagcucucaagaaaugcgaugggcagcuguccacugcccaugaaguagugccuuucgcugucuuuaagaacagcaaaaagguguacuuagacaagcuggaucucaaaaccgaggagaaucuucugccagacucguucguuuguuuugaacacaagggacaguauaaaggcacaauggauucuggccagaccaagagagaguugaaauccuucgacaucucacaaugccccaagauugggggacacgguaguaagaaauguacgggcgaugccgcauuuugcagcgccuacgaauguacugcucaguaugcgaacgcauacugcucccaugccaaugggucuggaaucgugcagauccaagucagcggcguguggaagaaaccgcuauguguagguuaugagaggguuguggucaagcgggaacugucagcuaaaccuauucagcguguggagcccugcacaaccuguauaacuaagugcgagccacacgggcucgucgugcgcaguacaggcuucaagaucuccagcgccguugcaugcgccucuggaguguguguaaccggcucacagaguccuagcacggaaauuacccugaaauaccccgggaucucccagucuucgggaggugacauaggcguccauauggcucacgaugaccaaagcguguccucaaagauuguugcccauugcccaccccaggacccuugucuugugcacgggugcaucgucugugcacacggacugaucaacuaucagugccauacagcguugagugcuuucgugguaguguuuguuuucucuagcauugccaucauuugucucgcaauacuguacagagucuuaaaaugccugaagaucgccccaaggaaagugcuaaauccgcucauguggauuacugcuuuuauccgguggguguacaagaaaauggucgcccgaguugcagauaacaucaaccaggugaaucgcgagauuggcuggauggaaggugggcaacuggugcuuggcaaccccgcuccuauaccaagacacgcccccaucccuagguauuccaccuacuugaugcugcuccugauuguaucauaugcgagcgccuguucugagcuuauccaggcuuccagucggauuacaacuugcagcaccgagggagucaauacaaagugucgccugucuggcaccgcauugaucagagccggguccgugggagcugaagccugccucaugcugaaggguguuaaagaggaccagacuaaguucuuaaaaauaaagacggugucaagugaacugagcugcagggagggccagucguacuggacaggguccuuuucuccaaaaugucuaagcucacgucggugccaucucgucggagaaugucacgugaaccgaugccugaguuggagagauaaugagaccuccgcagaguucucuuuuguuggcgaaagcacuaccaugagggagaacaaguguuucgaacaaugcgguggguggggcuguggaugcuuuaaugugaaccccuccugucuuuucguacacacauauuugcagucaguccgcaaggaggcgcugcggguguuuaauugcaucgacugggugcauaaacucacccuggaaauuacugauuucgacggcagcgucaguacaaucgauuuaggggccucuuccagcagauuuacgaacuggggaucgguuucacugucucuugacgcugagggcauuagugguuccaauagcuucucuuucaucgagagcccggggaagggauacgccauaguggaugaaccuuuuuccgagauuccaaggcagggcuucuugggugaaauccgcuguaacucagagaguagcguacucucugcacacgaauccugccugcgagcucccaaucuaauuucauauaaaccuaugaucgaccagcuggagugcaccacuaaccucauagaucccuuuguggucuucgagcggggcagucugccacaaacacguaaugacaagaccuuugccgcaagcaaagggaacagaggagugcaggccuucuccaagggcucuguucaggcugaucuuacauugauguuugacaacuucgaaguggacuuugucggggcggccgugucgugugaugcagcuuuccugaauuuaacuggaugcuacagcuguaacgccggcgccaggguuugccucucaaucaccuccacggguaccgggacacugagugcucauaauaaggacggaucucuucacauugugcugccuagcgagaacggcacuaaagaucaaugucagaucuugcauuuuaccguccccgaaguagaggaggaguucauguacuccugcgacggugaugagcgcccacuccuggugaagggcacacuaauugcaaucgacccguuugaugaccggagagaagccgggggagagucaacuguugugaauccuaaaucuggcagcuggaacuucuucgauugguuuagugggcugauguccugguucggaggcccccucaagaccauacugcuuauuuguuuguaugucgcgcugagcaucgguuuauuuuuccuccugaucuaccuugggaggacgggacugucuaaaauguggcuagcugccacaaagaaggcaucauga

SEQ ID NO: 11109 - RNA, 3594 nt, Artificial Sequence
  derived and/or modified CDS sequence (opt3) from RVFV(73HB1230)__DQ380221.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaguuggcagagagacuauggcagguauugccaugaccgugcugccugcuuuggcagucuuugcccucgcuccagugguauucgccgaagacccccaccugaggaaucggccugggaaaggacauaacuacaucgauggcaugacacaggaggacgcgaccuguaagccaguuacuuaugcaggcgccugcuccucuuuugaugugcugcucgaaaaagggaaguuccccuuauuucagagcuacgcucaccaucgcacacugcuugaggccguccacgacaccauaauugcaaaagcugauccuccauccugugacuugcagucagcccacggaaauccgugcaugaaggagaagcuggugaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgucugugagguuggugugcaagcucucaagaaaugcgacgggcagcugucuacugcccaugaaguagugccuuucgcugucuuuaagaacuccaaaaagguguacuuagauaagcuggaccucaaaaccgaggagaaucuucugccagauagcuucguuuguuuugaacacaagggacaguauaaaggcacaauggacucgggccagaccaagaaagaguugaagucuuucgauaucucccaaugccccaagauugggggacacgguaguaaaaaguguacgggcgacgccgcauuuugcucagccuacgaauguacugcucaguaugcgaacgcauacugcagccaugccaauggguccggaaucgugcagauccaagucucuggcguguggaaaaagccgcuauguguagguuaugagagaguuguggucaaaagggaacugagcgcuaagccuauucagcggguggagcccugcacaaccuguauaacuaagugcgagccacacgggcucgucgugcguucaacaggcuucaaaaucaguuccgccguugcaugcgccagcggaguguguguaaccggcucucagucaccuaguacggaaauuacccugaaguaccccgggaucagccaguccucuggaggugauauaggcguccauauggcucacgacgaccaaucggugagcuccaaaauuguugcccauugcccaccccaggauccuugucuugugcacgggugcaucgucugugcacacggacugaucaacuaucagugccauacagcguugucagcuuucgugguaguguuuguuuucaguucuauugccaucauuugucucgcaauacuguaccgcgucuuaaagugccugaaaaucgccccaagaaaggugcuaaauccgcucauguggauuacugcuuuuaucagguggguguacaaaaagauggucgcccggguugcagacaacaucaaccaggugaaucgagagauuggcuggauggaaggugggcaacuggugcuuggcaaccccgcuccuauaccacgccacgcccccaucccuagauauagcaccuacuugaugcugcuccugauuguauccuaugcgucagccuguagcgagcuuauccaggcuucuuccaggauuacaacuugcaguaccgagggagucaauacaaagugucggcugagcggcaccgcauugauccgcgccgggucugugggagcugaagccugccucaugcugaaagguguuaaggaggaucagacuaaauucuuaaagauaaaaacgguguccucagaacugaguugcagagagggccagagcuacuggacagggucguuuuccccaaagugucuaucuagcaggcguugccaucucgucggagaaugucacgugaaccggugccugucauggcgagacaaugagaccagugcagaguucuccuuuguuggcgaaucuacuaucaugagagagaacaaguguuucgaacaaugcgguggguggggcuguggaugcuuuaaugugaaccccagcugucuuuucguacacaccuauuugcaguccgucaggaaagaggcgcugcgcguguuuaauugcauugauugggugcauaagcucacacuggaaaucaccgacuucgauggcucagucagcacuauugacuuaggggccaguucuucccgguuuacaaacuggggaagcguuucgcugucacuugaugcugagggcaucucugguaguaauuccuucagcuucauagagucuccggggaaaggauacgccauuguggacgaaccuuuuagcgagaucccaagacagggcuucuugggugaaauuagguguaacuccgagucaaguguacucagcgcacacgaaucuugccugcgcgcucccaaucuaaucuccuauaagccuaugauagaucagcuggagugcacgaccaaccucaucgaccccuuuguggucuucgagcgaggcucacugccacaaacucggaaugauaaaacauuugccgcaaguaaggggaaccguggagugcaggccuucagcaagggcuccguucaggcugaccuuaccuugauguuugacaacuucgaaguggauuuugucggggcggccgugucuugugacgcagcuuuccugaauuuaacaggaugcuacucguguaacgccggcgccagaguuugccucagcauuacuucaaccgguacggggacccuguccgcucauaauaaagauggaagucuucacaucgugcugccuucugagaacggcacaaaggaccaaugucagauuuugcauuuuacuguccccgaaguagaggaggaguucauguacagcugcgauggugacgagaggccacuccuggugaaaggcacccuaaucgcaauagauccguuugacgaucgccgggaagccgggggagaguccacaguugugaauccuaagucaggcucuuggaacuucuucgacugguuuagcgggcugaugaguugguucggaggcccccucaaaacuauucugcuuaucuguuuguaugucgcgcuguccaucgguuuauuuuuccuccugauuuaccuugggagaaccggacugagcaagauguggcuagcugccacgaagaaagcaucuuga

SEQ ID NO: 11110 - RNA, 3594 nt, Artificial Sequence
  derived and/or modified CDS sequence (opt3) from RVFV(73HB1449)__DQ380211.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauggacucgggccagaccaagagagaguugaaaucuuucgauauuucccaaugccccaagaucgggggacacgguucaaagaaauguacgggcgacgccgcauuuugcagugccuacgaauguacugcucaguaugcgaacgcauacugcagccaugccaauggguccggaaucguucagauucaagugucuggcgucuggaagaaaccgcuauguguggguuaugagaggguaguugugaagcgggaacugagcgcuaaaccuauacagcgugucgagcccugcacaaccuguaucacuaagugcgagccacacgggcucgugguccgcucaacaggcuucaagauuaguuccgccguggcaugcgccagcggaguuugugugaccggcucucagaacccuucaacggaaaucacccugaaauaccccgggauaagucagagcuccggaggugauauuggcguacauauggcucacgacgaccaaucugucucgagcaagaucguggcccauugcccaccccaggauccuugucuuguucacgggugcaucgugugugcacacggacugauuaauuaucagugccauacagcguuguccgcuuucgucgugguauuuguguucucaaguaucgccauuauaugucucgcaauccuguacagaguuuuaaaaugccugaagauugccccaaggaaaguccuaaacccgcucauguggaucacugcuuuuauccgguggguguacaagaaaaugguggcccgagucgcagacaacauuaaucagguuaaccgcgagauaggcuggauggaaggugggcaacuggugcuuggcaaucccgcuccuaucccaagacacgcccccauuccuagguauucuaccuacuugaugcugcuccugaucgugagcuaugcguccgccuguucagagcuuauucaggcuagcucucggaucacaacuugcuccaccgagggaguaaacacaaagugucgccugaguggcaccgcauugauaagagccgggagcgucggagcugaagccugccucaugcugaagggugugaaagaugaccagacuaaguucuuaaaaaucaagacgguuucuuccgagcugucaugcagggaaggccagaguuacuggacagggagcuuuucgccaaaaugucuauccucucgucggugccaucucgugggagagugucacgucaaucgaugccugagcuggagagauaacgaaaccucagcagaguucaguuuugugggcgaguccacuaccaugagggaaaauaaguguuucgagcaaugcgguggguggggcuguggaugcuuuaacguuaaucccucuugucuuuucgugcacacauauuugcagagcguacgcaaggaagcgcugcgggucuuuaacugcauugacugggugcauaaacucacccuggagaucacugauuucgacggcuccgugucaacaauugauuuaggggccagcaguucuagauuuacgaauuggggauccgucagccugucgcuugacgcugaaggcaucucagguucuaacaguuucuccuucauagagagcccggggaagggauacgccauuguugaugagccuuuuucugaaaucccaaggcagggcuucuugggugagauucgcuguaauagcgaauccucagugcucagugcacacgagagcugccugcgagcucccaaccuaaucucuuauaaaccuaugauagaccagcuggaaugcaccacuaaucucaucgaucccuuuguaguguucgagcggggcucccugccacaaacacguaacgagaagaccuuugccgcaucaaaagggaacagaggaguccaggccuucaguaagggcagcgugcaggcugaccuuacauugauguuugacaauuucgaaguugauuuugugggggcggccgucuccugugacgcagcuuuccugaacuuaacuggaugcuacucuuguaaugccggcgccagggugugccucucgauuaccagcacggguaccgggacacugucagcucauaacaaggauggaucccuucacaucguucugccuagugagaauggcacuaaagaccaaugucagauuuugcauuuuaccgugcccgaagucgaggaggaguucauguacucuugcgauggugacgagcgcccacuccugguaaagggcacacuaaucgcaauagauccguuugacgaucggagagaagccgggggagagagcacugugguuaacccuaaauccggcucauggaauuucuucgacugguuuucugggcugaugagcugguucggaggcccccucaagaccauucugcuuaucuguuuguauguggcgcugaguaucgguuuauuuuuccuccugauuuaccuugggaggacgggacuguccaaaauguggcuagcugccacaaagaaggcaagcuga

SEQ ID NO: 11111 - RNA, 3594 nt, Artificial Sequence
  derived and/or modified CDS sequence (opt3) from RVFV(ZH-548M12)__M25276.1__GP
auguacgugcugcucaccauccuuacaagcguccugguuugcgaggccauuauaagaguguccuugucuucaacuagggaagagacguguuucggcgacaguaccaaccccgaaaugaucgagggggcuugggauagcuuacgggaagaggagaugccugaggaacuguccugcucuauuucgggaauccgcgaaguaaagacaucaagccaggagcuauaucgagcacucaaagccauuaucgcggcugacggucugaauaacauaacuugucacggcaaggauccagaggacaaaaucagucuuauuaaggggccgccccauaaaaagcgugugggaaucgucagaugcgaaaggcggcgcgaugccaagcaaauuggcagaaaaaccauggcagguaucgccaugacagugcugccugcuuuggcaguuuuugcccucgcuccaguggucuucgccgaggacccccaccugaggaaucggccugggaagggacauaacuacauagauggcaugacccaggaagacgcgacuuguaaaccagugacauaugcaggcgccugcuccucuuuugauguacugcucgagaaggggaaauuccccuuauuucagagcuacgcucaccaucgcacccugcuugaagccguucacgacacgauuaucgcaaaggcugauccuccauccugugacuugcugucagcccacggaaauccgugcaugaaggagaagcuagugaugaaaacucauugucccaacgauuaucagagugcgcaccaucucaauaacgacgguaaaauggccagcgucaagugcccuccaaaauacgagcugaccgaagacuguaauuucugccgacaaaugacaggcgcaucucuuaagaaaggguccuauccccugcaggauuuguuuugccagucaagcgaggacgauggaaguaagcucaagacuaaaaugaagggcgugugugaaguggguguccaggcucugaaaaagugcgacgggcaauuaucuaccgcccacgagguugugccuuucgcuguauuuaaaaacuccaagaagguguaccuggauaaacucgaccuuaagacagaagagaaucuguugccagauagcuucgucuguuuugagcacaaaggacaguacaagggcaccauggacucgggccagacgaaaagagaacuaaagucuuucgauauuucccagugccccaagaucgggggacaugguaguaaaaaguguacuggcgacgccgcauuuugcagugccuaugaguguacagcucaauacgcgaacgcauauugcagccacgccaauggguccggaaucgugcagauucagguuucuggcguguggaaaaagccgcugugugucgguuacgaaagggugguaguuaaacgggagcucagcgcuaagccuauacaacguguggaacccugcaccacuuguaucacaaagugcgagccacaugggcuggucgugcgcucaaccggcuucaaaauuaguuccgccgucgcaugcgccagcggaguguguguuacgggcucucagucaccuaguaccgagaucacacuuaaguaucccgggauaagccaguccucuggaggugauauuggcgugcacauggcucaugacgaccagucgguaagcuccaaaaucgucgcccacugcccaccccaagauccuugucuggugcacgacugcaucguuugugcacauggguugauuaacuaccagugccacacugcgcucucagcuuucguggucguguuuguauucaguucuaucgccauuauaugucuggcaaucuuauauagagugcugaagugccuaaaaauugccccaaggaagguucucaauccgcugauguggaucaccgcuuuuauccgguggauuuacaaaaagauggucgcccgaguggcagauaacauaaaccaggugaaucgcgaaaucggauggauggagggcggucagcuugucuuggggaaccccgcuccuauuccaagacaugcccccaucccuagguacagcacauaucugaugcuccugcuuauuguuuccuacgcgucagccuguagcgaacugauccaggcuucuucccggauaacuaccugcaguacagagggcgugaauaccaagugucgcuugagcggaacugcacucaucagagccggcucugugggggcugaggccugccugauguuaaaaggaguaaaggaagaccaaacgaaauuccugaagcuaaaaacagucuccucagagcucaguugcagggaaggucagagcuauuggaccggcucguuuuccccaaagugucugucuagccgucggugccaccuugugggggagugucacguuaaccgaugcuugucauggagagauaaugaaacuucagcagaguucuccuuugugggagagucuaccacaaugagggaaaacaaguguuucgagcagugcggcgguuggggguguggcugcuuuaaugucaaccccagcugucuguucgugcauaccuaccuccaauccguucgcaaagaagcgcugcggguguuuaauugcauugacuggguacacaaguuaacucuggagaucacagauuucgacggaucagucagcacgauugaucuuggcgccaguucuuccagauuuaccaacugggggagcgugucguugucacucgacgcugaaggaaucucuggcaguaauuccuucagcuucauagagucuccggguaaaggguaugccauuguggaugagccuuuuagcgaaaucccaaggcagggauuccugggcgagauucgcuguaacuccgaaucaaguguccuaagcgcacaugagucuugccugcgagcucccaaucucaucuccuacaagccuaugauagaccagcuggaaugcacuacaaaccuuaucgaucccuuuguuguguucgagcgggguucauugccacagacccguaaugacaaaacauuugccgcaaguaagggcaacagagggguacaagccuucagcaagggauccgugcaggcugaccugacuuuaauguuugauaacuucgaggucgacuuugugggcgcggccguuucuugugaugcagcuuuccucaaucugaccgggugcuauucguguaacgccggagccagggugugccuuagcauuacgucaaccggcacagguucccugagugcucacaauaaagacgggucuuugcauaucguccucccuagcgaaaacggaacuaaggaucagugucaaauucugcacuuuaccgugcccgagguugaagaggaguucauguacuccugcgacggcgaugaacgcccacuacuggugaaagguacacucaucgcaauagacccguuugaugaccggagagaggccggcggggaaucaacugucguaaauccuaagucuggaagcuggaacuucuucgauugguuuaguggccugauguccugguucgggggaccccuuaaaaccauuuugcugaucuguuuauacguggcgcucagcaucggccuguuuuuccuucugauuuaucuaggugggacgggacucucuaagauguggcuggcugccacaaagaaagcaucauga

SEQ ID NO: 11112 - RNA, 3594 nt, Artificial Sequence
  derived and/or modified CDS sequence (opt3) from RVFV(ZINGA J83 R1)__KU978776.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacugaugaccggcgcaucucuuaaaaagggguccuacccccugcaggauuuguuuugccagucaagcgaagacgauggaaguaaacucaagacaaagaugaaaggcgugugugaggucgguguucaggcucugaagaaaugcgacgggcaauuaucuacugcccaugaagugguaccuuucgcuguguuuaagaacuccaaaaaggucuaccuggauaagcucgaccuuaaaaccgaggagaaucuguugccagauagcuucguguguuuugaacacaagggacaguauaaaggcacaauggacucgggccagaccaagagagagcuaaaaucuuucgauauuucccagugccccaagaucgggggacacgguucaaagaaauguacgggcgacgccgcauuuugcagugccuacgaauguacugcucaauaugcgaacgcauacugcagccaugccaauggguccggaaucguucagauucaggugucuggcgucuggaagaaaccgcuguguguggguuaugagaggguaguugugaagcgggaacucagcgcuaaaccuauacaacgugucgagcccugcacaaccuguaucacuaagugcgagccacacgggcuggugguccgcucaacaggcuucaagauuaguuccgccguggcaugcgccagcggaguuugugugaccggcucucagucaccuaguacggaaaucacccuuaaauaccccgggauaagccaguccucuggaggugauauuggcguacauauggcucacgacgaccagucggucagcuccaagaucguggcccauugcccaccccaagauccuugucugguucacgggugcaucgugugugcacacggauugauuaacuaucagugccauacagcgcucucagcuuucgucgugguauuuguguucaguucuaucgccauuauaugucuggcaaucuuauacagaguucugaaaugccuaaagauugccccaaggaaaguccucaauccgcugauguggaucacugcuuuuauccgguggguguaccgaaagaugguggcccgcgucgcagacaacauuaaccagguuaauagagagauaggcuggauggaaggugggcagcuuguguugggcaaccccgcuccuaucccaaggcacgugcccauuccucgguauagcaccuaccugaugcuccugcuuaucguauccuaugccucagcguguagcgagcugauucaagccucuucccgcaucacaacuugcaguaccgagggagucaauacaaaauguagauugagcggcaccgcucucauaagggcagggucugugggagccgaggcuugccugauguuaaaggguguuaaggaggaucagacuaaauuccugaagaucaaaacgguguccucagaacuaaguugccgugagggccagagcuacuggacagggucguuuuccccaaagugucucucuagccggcgaugccaucuggucggagaaugucacgugaacagaugccuuucauggagggacaaugagaccagugccgaguucuccuuuguuggcgaaucuacuaccaugcgcgagaacaaauguuucgaacagugcgguggguggggcuguggaugcuuuaaugugaaccccagcuguuuguucguacacacauaucugcaauccguccggaaggaggcacucagaguguuuaauugcauugauugggugcauaagcugaccuuagaaaucacugacuucgauggcucagucagcacaauugaccugggggcgaguucuuccagguuuacgaacuggggaagcguuucgcuuucauuggaugccgagggcaucucugguaguaauuccuucagcuucauagagucuccggggaaaggauacgcuauuguggacgaaccuuuuagcgagaucccacgccagggcuuccucggugaaauucgauguaacuccgagucaaguguacugagcgcccacgaaucuugccuacgggcacccaaucugaucuccuauaagccuaugauagaucagcucgagugcaccacuaaccugaucgaccccuuuguggucuucgagcguggcucacuuccacagacaagaaaugauaaaaccuuugcugccaguaaggggaacaggggagugcaagcauucagcaaaggcuccguucaggccgacuugacacugauguuugacaacuucgaaguggauuuugucggggcugcggugucuugugacgccgcauucuuaaaucucacuggaugcuacucguguaacgcuggcgcccgcguuugccugagcauuaccucaacggguaccgggacacuuuccgcccauaauaaggauggaagucugcacaucguguugccuucugagaacggcacuaaggaccagugucaaauucuccauuuuaccguccccgaaguagaggaggaguucauguacagcugcgauggugacgaacggccacugcuagugagaggcacacugaucgcuauagauccguuugacgauaggcgagaagcagggggagaguccacuguugugaauccuaaaucaggcucuuggaacuucuucgacugguuuagcgggcucaugaguugguucggaggcccccugaagaccauucuuuugaucugucuguaugucgccuuauccaucggucucuuuuuccugcuuauuuaccuggggcgcacgggacuaagcaaaauguggcucgcggcuacaaagaaagccucuuga

SEQ ID NO: 11113 - RNA, 3594 nt, Artificial Sequence
  derived and/or modified CDS sequence (opt3) from RVFV(Sudan 28-2010)__JQ820491.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggguauucgcgaagucaagaccucaagccaggagcuauaucgagcacucaaagccaucauugcggcugacggacugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaaaaauuccaagaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugacauaggcguccauauggcucacgaugaccaaucggugagcuccaagauuguugcccauugcccaccccaggacccuugucuugugcacgggugcaucgucugugcacacggacugaucaauuaucagugccauacagcguugucagcuuucgugguaguguuuguuuucaguucuauugccaucauuugucucgcaauacuguacagagucuuaaaaugccugaagaucgccccaaggaaagugcuaaacccgcucauguggauuacugcuuuuauccgguggguguacaagaaaauggucgcccgaguugcagauaacaucaaucaggugaaccgcgagauuggcuggauggaaggugggcaacuggugcuuggcaaucccgcuccuauaccaagacacgcccccaucccuagguauagcaccuacuugaugcugcuccugauuguauccuaugcgucagccuguagcgagcuuauccaggcuucuucccggauuacaacuugcaguaccgagggagucaacacaaagugucgccugagcggcaccgcauugaucagagccgggucugugggagcugaagccugccucaugcugaaggguguuaaagaggaccagacuaaguucuuaaaaauaaagacgguguccucagaacugaguugcagggagggccagagcuacuggacagggucguuuuccccaaaaugucuaucuagccgucggugccaucucgucggagaaugucacgugaaucgaugccugucauggagagauaacgagaccagugcagaguucuccuuuguuggcgaaucuacuaccaugagggagaauaaguguuucgaacaaugcgguggguggggcuguggaugcuuuaacgugaaucccagcugucuuuucguacacacauauuugcaguccguccgcaaggaggcgcugcggguguuuaacugcaucgacugggugcauaaacucacccuggaaauuacugauuucgacggcucagucagcacaaucgauuuaggggccaguucuuccagauuuacgaauuggggaagcguuucgcugucacuugacgcugagggcauuucugguaguaacuccuucagcuucaucgagucuccggggaagggauacgccauaguggaugaaccuuuuagcgagauuccaaggcagggcuucuugggugaaauccgcuguaauuccgagucaaguguacucagcgcacacgaaucuugccugcgagcucccaaccuaauuuccuauaaaccuaugaucgaccagcuggagugcaccacuaaucucauagaucccuuuguggucuucgagcggggcucacugccacaaacacguaacgacaagaccuuugccgcaaguaaagggaacagaggagugcaggccuucagcaagggcuccguucaggcugaucuuacauugauguuugacaauuucgaaguggacuuugucggggcggccgugucuugugaugcagcuuuccugaacuuaacuggaugcuacucguguaaugccggcgccaggguuugccucagcaucaccucaacggguaccgggacacuguccgcucauaacaaggacggaagucuucacauugugcugccuucugagaauggcacuaaagaucaaugucagaucuugcauuuuaccguccccgaaguagaggaggaguucauguacagcugcgacggugaugagcgcccacuccuggugaagggcacacuaauugcaaucgacccguuugaugaccggagagaagccgggggagaguccacuguugugaacccuaaaucaggcucuuggaauuucuucgauugguuuagcgggcugaugaguugguucggaggcccccucaagaccauacugcuuauuuguuuguaugucgugcuguccaucgguuuauuuuuccuccugaucuaccuugggaggacgggacugagcaaaauguggcuagcggcuacaaagaaggccucuuga

SEQ ID NO: 11114 - RNA, 3594 nt, Artificial Sequence
  derived and/or modified CDS sequence (opt3) from RVFV(2007001292)__EU574046.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggggauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaagaauaguaaaaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugacauaggcguccauauggcucacgaugaccaaucggugagcuccaagauuguugcccauugcccaccccaggacccuugucuugugcacgggugcaucgucugugcacacggacugaucaauuaucagugccauacagcguugucagcuuucgugguaauuuuuguguucaguucuacugccaucauuugucucgcaguucuguacagagucuuaaaaugccugaagauagccccaaggaaagugcuaaacccgcucauguggaucaccgcuuuuauucgguggguguacaagaaaauggucgcccgaguugcagauaacaucaaucaggugaaccgcgagaucggcuggauggaaggugggcaacuggcucuuggcaaucccgccccuauuccaagacacgcgcccauaccuagguauagcacauacuugaugcugcuccugaucguguccuaugccucagcuuguagcgagcuuauucaggcaucuucccggaucacuaccugcaguacagagggaguaaacaccaagugucgccugagcggcacugccuugauuagagcugggucugucggagccgaagcaugccucaugcugaagggugugaaagaggaccagacgaaguucuuaaaaaucaagacaguuuccucagaacugaguugcagggagggccagagcuacuggaccgggucguuuuccccaaaaugucuaucuagccgucggugccaucucgugggagaaugucacgucaaucgaugccugucauggagagauaacgagacuuccgcggaguucuccuuugugggcgaaucuaccacaaugagggagaauaaguguuucgaacaaugcgguggguggggcuguggaugcuuuaacguuaaucccagcugucuuuucgugcacaccuauuugcaguccguacgcaaggaggcccugcgggucuuuaacugcauagacugggugcauaaacucacucuggaaaucacagauuucgacggcucagugagcacgauugauuuaggggcuaguucuuccagauuuaccaauuggggaagcgucucgcugucacuugacgccgagggcaucucugguaguaacuccuucagcuucauugagucuccggggaagggauacgcaaucguugaugaaccuuuuagcgagauaccaaggcagggcuucuugggugaaauucgcuguaauuccgagucaagugugcucagcgcucacgaaucuugccugcgagcccccaaccuaguauccuauaaaccuaugaucgaccagcuggagugcacuacaaaucucauugaucccuuuguggucuucgagcggggcucacugccacaaacccguaacgacaagacauuugcagccaguaaagggaacagaggagugcaggcuuucagcaagggcuccguucaggcggaucuuacuuugauguuugacaauuucgaaguggacuuugucggggccgcagugucuugugaugcugccuuccugaacuuaaccggaugcuacucguguaaugccggcgcuaggguuugccucagcaucacgucaaccgguacagggacucuguccgcacauaacaaggacggaagucuucacauagugcugccuucugagaauggcaccaaagaucaaugucagaucuugcauuuuacaguccccgaaguagaggaggaguucauguacagcugcgacggugaugagcgcccacuccuggugaagggcacucuaauugccaucgacccguuugaugaccggagagaagcgggaggagaguccaccguugugaacccuaaaucaggcucuuggaaucuguucgauugguucagcgggcucaugaguugguuuggaggcccccugaagacgauucuuuugaucugucuguaugucgcuuuauccauaggucucuucuuucugcuuauuuaccuggggaggacaggacuaagcaaaauguggcucgccgcaaccaagaaggccucuuga

SEQ ID NO: 11115 - RNA, 3594 nt, Artificial Sequence
  derived and/or modified CDS sequence (opt3) from RVFV(Sudan 85-2010)__JQ820488.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaggaacuguccugcucugugucggguauucgcgaagucaagaccucaagccaggagcuauaucgagcacucaaagccaucauugcggcugacggacugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaaaaauuccaagaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugacauaggcguccauauggcucacgaugaccaaucggugagcuccaagauuguugcccauugcccaccccaggacccuugucuugugcacgggugcaucgucugugcacacggacugaucaauuaucagugccauacagcguugucagcuuucgugguaguguuuguuuucaguucuauugccaucauuugucucgcaauacuguacagagucuuaaaaugccugaagaucgccccaaggaaagugcuaaacccgcucauguggauuacugcuuuuauccgguggguguacaagaaaauggucgcccgaguugcagauaacaucaaucaggugaaccgcgagauuggcuggauggaaggugggcaacuggugcuuggcaaucccgcuccuauaccaagacacgcccccaucccuagguauagcaccuacuugaugcugcuccugauuguauccuaugcgucagccuguagcgagcuuauccaggcuucuucccggauuacaacuugcaguaccgagggagucaacacaaagugucgccugagcggcaccgcauugaucagagccgggucugugggagcugaagccugccucaugcugaaggguguuaaagaggaccagacuaaguucuuaaaaauaaagacgguguccucagaacugaguugcagggagggccagagcuacuggacagggucguuuuccccaaaaugucuaucuagccgucggugccaucucgucggagaaugucacgugaaucgaugccugucauggagagauaacgagaccagugcagaguucuccuuuguuggcgaaucuacuaccaugagggagaauaaguguuucgaacaaugcgguggguggggcuguggaugcuuuaacgugaaucccagcugucuuuucguacacacauauuugcaguccguccgcaaggaggcgcugcggguguuuaacugcaucgacugggugcauaaacucacccuggaaauuacugauuucgacggcucagucagcacaaucgauuuaggggccaguucuuccagauuuacgaauuggggaagcguuucgcugucacuugacgcugagggcauuucugguaguaacuccuucagcuucaucgagucuccggggaagggauacgccauaguggaugaaccuuuuagcgagauuccaaggcagggcuucuugggugaaauccgcuguaauuccgagucaaguguacucagcgcacacgaaucuugccugcgagcucccaaccuaauuuccuauaaaccuaugaucgaccagcuggagugcaccacuaaucucauagaucccuuuguggucuucgagcggggcucacugccacaaacacguaacgaaaagaccuuugccgcaaguaaagggaacagaggagugcaggccuucagcaagggcuccguucaggcugaccuuacauugauguuugauaauuucgagguggacuuugucggggcggccgugucuugugacgcagcuuuccugaacuuaacuggaugcuacucguguaaugccggcgccaggguuugccucagcaucaccucaacggguaccgggacacuguccgcucauaacaaggauggaagucuucacauugugcugccuucugaaaauggcacuaaagaccaaugucagaucuugcauuuuaccguccccgagguagaggaagaguucauguacagcugcgauggugacgaacgcccacuccuggugaagggcacacuaauugcaaucgauccguuugacgaucggagagaggccgggggagaauccacuguugugaacccuaaaucaggcucuuggaauuucuucgacugguuuagcgggcugaugaguugguucggaggcccccucaagaccauacugcuuauuuguuuguaugucgcgcuguccaucgguuuauuuuuccuccugaucuaccuugggaggacgggacugagcaaaauguggcuagcugccacaaagaaggcaucuuga

SEQ ID NO: 11116 - RNA, 3594 nt, Artificial Sequence
  derived and/or modified CDS sequence (opt3) from RVFV(2007002060)__EU574039.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggggauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaauuguuagaugcgaaaggcggaaggacgccaaacaaaucggccgcgagacuauggcagguauugccaugaccgugcugccugcuuuggcagucuuugcccucgcuccagugguauucgccgaagauccccaccugagaaacaggccugggaagggacauaauuacaucgacggcaugacacaggaggaugcgaccuguaaaccaguuacuuaugcaggcgccugcuccucuuuugacgugcugcucgaaaaggggaaauuccccuuauuucagagcuacgcucaccaucggacacugcuugaggccguccacgauaccauaauugcaaaggcugacccuccauccugugauuugcagucagcccacggaaacccgugcaugaaggagaaacuggugaugaagacgcauugucccaaugacuaucaaagugcgcacuaccuaaacaaugaugguaaaauggccagcgugaagugcccuccaaaauaugaacucacugaggacuguaacuucugccgccagaugaccggcgcaucucugaagaaaggguccuacccccuucaggaccuguuuugccagucaagcgaagaugacggaaguaaguugaagacaaaaaugaagggcgucugugagguuggugugcaagcucucaaaaagugcgaugggcagcugucuacugcccaugaaguagugccuuucgcugucuuuaaaaauuccaagaagguguacuuagacaaacuggaucucaagaccgaggagaaccuucugccagacagcuucguuuguuuugaacacaaaggacaguauaagggcacaauggauucgggccagaccaaacgagaguugaagucuuucgacaucucccaaugccccaagauugggggacacgguaguaaaaaguguacgggcgaugccgcauuuugcagugccuacgaauguacugcucaguaugcgaaugcauacugcagccaugccaacggguccggaaucgugcagauccaagucucuggcguguggaaaaagccgcuauguguagguuaugagagaguuguggucaaaagggaacugagcgcuaagccuauucagcggguggagcccugcacaaccuguauaacuaagugcgagccacacgggcucgucgugcguucaacaggcuucaaaaucaguuccgccguugcaugcgccagcggaguguguguaaccggcucucagucaccuaguacggaaauuacccugaaguaccccgggaucagccaguccucuggaggugacauaggcguccauauggcucacgaugaccaaucggugagcuccaaaauuguugcccauugcccaccccaggacccuugucuugugcacgggugcaucgucugugcacacggacugaucaauuaucagugccauacagcguugucagcuuucgugguaauuuuuguguucaguucuacugccaucauuugucucgcaguucuguaccgcgucuuaaagugccugaaaauagccccaagaaaggugcuaaacccgcucauguggaucaccgcuuuuauuagguggguguacaaaaagauggucgcccggguugcagauaacaucaaucaggugaaccgagagaucggcuggauggaaggugggcaacuggcucuuggcaaucccgccccuauuccacgccacgcgcccauaccuagauauagcacauacuugaugcugcuccugaucguguccuaugccucagcuuguagcgagcuuauucaggcaucuuccaggaucacuaccugcaguacagagggaguaaacaccaagugucggcugagcggcacugccuugauucgcgcugggucugucggagccgaagcaugccucaugcugaaaggugugaaggaggaccagacgaaauucuuaaagaucaaaacaguuuccucagaacugaguugcagagagggccagagcuacuggaccgggucguuuuccccaaagugucuaucuagcaggcguugccaucucgugggagaaugucacgucaaucggugccugucauggcgagauaacgagacuucagcggaguucuccuuugugggcgaaucuaccacaaugagagagaauaaguguuucgaacaaugcgguggguggggcuguggaugcuuuaacguuaaucccagcugucuuuucgugcacaccuauuugcaguccguaaggaaagaggcccugcgcgucuuuaacugcauagacugggugcauaagcucacucuggaaaucacagauuucgacggcucagugagcacgauugauuuaggggcuaguucuucccgguuuaccaauuggggaagcgucucgcugucacuugacgccgagggcaucucugguaguaacuccuucagcuucauugagucuccggggaaaggauacgcaaucguugaugaaccuuuuagcgagauaccaagacagggcuucuugggugaaauuagguguaauuccgagucaagugugcucagcgcucacgaaucuugccugcgcgcccccaaccuaguauccuauaagccuaugaucgaccagcuggagugcacuacaaaucucauugaucccuuuguggucuucgagcgaggcucacugccacaaacccggaacgacaaaacauuugcagccaguaaggggaaccguggagugcaggcuuucagcaagggcuccguucaggcggaucuuacuuugauguuugacaauuucgaaguggacuuugucggggccgcagugucuugugaugcugccuuccugaacuuaaccggaugcuacucguguaaugccggcgcuagaguuugccucagcaucacgucaaccgguacagggacucuguccgcacauaacaaagacggaagucuucacauagugcugccuucugagaauggcaccaaggaucaaugucagaucuugcauuuuacaguccccgaaguagaggaggaguucauguacagcugcgacggugaugagaggccacuccuggugaaaggcacucuaauugccaucgacccguuugaugaccgccgggaagcgggaggagaguccaccguugugaacccuaagucaggcucuuggaauuucuucgauugguuuagcgggcugaugaguugguucggaggcccccucaaaacgauucugcuuaucuguuuguaugucgcucuguccauagguuuauuuuuccuccugauuuaccuugggagaacaggacugagcaagauguggcuagccgcaaccaagaaagccucuuga

SEQ ID NO: 11117 - RNA, 3594 nt, Artificial Sequence
  derived and/or modified CDS sequence (opt3) from RVFV(2007002476)__EU574036.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggggauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaagaauaguaaaaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugacauaggcguccauauggcucacgaugaccaaucggugagcuccaagauuguugcccauugcccaccccaggacccuugucuugugcacgggugcaucgucugugcacacggacugaucaauuaucagugccauacagcguugucagcuuucgugguaauuuuuguguucaguucuacugccaucauuugucucgcaguucuguacagagucuuaaaaugccugaagauagccccaaggaaagugcuaaacccgcucauguggaucaccgcuuuuauuaaguggguguacaaaaagauggucgcccggguugcagauaacaucaaucaggugaaccgagagaucggcuggauggaaggugggcaacuggcucuuggcaaucccgccccuauuccacgccacgcgcccauaccuagauauagcacauacuugaugcugcuccugaucguguccuaugccucagcuuguagcgagcuuauucaggcaucuuccaggaucacuaccugcaguacagagggaguaaacaccaagugucggcugagcggcacugccuugauucgcgcugggucugucggagccgaagcaugccucaugcugaaaggugugaaggaggaccagacgaaauucuuaaagaucaaaacaguuuccucagaacugaguugcagagagggccagagcuacuggaccgggucguuuuccccaaagugucuaucuagcaggcguugccaucucgugggagaaugucacgucaaucggugccugucauggcgagauaacgagacuuccgcggaguucuccuuugugggcgaaucuaccacaaugagagagaauaaguguuucgaacaaugcgguggguggggcuguggaugcuuuaacguuaaucccagcugucuuuucgugcacaccuauuugcaguccguaaggaaagaggcccugcgcgucuuuaacugcauagacugggugcauaagcucacucuggaaaucacagauuucgacggcucagugagcacgauugauuuaggggcuaguucuucccgguuuaccaauuggggaagcgucucgcugucacuugacgccgagggcaucucugguaguaacuccuucagcuucauugagucuccggggaaaggauacgcaaucguugaugaaccuuuuagcgagauaccaagacagggcuucuugggugaaauuagguguaauuccgagucaagugugcucagcgcucacgaaucuugccugcgcgcccccaaccuaguauccuauaagccuaugaucgaccagcuggagugcacuacaaaucucauugaucccuuuguggucuucgagcgaggcucacugccacaaacccggaacgacaaaacauuugcagccaguaaggggaaccguggagugcaggcuuucagcaagggcuccguucaggcggaucuuacuuugauguuugacaauuucgaaguggacuuugucggggccgcagugucuugugaugcugccuuccugaacuuaaccggaugcuacucguguaaugccggcgcuagaguuugccucagcaucacgucaaccgguacagggacucuguccgcacauaacaaagacggaagucuucacauagugcugccuucugagaauggcaccaaggaucaaugucagaucuugcauuuuacaguccccgaaguagaggaggaguucauguacagcugcgacggugaugagaggccacuccuggugaaaggcacucuaauugccaucgacccguuugaugaccgccgggaagcgggaggagaguccaccguugugaacccuaagucaggcucuuggaauuucuucgauugguuuagcgggcugaugaguugguucggaggcccccucaaaacgauucugcuuaucuguuuguaugucgcucuguccauagguuuauuuuuccuccugauuuaccuugggagaacaggacugagcaagauguggcuagccgcaaccaagaaagccucuuga

SEQ ID NO: 11118 - RNA, 3594 nt, Artificial Sequence
  derived and/or modified CDS sequence (opt3) from RVFV(2269/74)__DQ380222.1__GP
auguacgugcugcucacaauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacagcacaaaggcacaauggacucgggccagaccaagagagaguugaaaucuuucgauauuucccaaugccccaagaucgggggacaugguucaaagaaauguacgggcgacgccgcauuuugcagugccuaugaauguacugcucaguacgcgaacgcauauugcagccacgccaauggguccggaaucguucagauucaagugucuggcgucuggaagaaaccgcuauguguggguuacgagaggguaguugugaagcgggaacugagcgcuaaaccuauacagcgugucgagcccugcacaaccuguaucacuaagugcgagccacaugggcucgugguccgcucaacaggcuucaagauuaguuccgccguggcaugcgccagcggaguuugugugaccggcucucagucaccuaguacggaaaucacccugaaauaucccgggauaagccaguccucuggaggugauauuggcguacacauggcucaugacgaccaaucggucagcuccaagaucguggcccacugcccaccccaggauccuugucuuguucacgggugcaucgugugugcacauggacugauuaacuaccagugccacacagcguugucagcuuucgucgugguauuuguguucaguucuguugccaucauuugucucgcaauacuguauaaagucuuaaagugccugaaaaucgccccaaagaaagugcuaaauccgcucauguggauuacugcuuuuaucagauggguguacaagaagauggucgccaggguugcagacaacaucaaccaggugaaucgggagauuggcuggauggaaggugggcaacuggcucuuggcaaccccgccccuauaccacgacaugcgcccaucccucgcuacagcaccuauuugaugcugcuccugauuguguccuacgccucagcuuguagcgagcuuauccaggcaucuuccagaauuacaacuugcaguaccgagggaguaaauacaaaauguaggcugagcggcaccgccuugauccgggcugggucugucggagccgaagcaugccucaugcugaagggugugaaagaggaucagacuaaguucuuaaaaauaaagacgguuuccucagaacugaguugccgcgagggccagagcuauuggacagggucguuuuccccaaagugucuaucuagcagaaggugccaccucgugggagaaugucacgucaaccguugccugucauggcgggacaaugagaccagugcggaguucuccuuugugggcgaaucuacuaccaugcgagagaacaaauguuucgaacaaugcgguggguggggcuguggaugcuuuaauguuaaccccagcugucuuuucgugcauacauacuugcaguccguaagaaaggaggcccugagggucuuuaauugcaucgauugggugcacaaacucacccuggaaauuacugacuucgauggcucagugagcacaaucgacuuaggggcuaguucuucccgcuuuacgaacuggggaagcgucucgcugucacuugaugccgagggcauuucugguaguaauuccuucagcuucaucgagucuccggggaagggauaugcaauaguugacgaaccuuuuagcgagauuccacggcagggcuucuugggugaaaucagauguaacuccgagucaagugugcucagcgcucaugaaucuugccugagggcccccaaucuaauuuccuacaaaccuaugaucgaucagcuggagugcaccacuaaccucauagaccccuuuguaguguucgagcgcggcucacugccacaaacacgaaaugauaagaccuuugcagccaguaaggggaaccggggaguccaggcuuucagcaaaggcuccgugcaggcggaccuuacauugauguuugacaacuucgaaguugauuuugugggggccgcagucucuugugacgcugccuuccugaauuuaacuggaugcuauucguguaacgccggcgcucgugugugccucagcaucaccucaacggguaccgggacacuguccgcacacaauaaggauggaagucuucauauuguucugccuucugagaacggcacuaaagaccaaugucagaucuugcacuuuaccgugcccgaagucgaggaggaguucauguacagcugcgauggugacgagagaccacuccugguaaagggcacacuaauugccaucgauccguuugacgauaggcgcgaagcugggggagaguccacugugguuaauccuaaaucaggcucuuggaacuucuucgacugguuuagcgggcugaugaguugguucggaggcccccucaagaccauacugcuuauuuguuuguacguggcgcuguccaucgguuuauuuuuccuccugaucuaucuugggcggacgggacugagcaagauguggcuagccgcaaccaaaaaggccucuuga

SEQ ID NO: 11119 - RNA, 3594 nt, Artificial Sequence
  derived and/or modified CDS sequence (opt3) from RVFV(SA-51 (Van Wyck))__DQ380195.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauggacucgggccagaccaagagagaguugaaaucuuucgauauuucccaaugccccaagaucgggggaagggguucaaagaaauguacgggcgacgccgcauuuugcagugccuacgaauguacugcucaguaugcgaacgcauacugcagccacgccaauggguccggaaucguucagauucaagugucuggcgucuggaagaaaccgcuauguguggguuaugagcggguaguugugaagcgugaacugagcgcuaaaccuauacagcgcgucgagcccugcacaaccuguaucacuaagugcgagccacaugggcucguggucagaucaacaggcuucaagauuaguuccgccguggcaugcgccagcggaguuugugugaccggcucucagucaccuaguacggaaaucacccugaaauaccccgggauaagccaguccucuggaggugauauuggcguacacauggcucaugacgaccaaucggucagcuccaagaucguggcccacugcccaccccaggauccuugucuuguucaugggugcaucgugugugcacacggacugauuaacuaucagugccacacagcguugucagcuuucgucgugguauuuguguucaguucuguugccaucauuugucucgcaauacuguacaaagucuuaaagugccugaaaaucgccccaaggaaggugcuaaauccgcucauguggauuacugcuuuuauccgguggguguacaaaaagauggucgcccgaguugcagacaacaucaaccaggugaaucgcgagauuggcuggauggaaggugggcaacuggcucuuggcaaccccgccccuauaccaagacaugcgcccaucccuagguauagcaccuacuugaugcugcuccugauuguguccuaugccucagcuuguagcgagcuuauccaggcaucuucccggauuacaacuugcaguaccgagggaguaaauacaaagugucgccugagcggcaccgccuugaucagagcugggucugucggagccgaagcaugccucaugcugaaaggugugaaggaggaucagacuaaauucuuaaagauaaaaacgguuuccucagaacugaguugcagggagggccagagcuacuggacagggucguuuuccccaaagugucuaucuagccgucggugccaccucgugggagaaugucaugucaaccgaugccugucauggagagacaaugagaccagugcggaguucuccuuugugggcgaaucuacuaccaugagggagaacaaguguuucgaacaaugcgguggguggggcuguggaugcuuuaauguuaaccccagcugucuuuucgugcacacauauuugcaguccguacgcaaagaggcccugcgggucuuuaauugcaucgauugggugcacaagcucacccuggaagugacugacuucgauggcucagucagcacaauugacuuaggggcuaguucuuccagauuuacgaacuggggaagcguuucgcugucacuugaugccgagggcaucucugguaguaauuccuucagcuucauugagucuccggggaaaggauacgcaaucguggacgaaccuuuuagcgagauaccaaggcagggcuucuugggugaaauucgcuguaacuccgagucaaguguacucagcgcucaugaaucuugccugcgagcccccaaucuaaucuccuauaagccuaugauugaucagcuggagugcaccacuaaccucaucgaccccuuuguggucuucgagcggggcucacugccacaaacacguaaugauaaaaccuuugcagccaguaaggggaacagaggagugcaggcuuucagcaagggcuccguucaggcggaccuuacauugauguuugacaacuucgaaguggauuuugucggggccgcagugucuugugacgcugccuuccugaauuuaacuggaugcuacucguguaacgccggcgcuaggguuugccucagcauaaccucaacggguaccgggacacuguccgcacacaauaaagauggaagucuucauaucgugcugccuucugagaacggcacuaaggaccaaugucagauuuugcacuuuaccguccccgaaguagaggaggaguucauguacagcugcgauggugacgagcgcccacuccuggugaaaggcacacuaaucgccauugauccguuugacgaucggagagaagcugggggagaguccacuguugugaauccuaagucaggcucuuggaacuucuucgacugguuuagcgggcugaugaguugguucggaggcccccucaaaaccauccugcuuauauguuuguaugucgcgcuguccauugguuuauuuuuccuccugaucuaccuugggaggacgggacugagcaagauguggcuagccgcaacaaagaaagccucuuga

SEQ ID NO: 11120 - RNA, 3594 nt, Artificial Sequence
  derived and/or modified CDS sequence (opt3) from RVFV(OS-8)__DQ380185.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauggacucgggccagaccaagagagaguugaaaucuuucgauauuucccaaugccccaagaucgggggacacgguucaaagaaauguacgggcgacgccgcauuuugcagugccuacgaauguacugcucaguaugcgaacgcauacugcagccaugccaauggguccggaguugugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugauauaggcguccauauggcucacgacgaccaaucggugagcuccaagauuguugcccauugcccaccccaggauccuugucuugugcacgggugcaucgucugugcacacggacugaucaacuaucagugccauacagcguugucagcuuucgugguaguguuuguuuucaguucugucgccauuaucugucucgcaauucuguacaaaguguuaaagugccugaaaauagccccaagaaaggugcuaaauccgcucauguggaucacugcuuuuauuaggugggucuacaaaaagaugguugcccggguggcagacaacaucaaccaggugaaucgagagaucggcuggauggaaggugggcaacuggcucuuggcaaccccgccccuauuccacgccacgcgcccauaccuagauauagcaccuacuugaugcugcuccugaucguauccuaugccucagcuuguagcgagcuuauucaggcaucuuccaggaucacaacuugcaguaccgagggagucaauacaaagugucggcugagcggcaccgccuugauucgcgcugggucugugggagccgaagcaugccucaugcugaaagguguuaaggaggaucagacuaaauucuuaagaaucaagacgguguccucagaacugaguugcagggagggccagagcuacuggacagggucguuuuccccaaaaugucuaucuagccgucggugccaucucgucggagaaugucacgugaaccgaugccugucauggagagacaaugagaccagugcggaguucuccuuuguuggcgaaucuacuaccaugagggagaacaaguguuucgaacaaugcgguggguggggcuguggaugcuuuaaugugaaccccagcugucuuuucguacacacauauuugcaguccguccgcaaggaggcccugcggguguuuaauugcauagauugggugcauaaacucacccuggaaaucacugacuucgauggcucagucagcacaauugacuuaggggcuaguucuuccagauuuacgaacuggggaagcguuucgcugucacuugaugccgagggcaucucugguaguaauuccuucagcuucauugagucuccggggaagggauacgcaaucguggacgaaccuuuuagcgagauaccaaggcagggcuucuugggugaaauucgcuguaacuccgagucaaguguacucagcgcucacgaaucuugccugcgagcccccaaucuaaucuccuauaaaccuaugauugaucagcuggagugcaccacuaaccucaucgaccccuuuguggucuucgagcggggcucacugccacaaacacguaaugauaagaccuuugcagccaguaaagggaacagaggagugcaggcuuucagcaagggcuccguucaggcggaccuuacauugauguuugacaacuucgaaguggauuuugucggggccgcagugucuugugacgcugccuuccugaauuuaucgggaugcuacagcuguaacgccggcgcuaggguuugccucucaauaacuuccaccgguacggggacccugagugcacauaauaaggauggaucucuucacaucgugcugccuagcgagaacggcacaaaagaccaaugucagauuuugcauuuuacuguccccgaaguagaggaggaguucauguacuccugcgauggugacgagcgcccacuccuggugaagggcacccuaaucgccauugauccguuugacgaucggagagaagcugggggagagucaacaguugugaauccuaaaucuggcagcuggaacuucuucgacugguuuagugggcugauguccugguucggaggcccccucaagacuauccugcuuauauguuuguaugucgcgcugagcauugguuuauuuuuccuccugaucuaccuugggaggaccggacugucuaaaauguggcuagccgcaacgaagaaggccucauga

SEQ ID NO: 11121 - RNA, 3594 nt, Artificial Sequence
  derived and/or modified CDS sequence (opt3) from RVFV(BIME-01)__KX609032.1__GP
auguacgugcugcucaccauccuuauuagcguccugguuugcgaggccauaaucagaguguccuugucuucaacaagggaagagacuuguuucggcgacaguacgaaccccgaaaugauugagggggcuugggauagcuuacgggaagaggagaugccugaagaacuguccugcucuaucucggggauucgcgaaguaaagaccucaagccaggagcuauaucgagcacucaaagccaucauagcggcugacggucugaauaacaucacaugucacggcaaggauccagaggacaaaauuagucuuaucaaggggccgccccauaaaaagcgugugggaauugucagaugcgaaaggcggcgcgaugccaagcaaaucggcagagagacuauggcagguauagccaugaccgugcugccugcuuuggcaguuuuugcccucgcuccaguggucuucgccgaagacccccaccugaggaaucggccugggaaaggacauaacuacauugauggcaugacacaggaggacgcgaccuguaagccagugacuuaugcaggcgccugcuccucuuuugauguacugcucgaaaaagggaaguuccccuuauuucagagcuacgcucaccaucgcacacugcuugaggccguucacgacaccaucauugcaaaagcugauccuccauccugugacuugcagucagcccacggaaauccgugcaugaaggagaagcuggugaugaaaacgcauugucccaacgauuaucaaagugcgcacuaccuaaauaacgacgguaagauggccagcgucaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugagguggguguccaagcucucaagaaaugcgacgggcagcugucuacugcccaugaaguugugccuuucgcuguauuuaagaacuccaaaaagguguacuuagauaagcuggaccucaaaaccgaggagaaucuucugccagauagcuucgucuguuuugaacacaagggacaguauaaaggcacaauggacucgggccagaccaagagagaguugaaaucuuucgauaucucccaaugccccaagaucgggggacacgguucaaagaaauguacgggcgacgccgcauuuugcagugccuacgaauguacugcucaguaugcgaacgcauacugcagccaugccaauggguccggaauugugcagauacaaguuucuggcguguggaagaaaccgcuaugugucgguuaugagagggugguaguuaagcgggaacugagcgcuaaaccuauccagcguguggagcccugcacaaccuguauuacuaagugcgagccacacgggcucgucgugcgcucaacaggcuucaagaucaguuccgccgucgcaugcgccagcggaguguguguuaccggcucucagucaccuaguacggaaauaacccugaaauaccccgggauuagccaguccucuggaggugauaucggcgugcauauggcucacgacgaccaaucgguaagcuccaagaucgucgcccauugcccaccccaggauccuugucuugugcacgggugcauuguuugugcacacggacugaucaacuaucagugccauacagcguugucagcuuucguggucguguuuguauucaguucuguggccauuauaugucucgcaauccuguacaaaguuuuaagaugccugaagauugccccgaaaaagguccuaaauccacucauguggaucacugcuuuuaucagguggguguacaaaaagaugguggcccgggucgcagacaacauuaaccagguuaaucgagagauaggcuggauggaaggugggcaacuggcucuuggcaaccccgccccuaucccacgccacgcgcccauuccuagauauagcaccuacuugaugcugcuccugaucauuuccuaugccucagcuuguagcgagcuuauccaggcaucuuccaggauaacaacuugcaguaccgagggagugaauacaaagugucggcugagcggcaccgccuugauccgcgcugggucugugggagccgaagcaugccucaugcugaaagguguaaaggaggaucagacuaaauucuuaaagauuaaaacggucuccucagaacugaguugcagagagggccagagcuacuggacagggucguuuuccccaaagugucuaucuagcaggcguugccaucucgugggagaaugucacguuaaccggugccugucauggcgagacaaugagaccagugcggaguucuccuuugugggcgaaucuacuaccaugagagagaacaaguguuucgaacaaugcgguggguggggcuguggaugcuuuaaugucaaccccagcugucuuuucgugcacacauauuugcaguccguuaggaaagaggcccugcgcguguuuaauugcaucgauuggguacauaagcucacccuggaaauuacugacuucgauggcucagucagcacaaucgacuuaggggcuaguucuucccgguuuacgaacuggggaagcgugucgcugucacuugaugccgagggcauaucugguaguaauuccuucagcuucauugagucuccggggaaaggauacgcaaucguggacgaaccuuuuagcgagauuccaagacagggcuucuugggugaaaucagguguaacuccgagucaaguguccucagcgcucacgaaucuugccugcgcgcccccaaucuaauauccuauaagccuaugaucgaucagcuggagugcaccacuaaccucauugaccccuuuguuguguucgagcgaggcucacugccacaaacacggaaugauaaaaccuuugcagccaguaaggggaaccguggaguacaggcuuucagcaagggcuccgugcaggcggaccuuacauugauguuugacaacuucgaagucgauuuugugggggccgcaguuucuugugacgcugccuuccugaauuuaacuggaugcuacucguguaacgccggcgcuagagugugccucagcaucaccucaacggguaccgggacacuguccgcacauaauaaagauggaagucuucacauuguccugccuucugagaacggcacuaaggaccaaugucagaucuugcauuuuaccgugcccgaaguugaggaggaguucauguacagcugcgauggugacgagaggccacuccuggugaaaggcacacuaauagccauugauccguuugacgaucgccgggaagcgggaggagaguccacugucguaaauccuaagucaggcucuuggaacuucuucgacugguuuagcgggcugaugaguugguucggaggcccccucaaaaccauccugcuuaucuguuuguauguggcucuguccauugguuuauuuuuccuccugaucuaccuugggagaacgggacugagcaagauguggcuagccgcaacaaagaaagccucuuga

SEQ ID NO: 11122 - RNA, 3594 nt, Artificial Sequence
  derived and/or modified CDS sequence (opt3) from RVFV(Kenya 83 (21445))__DQ380198.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaagaauccagagaacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggauuguaauuucugccgacagaugaccggcgcaucucugaaaaagggguccuacccccuucaggaccuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauggacucgggccagaccaagagagaguugaaaucuuucgauauuucccaaugccccaagaucgggggacacgguucaaagaaauguacgggcgacgccgcauuuugcagugccuacgaauguacugcucaguaugcgaacgcauacugcagccaugccaauggguccggaaucguucagauucaagugucuggcgucuggaagaaaccgcuauguguggguuaugagaggguaguugugaagcgggaacugagcgcuaaaccuauacagcgugucgagcccugcacaaccuguaucacuaagugcgagccacacgggcucgugguccgcucaacaggcuucaagauuaguuccgccguggcaugcgccagcggaguuugugugaccggcucucagucaccuaguacggaaaucacccugaaauaccccgggauaagccaguccucuggaggugauauuggcguacauauggcucacgacgaucaaucggucagcuccaagaucguggcccauugcccaccccaggacccuugucuuguucacgggugcaucgugugugcacacggacugauuaacuaucagugccauacagcguugucagcuuucgucgugguauuuguguucaguucuaucgccauuauaugucucgcaauccuguacagaguuuuaaaaugccugaagauugccccaaggaaaguccuaaacccgcucauguggaucacugcuuuuauccgguggguguacaagaaaaugguggcccgagucgcagacaauauuaaccagguuaaucgcgagauaggcuggauggaaggugggcaacuggcucuuggcaaccccgccccuaucccaagacacgcgcccauuccuagguauagcaccuacuugaugcugcuccugaucguguccuaugccucagcuuguagcgagcuuauucaggcaucuucccggaucacaacuugcaguaccgagggagugaauacaaagugucgccugagcggcaccgccuugauaagagcugggucuguaggagccgaagcaugccucaugcugaagggugucaaagaggaucagacuaaguucuuaaaaaucaagacgguguccucagaacugaguugcagggagggccagagcuacuggacagggucguuuuccccaaaaugucuaucuagccgucggugccaucucguuggagaaugucacgugaaccgaugccugucauggagagacaaugagaccagugcggaguucuccuuugucggcgaaucuacuaccaugagggagaacaaguguuucgaacaaugcgguggguggggcuguggaugcuuuaaugugaaccccagcugucuuuucguucacacauauuugcaguccgugcgcaaggaggcccugcggguauuuaauugcauugauuggguccauaaacucacccuggaaaucacugacuucgauggcucagugagcacaauugacuuaggggcuaguucuuccagauuuacgaacuggggaagcgugucgcugucacuugaugccgagggcaucucugguaguaauuccuucagcuucauagagucuccggggaagggauacgcaauugucgacgaaccuuuuagcgagaucccaaggcagggcuucuugggugaaauucgcuguaacuccgagucaaguguucucagcgcucacgaaucuugccugcgagcccccaaucuaaucuccuauaaaccuaugauagaucagcuggagugcaccacuaaccucaucgaccccuuugugguauucgagcggggcucacugccacaaacacguaacgauaagaccuuugcagccaguaaagggaauagaggagugcaggcuuucagcaagggcuccguccaggcggaccuuacauugauguuugauaacuucgaaguggacuuuguuggggccgcagugucuugugacgcugccuuccugaauuuaacuggaugcuacucguguaacgccggcgcuagggucugccucagcauuaccucaacggguaccgggacacuguccgcacauaauaaggauggaagucuucacaucgugcugccuucugagaacggcacuaaagaccaaugucagauuuugcauuuuaccguucccgaaguggaggaggaguucauguacagcugcgauggugacgagcgcccacuccuggucaagggcacacuaaucgccauagauccguuugacgaucggagagaagcugggggagaguccacuguagugaauccuaaaucaggcucuuggaacuucuucgacugguuuagcgggcugaugaguugguucggaggcccccucaagaccauucugcuuaucuguuuguauguugcgcuguccaucgguuuauuuuuccuccugauuuaccuugggaggacgggacugagcaaaauguggcuagccgcaacaaagaaggccucuuga

SEQ ID NO: 11123 - RNA, 3594 nt, Artificial Sequence
  derived and/or modified CDS sequence (opt3) from RVFV(2007000253)__JF326192.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggguauucgcgaagucaagaccucaagccaggagcuauaucgagcacucaaagccaucauugcggcugacggacugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaagaauaguaaaaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugacauaggcguccauauggcucacgaugaccaaucggugagcuccaagauuguugcccauugcccaccccaggacccuugucuugugcacgggugcaucgucugugcacacggacugaucaauuaucagugccauacagcguugucagcuuucgugguaauuuuuguguucaguucuacugccaucauuugucucgcaguucuguacagagucuuaaaaugccugaagauagccccaaggaaagugcuaaacccgcucauguggaucaccgcuuuuauucgguggguguacaagaaaauggucgcccgaguugcagauaacaucaaucaggugaaccgcgagaucggcuggauggaaggugggcaacuggcucuuggcaaucccgccccuauuccaagacacgcgcccauaccuagguauagcacauacuugaugcugcuccugaucguguccuaugccucagcuuguagcgagcuuauucaggcaucuucccggaucacuaccugcaguacagagggaguaaacaccaagugucgccugagcggcacugccuugauuagagcugggucugccggagcagaagcgugccucaugcugaagggugucaaagaggaccagacgaaguucuuaaaaaucaagacaguguccucagaacugaguugcagggagggccagagcuacuggaccgggucguuuuccccaaaaugucuaucuagccgucggugccaucucguuggagaaugucacgugaaucgaugccugucauggagagauaacgagacuuccgccgaguucuccuuugucggcgaaucuaccacaaugagggagaauaaguguuucgaacaaugcgguggguggggcuguggaugcuuuaacgugaaucccagcugucuuuucguucacaccuauuugcaguccgugcgcaaggaggcucugcggguauuuaacugcauagacuggguccauaaacucacucuggaaaucacagauuucgacggcucagugagcacgauugauuuaggggccaguucuuccagauuuaccaauuggggaagcgugucgcugucacuugacgcagagggcaucucugguaguaacuccuucagcuucauugagucuccggggaagggauacgcuaucgucgaugaaccuuuuagcgagauaccaaggcagggcuucuugggugaaauucgcuguaauuccgagucaaguguucucagcgcccacgaaucuugccugcgagcacccaaccuaguguccuauaaaccuaugaucgaccagcuggagugcacuacaaaucucauugaucccuuuguaguguucgagcggggcucacugccacaaacccguaacgacaagacauuugccgcuaguaaagggaacagaggaguccaggcguucagcaagggcuccgugcaggccgaucuuacuuugauguuugacaauuucgaaguugacuuugugggggcagcugucucuugugaugccgccuuccugaacuuaaccggaugcuacucguguaaugcuggcgcaagggugugccucagcaucacgucaaccgguacagggacucuguccgcccauaacaaggacggaagucuucacauaguucugccuucugagaauggcaccaaagaucaaugucagaucuugcauuuuacagugcccgaagucgaggaggaguucauguacagcugcgacggugaugagcgcccacuccugguaaagggcacucuaauugcgaucgacccguuugaugaccggagagaagcugggggagaguccaccgugguuaacccuaaaucaggcucuuggaauuucuucgauugguuuagcgggcugaugaguugguucggaggcccccucaagacgauucugcuuaucuguuuguauguggcccuguccauagguuuauuuuuccuccugauuuaccuugggaggacaggacugagcaaaauguggcuagcagccaccaagaaggcuucuuga

SEQ ID NO: 11124 - RNA, 3594 nt, Artificial Sequence
  derived and/or modified CDS sequence (opt3) from RVFV(200803166)__JF311381.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaggaacuguccugcucugugucggguauucgcgaagucaagaccucaagccaggagcuauaucgagcacucaaagccaucauugcggcugacggacugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucaaaaaggggaaauuccccuuauuucagagcuacgcucaccaucgcacacugcuugaagccguccacgauaccauaauugcaaaggcugacccuccauccugugauuugcagucagcccacggaaacccgugcaugaaggagaaacuggugaugaagacgcauugucccaaugacuaucaaagugcgcacuaccuaaacaaugaugguaaaauggccagcgugaagugcccuccaaaauaugagcucacugaagacuguaacuucugccgacagaugaccggcgcaucucugaagaaaggguccuacccccuucaggaccuguuuugccagucaagcgaggaugacggaaguaaguugaagacaaaaaugaagggcgucugugaaguuggugugcaagcucucaaaaagugcgaugggcagcugucuacugcccaugagguagugccuuucgcugucuuuaaaaauuccaagaagguguacuuagacaaacuggaucucaagaccgaagagaaccuucugccagacagcuucguuuguuuugagcacaaaggacaguauaagggcacaauggauucgggccagaccaaaagagaauugaagucuuucgacaucucccaaugccccaagauugggggacacgguaguaaaaaguguacgggcgaugccgcauuuugcucagccuacgaguguacugcucaguaugcgaaugcauacugcagccaugccaacggguccggaaucgugcagauccaagucucuggcguguggaaaaagccgcuauguguagguuaugaaaggguuguggucaaacgggagcugagcgcuaagccuauucagcguguggaacccugcacaaccuguauaacuaagugcgagccacacgggcucgucgugcgcucaacaggcuucaaaaucaguuccgccguugcaugcgccagcggaguguguguaaccggcucucagucaccuaguacggagauuacccugaaguaccccgggaucagccaguccucuggaggugacauaggcguccauauggcucacgaugaccaaucggugagcuccaaaauuguugcccauugcccaccccaggacccuugucuugugcacgggugcaucgucugugcacacggacugaucaauuaucagugccauacagcguugucagcuuucgugguaguguuuguuuucaguucuauugccaucauuugucucgcaauacuguacagagucuuaaagugccugaaaaucgccccaaggaaggugcuaaacccgcucauguggauuacugcuuuuauccgguggguguacaaaaagauggucgcccgaguugcagauaacaucaaucaggugaaccgcgaaauuggcuggauggagggugggcaacuggugcuuggcaaucccgcuccuauaccaagacacgcccccaucccuagguauagcaccuacuugaugcugcuccugauuguauccuaugcgacagccuguucagaacuuauccaggcuagcucucggauuacuaccugcuccacagagggagucaacaccaagugucgccugaguggcacugcauugaucagagccgggagcgugggagcugaggccugccucaugcugaaagguguuaaggaagaccagacgaaauucuuaaagauaaaaacagugucuuccgagcugucaugcagggaaggccagaguuacuggaccgggagcuuuucgccaaagugucuauccucucgucggugccaucucgucggagagugucacgugaaucgaugccugagcuggagagauaacgaaacuucagcagaguucaguuuuguuggcgaguccaccacaaugagggaaaauaaguguuucgagcaaugcgguggguggggcuguggaugcuuuaacgugaaucccucuugucuuuucguacacaccuauuugcagagcguccgcaaagaagcgcugcggguguuuaacugcaucgacugggugcauaagcucacucuggagauuacagauuucgacggcuccgucucaacgaucgauuuaggggccagcaguucuagauuuaccaauuggggauccguuagccugucgcuugacgcugaaggcauuucagguucuaacaguuucuccuucaucgagagcccggggaaaggauacgccauaguggaugagccuuuuucugaaauuccaaggcagggcuucuugggugagauccgcuguaauagcgaauccucaguacucagugcacacgagagcugccugcgagcucccaaccuaauuucuuauaagccuaugaucgaccagcuggaaugcacuacaaaucucauagaucccuuuguggucuucgagcggggcucccugccacaaacccguaacgacaaaacauuugccgcaucaaaggggaacagaggagugcaggccuucaguaagggcagcguucaggcugaucuuacuuugauguuugacaauuucgagguggacuuugucggggcggccguguccugugaugcagcuuuccugaacuuaaccggaugcuacucuuguaaugccggcgccaggguuugccucucgaucacgagcaccgguacagggacucugucagcucauaacaaagacggaucccuucacgugguccugccuagugaaaauggcaccaaggaucaaugucagauuuugcauuuuacaguacccgagguggaagaggaguucauguacucuugcgacggugaugaacgcccacuccugguuaaaggcacucuaaucgcaauugacccguuugaugaccggagagaggccgggggagaaagcaccguggucaacccuaaguccggcucauggaauuucuucgauugguuuucugggcugaugagcugguucggaggcccccucaaaacgauccugcuuauauguuuguauguggcgcugaguauugguuuauuuuuccuccugaucuaccuugggaggacaggacuguccaagauguggcuagcugccaccaagaaagcaagcuga

SEQ ID NO: 11125 - RNA, 3594 nt, Artificial Sequence
  derived and/or modified CDS sequence (opt3) from RVFV(2007001107)__EU574047.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggggauucgcgaagucaagaccucaaaucaggagcuauaucgagcacucaaagccaucauugcggcugacggucugaacaauaucacaugucacggcaagaacccagaggauaaaauaagccuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaucggccugggaaaggacauaacuacaucgacggcaugacacaggaggaugcgaccuguaagccaguuacuuaugcaggcgccugcaguuccuuugacgugcugcucgaaaaagggaaguuccccuuauuucagucuuacgcucaccaucgcacacugcuugaggccguccacgauaccauaauugcaaaagcugacccuccaagcugugauuugcaguccgcccacggaaauccgugcaugaaggagaagcuggugaugaaaacgcauugucccaacgacuaucaaucagcgcacuaccuaaauaacgaugguaagauggccagugugaaaugcccuccaaaguaugaacucacugaggacuguaauuucugccgacagaugaccggcgcaagccugaaaaaggggucuuacccccuucaggaccuguuuugccaguccucagaagaugacggaagcaaauugaagacaaagaugaaaggcgucugugagguuggugugcaagcucucaagaaaugcgaugggcagcugaguacugcccaugaaguagugccuuucgcugucuuuaagaacucuaaaaagguguacuuagacaagcuggaucucaaaaccgaggagaaucuucugccagacuccuucguuuguuuugaacacaagggacaguauaaaggcacaauggauagcggccagaccaagagagaguugaaaucguucgacaucucucaaugccccaagauugggggacacgguuccaagaaauguacgggcgaugccgcauuuugcucagccuacgaauguacugcucaguaugcgaacgcauacugcagucaugccaaugggagcggaaucgugcagauccaagucuccggcguguggaagaaaccgcuauguguagguuaugagaggguuguggucaagcgggaacugucugcuaaaccuauucagcguguggagcccugcacaaccuguauaacuaagugcgagccacacgggcucgucgugcgcagcacaggcuucaagaucucaagugccguugcaugcgccuccggaguguguguaaccggcagccagucuccuucaacggaaauuacccugaaauaccccgggaucagucagagcuccggaggugacauaggcguccauauggcucacgaugaccaaucugugucgagcaagauuguugcccauugcccaccccaggacccuugucuugugcacgggugcaucgucugugcacacggacugaucaacuaucagugccauacagcguuguccgcuuucgugguaauuuuuguguucucaaguacugccaucauuugucucgcaguucuguacagagucuuaaaaugccugaagauagccccaaggaaagugcuaaacccgcucauguggaucaccgcuuuuauucgguggguguacaagaaaauggucgcccgaguugcagauaauaucaaccaggugaaucgcgagaucggcuggauggaaggugggcaacuggcucuuggcaaccccgccccuauuccaagacacgcgcccauaccuagguauucuacauacuugaugcugcuccugaucgugagcuaugccuccgcuuguucagagcuuauucaggcaagcucucggaucacuaccugcuccacagagggaguaaauaccaagugucgccugaguggcacugccuugauuagagcugggagcgucggagccgaagcaugccucaugcugaagggugugaaagaggaccagacgaaguucuuaaaaaucaagacaguuucuuccgaacugucaugcagggagggccagaguuacuggaccgggagcuuuucgccaaaaugucuauccucucgucggugccaucucgugggagaaugucacgucaaccgaugccugagcuggagagauaaugagacuucagcggaguucaguuuugugggcgaauccaccacaaugagggagaacaaguguuucgaacaaugcgguggguggggcuguggaugcuuuaauguuaaccccucuugucuuuucgugcacaccuauuugcagagcguacgcaaggaggcccugcgggucuuuaauugcauagacugggugcauaaacucacucuggaaaucacagauuucgacggcuccgugucaacgauugauuuaggggcuagcaguucuagauuuaccaacuggggauccgucagccugucgcuugacgccgagggcaucucagguucuaauaguuucuccuucauugagagcccggggaagggauacgcaaucguugaugaaccuuuuucugagauaccaaggcagggcuucuugggugaaauucgcuguaacagcgaguccucagugcucagugcucacgaaagcugccugcgagcccccaaucuaguaucuuauaaaccuaugaucgaccagcuggagugcacuacaaaccucauugaucccuuuguggucuucgagcggggcucccugccacaaacccguaacgacaagacauuugcagccucaaaagggaauagaggagugcaggcuuucaguaagggcagcguucaggcggaucuuacuuugauguuugacaacuucgaaguggacuuugucggggccgcaguguccugugaugcugccuuccugaauuuaaccggaugcuacucuuguaacgccggcgcuaggguuugccucucgaucacgagcaccgguacagggacucugucagcacauaauaaggacggaucccuucacauagugcugccuagugagaacggcaccaaagaucaaugucagaucuugcauuuuacaguccccgaaguagaggaggaguucauguacucuugcgacggugaugagcgcccacuccuggugaagggcacucuaauugccaucgacccguuugaugaccggagagaagcgggaggagagagcaccguugugaauccuaaauccggcucauggaacuucuucgauugguuuucugggcugaugagcugguucggaggcccccucaagacgauucugcuuaucuguuuguaugucgcucugaguauagguuuauuuuuccuccugauuuaccuugggaggacaggacuguccaaaauguggcuagccgcaaccaagaaggccagcuga

SEQ ID NO: 11126 - RNA, 3594 nt, Artificial Sequence
  derived and/or modified CDS sequence (opt3) from RVFV(ANK-3837)__DQ380215.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcaaguuggacucgggccagacaaaaagagagcuaaagucuuucgauauuucccaaugccccaagaucgggggacacgguaguaaaaaguguaccggcgacgccgcauuuugcucagccuacgaauguacggcucaguaugcgaacgcauacugcagccaugccaauggguccggaaucguucagauucaagugucuggcgucuggaaaaagccgcuguguguggguuaugagaggguaguugugaaacgggaacucagcgcuaagccuauacagcgugucgagcccugcacuacauguaucaccaagugcgagccacacgggcuggugguccgcucaacuggcuucaaaauuaguuccgccguggcaugcgccagcggaguuugugugacaggcucucagucaccuaguaccgaaaucacgcuuaaguaccccgggauaagccaguccucuggaggugauauuggcguacauauggcucacgacgaccaaucggucagcuccaaaaucguggcccauugcccaccccaggauccuugucugguucacgggugcaucgugugugcacacggauugauuaacuaucagugccauaccgcgcucucagcuuucgucgugguauuuguguucaguucuaucgccauuauaugucuggcaaucuuauacagaguucugaagugccuaaaaauugccccaaggaagguccucaauccgcugauguggaucacagcuuuuauccgguggguguaccgaaaaaugguggcccgcgucgcagacaacauuaaccagguuaauagagagauaggcuggauggaaggugggcaacuuguguugggcaaccccgcuccuaucccaaggcacgugcccauuccucgguauagcacuuaccugaugcuccugcuuaucguauccuaugccucagcguguagcgagcugauucaggccucuucccgcaucaccacaugcaguacugagggagucaauaccaaguguagauugagcggcacagcucucauaagggcagggucugugggagccgaggcuugccugauguuaaaggguguuaaagaggaucagaccaaguuccugaaaaucaagacuguguccucagaacuaaguugccgugagggccagagcuacuggacggggucguuuuccccaaaaugucucucuagccggcgaugccaucuggucggagaaugucacgugaacagaugccuuucauggagggacaaugagacaagugccgaguucuccuuuguuggcgaaucuaccacuaugcgcgagaacaaguguuucgaacaaugcgguggguggggcuguggaugcuuuaaugugaaccccagcuguuuguucguacacaccuaucugcaguccguccggaaggaggcacucagaguguuuaauugcauugauugggugcauaaacugacauuagaaaucaccgacuucgauggcucagucagcacuauugaccugggggcgaguucuuccagguuuacaaacuggggaagcguuucgcuuucauuggaugccgagggcaucucugguaguaauuccuucagcuucauagagucuccggggaagggauacgcuauuguggacgaaccuuuuagcgagaucccacgccagggcuuccucggugaaauucgauguaacuccgagucaaguguacugagcgcccacgaaucuugccuacgggcacccaaucugaucuccuauaaaccuaugauagaucagcucgagugcacgaccaaccugaucgaccccuuuguggucuucgagcguggcucacuuccacaaacuagaaaugauaagacauuugcugccaguaaagggaacaggggagugcaggcauucagcaagggcuccguucaggccgacuugacccugauguuugacaacuucgaaguggauuuugucggggcugcggugucuugugacgccgcauucuuaaaucucacaggaugcuacucguguaacgcuggcgcccgcguuugccugagcauuacuucaaccgguacggggacccuuuccgcccauaauaaggauggaagucugcacaucguguugccuucugagaacggcacaaaagaccaaugucagauucuccauuuuacuguccccgaaguagaggaggaguucauguacagcugcgauggugacgaacggccacugcuagugagaggcacccugaucgcuauagauccguuugacgauaggcgagaagcagggggagaguccacaguugugaauccuaagucaggcucuuggaacuucuucgacugguuuagcgggcucaugaguugguucggaggcccccugaaaacuauucuuuugaucugucuguaugucgccuuauccaucggucucuuuuuccugcuuauuuaccuggggcgcaccggacuaagcaagauguggcucgcggcuacgaaaaaggccucuuga

SEQ ID NO: 11127 - RNA, 3594 nt, Artificial Sequence
  derived and/or modified CDS sequence (opt3) from RVFV(OS-1)__DQ380186.1__GP
auguacgugcugcucacaauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcaacgggaugccaagcagauuggccgcgagacuauggcagguaucgccaugaccguucugccugcuuuggcaguguuugcccucgcuccagucguguucgccgaagacccccaccugagaaauaggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucggacacugcuugaggccgugcacgacaccauuaucgcaaaagcugauccuccauccugugacuugcaaucagcccacggaaauccgugcaugaaggagaagcuggucaugaaaacgcauugucccaacgauuaucagagugcgcacuaccuaaauaacgacgguaagauggccagcgugaaaugcccuccaaaguaugaacucacugaggacuguaauuucugccgccagaugaccggcgcaucucugaaaaagggguccuacccccuucaggaucuguuuugccaaucaagcgaagacgauggaaguaaauugaagacaaagaugaaaggcgugugugaggucgguguucaggcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauggacucgggccaaaccaagcgagaguugaaaucuuucgauauuucccagugccccaagaucgggggacacgguucaaagaaauguacgggcgacgccgcauuuugcagugccuacgaauguacugcucaguaugcgaacgcauacugcagccaugccaauggguccggaguugugcaaauccaggucucuggcguguggaagaaaccgcuauguguagguuaugagagaguuguggucaagagggaacugagcgcuaaaccuauucagcggguggagcccugcacaaccuguauaacuaagugcgagccacacgggcucgucgugcguucaacaggcuucaagaucaguuccgccguugcaugcgccagcggaguguguguaaccggcucucagucaccuaguacggaaauuacccugaaauaccccgggaucagccaauccucuggaggugauauaggcguccauauggcucacgacgaccagucggugagcuccaagauuguugcccauugcccaccccaggauccuugucuugugcacgggugcaucgucugugcacacggacugaucaacuaucagugccauacagcguugucagcuuucgugguaguguuuguuuucaguucugucgccauuaucugucucgcaauucuguacaaaguguuaaagugccugaaaauagccccacgcaaggugcuaaauccgcucauguggaucacugcuuuuauuagaugggucuacaaaaagaugguugccaggguggcagacaacaucaaccaagugaaucgggagaucggcuggauggaaggugggcagcuggcucuuggcaaccccgccccuauuccacgacacgcgcccauaccucgcuauagcaccuacuugaugcugcuccugaucguauccuaugccucagcuuguagcgagcuuauucaggcaucuuccagaaucacaacuugcaguaccgagggagucaauacaaaguguaggcugagcggcaccgccuugauucgggcugggucugugggagccgaagcaugccucaugcugaaagguguuaaggaggaucagacuaaauucuuaaagaucaaaacgguguccucagaacugaguugccgcgagggccaaagcuacuggacagggucguuuuccccaaagugucuaucuagcagaaggugccaucucgucggagaaugucacgugaaccguugccugucauggcgggacaaugagaccagugcggaguucuccuuuguuggcgaaucuacuaccaugcgagagaacaaguguuucgaacagugcgguggguggggcuguggaugcuuuaaugugaaccccagcugucuuuucguacacacauauuugcaguccgucagaaaagaggcccugaagguguuuaauugcauagauugggugcauaaacucacccuggaaaucacugacuucgauggcucagucagcacaauugacuuaggggcuaguucuuccagguuuacgaacuggggaagcguuucgcugucacuugaugccgagggcaucucugguaguaauuccuucagcuucauugagucuccggggaagggauacgcaaucguggacgaaccuuuuagcgagauaccacgccagggcuucuugggugaaauucgguguaacuccgagucaaguguacucagcgcucacgaaucuugccugagagcccccaaucuaaucuccuauaaaccuaugauugaucaacuggagugcaccacuaaccucaucgaccccuuuguggucuucgagaggggcucacugccacagacacgcaaugauaagaccuuugcagccaguaaggggaaccgaggagugcaggcuuucagcaaaggcuccguucaagcggaccuuacauugauguuugacaacuucgaaguggauuuugucggggccgcagugucuugugacgcugccuuccugaauuuaacuggaugcuacucguguaacgccggcgcucggguuugccucagcauaaccucaacggguaccgggacacuguccgcacauaauaaggauggaagucuucacaucgugcugccuucugagaacggcacuaaagaccagugucagauuuugcauuuuaccguccccgaaguagaggaggaguucauguacagcugcgauggugacgagcguccacuccuggugaagggcacacuaaucgccauugauccguuugacgauagaagggaagcugggggagaguccacuguugugaauccuaaaucaggcucuuggaacuucuucgacugguuuagcgggcugaugaguugguucggaggcccccucaagaccauccugcuuauauguuuguaugucgcgcuguccauugguuuauuuuuccuccugaucuaccuugggcgcacgggacugagcaagauguggcuagccgcaaccaaaaaggccucuuga

SEQ ID NO: 11128 - RNA, 3594 nt, Artificial Sequence
  derived and/or modified CDS sequence (opt3) from RVFV(Sudan 2V-2007)__JQ820490.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggguauucgcgaagucaagaccucaagccaggagcuauaucgagcacucaaagccaucauugcggcugacggacugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaaaaauuccaagaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugacauaggcguccauauggcucacgaugaccaaucggugagcuccaagauuguugcccauugcccaccccaggacccuuguucagugcacgggugcaucgucugugcacacggacuuaucaauuaucagugccauacagcgcugagugcuuucgugguaguguuuguuuucucuagcauugccaucauuuguuuggcaauacucuacagaguccugaaaugcuuaaagaucgccccaaggaaagugcugaacccgcuaauguggauuacugcuuuuauccgguggguguacaagaaaauggucgcccgaguugcagauaacaucaaucaggugaaccgcgagauuggcuggauggaaggugggcaacucgugcugggcaaucccgcuccuauaccaagacacgcccccaucccuagguauuccaccuaccuuauguugcugcucauuguaucacaugcgagcgccuguucugagcugauccaggcuuccagucggauuacaacuugcagcaccgagggagucaacacaaagugucgccuuucuggcaccgcacugaucagagccggguccgugggagcugaagccugcuugaugcucaaggguguuaaagaggaccagacuaaguuccugaaaauaaagacggugucaagugaauuaagcugcagggagggccagucguauuggacaggguccuuuucuccaaaaugucugagcucacgucggugccaccuagucggagaaugucacgugaaucgaugccucaguuggagagauaacgagaccuccgcagaguucucuuuuguuggcgaaagcacuaccaugagggagaauaaguguuucgaacaaugcgguggguggggcuguggaugcuuuaacgugaaucccuccugucuguucguacauacauaccuucagucaguccgcaaggaggcguugcggguguuuaacugcaucgacugggugcacaaacugacccucgaaauuacugauuucgacggcagcgucaguacaaucgaucugggggccucuuccagcagauuuacgaauuggggaucgguuucauuaucucuggacgcugagggcauuagugguuccaacagcuucucuuucaucgagagcccggggaagggauaugccauaguggaugaaccuuuuuccgagauuccaaggcagggcuuccuuggugaaauccgcuguaauucagagaguagcguauugucugcacaugaauccugccuccgagcucccaaccugauuucauacaaaccuaugaucgaccagcuagagugcaccacuaaucugauagaucccuuuguggucuucgagcggggcagucucccacaaacacguaacgacaagaccuuugccgcaagcaaagggaacagaggagugcaggccuucuccaagggcucuguucaggcugaucugacacuuauguuugacaauuucgaaguggacuuugucggggcggccgugucgugugaugcagcuuucuugaaccugacuggaugcuauagcuguaaugccggcgccaggguuugcuuaucaaucaccuccacggguaccgggacacucagugcucacaacaaggacggaucucugcauauugugcuuccuagcgagaauggcacuaaagaucaaugucagauccugcacuuuaccguccccgaaguagaggaggaguucauguacuccugcgacggugaugagcgcccauugcucgugaagggcacacugauggcaauugacccguuugaugaccggagagaagccgggggagagucaacuguugugaacccuaaaucuggcagcuggaauuucuucgauugguuuagugggcuaauguccugguucggaggcccccugaagaccauccuccugauaugucuuuacgucgcguugagcauuggucuguuuuucuuacucaucuaucuggggaggacgggacuuucuaaaauguggcuggcugccacaaagaaggcaucauga

SEQ ID NO: 11129 - RNA, 3594 nt, Artificial Sequence
  derived and/or modified CDS sequence (opt3) from RVFV(200803162)__JF311377.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggguauucgcgaagucaagaccucaagccaggagcuauaucgagcacucaaagccaucauugcggcugacggacugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaaaaauuccaagaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccgcuauguguagguuaugagaggguuguggucaagcgggaacugagcgcuaaaccuauucagcguguggagcccugcacaaccuguauagccaagugcgagccacacgggcucgucgugcgcucaacuggcuucaagaucaguuccgcaguugccugcgcuagcggaguguguguaacaggcucucagucaccuaguaccgaaauuacgcugaaauaccccgggaucagccaguccucuggaggugacauaggcguccauauggcccacgaugaccaaucggugagcuccaagauuguugcacauugcccaccccaggacccuugucuugugcacgauugcaucgucugugcgcacgggcugaucaauuaucagugccauaccgcuuugucagccuucgugguaauuuuuguguucaguucuacagcaaucauuugucucgccguucuguacagagucuuaaaaugccugaagauagcuccaaggaaagugcuaaacccgcucauguggaucacugccuuuauucgguggguguacaagaaaauggucgcacgaguugcugacaacaucaaucaggugaaccgcgagaucggauggauggaaggcggucaacuggcccuuagaaaucccgcgccuauuccaaggcacgcccccauaccucgguauagcaccuacuugaugcugcuccugaucguguccuaugcuucagcauguagcgagcuuauucaggccucuucccgcaucacaacuugcaguaccgaggggguaaacacaaaguguagacugagcggcaccgcuuugauuagggccggaucugucggcgcagaagcgugccucaugcugaagggggugaaagaggaucagacuaaguucuuaaaaaucaagacgguuuccucagaacugaguugccgugagggacagagcuacuggacagguucguuuuccccaaaaugucuaucuagccggcgaugccaucucgugggcgaaugucacgucaauagaugccugucauggagggacaacgagaccagugccgaguucuccuuugugggggaaucuacuaccaugcgcgagaauaaguguuucgaacaaugcggaggcugggguugugggugcuuuaacguuaaucccagcugucuuuucgugcacacauauuugcaguccguacggaaggaggcucugagagucuuuaacugcauagauugggugcauaaacucacccuggaaaucacugacuucgauggcucagugagcacaauugacuuaggagccaguucuuccagguuuacgaauuggggcagcgucucgcugucacuugaugcagaggggaucucuggaaguaacuccuucagcuucauugagucuccgggcaaggguuacgcuaucguugacgaaccuuuuagcgagauaccacgccagggguucuugggagaaauucgauguaauuccgagucaagugugcucagcgcccacgaaucuugccugcgggcacccaaccuaguauccuauaaaccuaugaucgaucagcuggagugcaccacuaaucucauugaccccuuuguggucuucgagcguggcucacugccacaaacaagaaacgauaagaccuuugccgcuaguaaagguaacaggggcgugcaggcguucagcaagggguccguucaggccgaccuuacauugauguuugacaauuucgaaguggauuuugucggagcagcugugucuugugacgccgccuuccugaacuuaacuggcugcuacucguguaaugcuggggcacgcguuugccucagcaucaccucaacgggaaccggcacacuguccgcccauaacaaggaugguagucuucacauagugcugccuucugagaaugggacuaaagaccaaugucagaucuugcauuuuaccguccccgaaguagaggaggaguucauguacagcugcgauggagacgagcggccacuccuggugaagggcacacuaauugcgaucgauccguuugacgauagaagggaagcugguggcgaguccacuguugugaacccuaaaucagggucuuggaauuucuucgacugguuuagcggacugaugaguugguucggcgggccccucaagaccauucugcuuaucuguuuguaugucgcccuguccauaggauuauuuuuccuccugauuuaccuuggccgaacgggucugagcaaaauguggcuagcagccacaaagaaggcuucuuga

SEQ ID NO: 11130 - RNA, 3594 nt, Artificial Sequence
  derived and/or modified CDS sequence (opt3) from RVFV(2007001811)__EU574040.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggguauucgcgaagucaagaccucaagccaggagcuauaucgagcacucaaagccaucauugcggcugacggacugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaaaaauuccaaaaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugacauaggcguccauauggcucacgaugaccaaucggugagcuccaagauuguugcccauugcccaccccaggacccuugucuugugcacgggugcaucgucugugcacacggacugaucaauuaucagugccauacagcguugucagcuuucgugguaguguuuguuuucaguucuauugccaucauuugucucgcaauacuguacagagucuuaaaaugccugaagaucgccccaaggaaagugcuaaacccgcucauguggauuacugcuuuuauccgguggguguacaagaaaauggucgcccgaguugcagauaacaucaaucaggugaaccgcgagauuggcuggauggaaggugggcaacuggugcuuggcaaucccgcuccuauaccaagacacgcccccaucccuagguauagcaccuacuugaugcugcuccugauuguauccuaugcgucagccuguagcgagcuuauccaggcuucuucccggauuacaacuugcaguaccgagggagucaacacaaagugucgccugagcggcaccgcauugaucagagccgggucugugggagcugaagccugccucaugcugaaggguguuaaagaggaccagacuaaguucuuaaugauaaaaacgguguccucagaacugaguugcagggagggccagagcuacuggacagggucguuuuccccaaagugucuaucuagccgucggugccaucucgucggagaaugucacgugaaucgaugccugucauggagagauaacgagaccagugcagaguucuccuuuguuggcgaaucuacuaccaugagggagaauaaauguuucgaacaaugcgguggguggggcuguggaugcuuuaacgugaaucccagcugucuuuucguacacacauauuugcaguccguccgcaaggaggcgcugcggguguuuaacugcaucgacugggugcauaagcucacccuggaaauuacugauuucgacggcucagucagcacaaucgauuuaggggccaguucuuccagauuuacgaauuggggaagcguuucgcugucacuugacgcugagggcauuucugguaguaacuccuucagcuucaucgagucuccggggaaaggauacgccauaguggaugaaccuuuuagcgagauuccaaggcagggcuucuugggugaaauccgcuguaauuccgagucaaguguacucagcgcacacgaaucuugccugcgagcucccaaccuaauuuccuauaagccuaugaucgaccagcuggagugcaccacuaaucucauagaucccuuuguggucuucgagcggggcucacugccacaaacacguaacgagaaaaccuuugccgcaaguaaggggaacagaggagugcaggccuucagcaaaggcuccguucaggcugaccuuacauugauguuugauaauuucgagguggacuuugucggggcggccgugucuugugacgcagcuuuccugaacuuaacuggaugcuacucguguaaugccggcgccaggguuugccucagcaucaccucaacggguaccgggacacuguccgcucauaacaaggauggaagucuucacauugugcugccuucugaaaauggcacuaaggaccaaugucagaucuugcauuuuaccguccccgagguagaggaagaguucauguacagcugcgauggugacgaacgcccacuccuggugaaaggcacacuaauugcaaucgauccguuugacgaucggagagaggccgggggagaauccacuguugugaacccuaagucaggcucuuggaauuucuucgacugguuuagcgggcugaugaguugguucggaggcccccucaaaaccauacugcuuauuuguuuguaugucgcgcuguccaucgguuuauuuuuccuccugaucuaccuugggaggacgggacugagcaagauguggcuagcugccacaaagaaggcaucuuga

SEQ ID NO: 11131 - RNA, 3594 nt, Artificial Sequence
  derived and/or modified CDS sequence (opt3) from RVFV(clone 13)__DQ380213.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaagcaugaacucacugaggacuguaauuucugccgacagaugaccggcgcaucucugaaaaagggguccuauccccuucaggaucuguuuugccagucaagcgaagacgauggaaguaaauugaagacaaagaugaaaggcgugugugaggucgguguucaagcucucaagaaaugcgacgggcagcugucuacugcccacgaagugguaccuuucgcuguguuuaagaacuccaaaaaggucuacuuagauaagcuggaccucaaaaccgaggagaaucuucugccagauagcuucguguguuuugaacacaagggacaguacaaaggcacaauggacucgggccagaccaagagagaguugaaaucuuucgauauuucccaaugccccaagaucgggggacaugguucaaagaaauguacgggcgacgccgcauuuugcagugccuaugaauguacugcucaguacgcgaacgcauauugcagccacgccaauggguccggaaucguucagauucaagugucuggcgucuggaagaaaccgcuauguguggguuacgagaggguaguugugaagcgggaacugagcgcuaaaccuauacagcgugucgagcccugcacaaccuguaucacuaagugcgagccacaugggcucgugguccgcucaacaggcuucaagauuaguuccgccguggcaugcgccagcggaguuugugugaccggcucucagaacccuucaacggaaaucacccugaaauaucccgggauaagucagagcuccggaggugauauuggcguacacauggcucaugacgaccaaucugucucgagcaagaucguggcccacugcccaccccaggauccuugucuuguucacgggugcaucgugugugcacauggacugauuaauuaccagugccacacagcguuguccgcuuucgucgugguauuuguguucucaaguaucgccauuauaugucucgcaauccuguauagaguuuuaaaaugccugaagauugccccaaggaaaguccuaaacccgcucauguggaucacugcuuuuauccgguggguguacaagaaaaugguggcccgagucgcagacaacauuaaucagguuaaccgcgagauaggcuggauggaaggugggcaacuggugcuuggcaaucccgcuccuaucccaagacaugcccccauuccuagguacucuaccuauuugaugcugcuccugaucgugagcuacgcguccgccuguucagagcuuauucaggcuagcucucggaucacaacuugcuccaccgagggaguaaacacaaagugucgccugaguggcaccgcauugauaagagccgggagcgucggagcugaagccugccucaugcugaagggugugaaagaugaccagacuaaguucuuaaaaaucaagacgguuucuuccgagcugucaugcagggaaggccagaguuauuggacagggagcuuuucgccaaaaugucuauccucucgucggugccaccucgugggagagugucacgucaaucgaugccugagcuggagagauaacgaaaccucagcagaguucaguuuugugggcgaguccacuaccaugagggaaaauaaguguuucgagcaaugcgguggguggggcuguggaugcuuuaacguuaaucccucuugucuuuucgugcauacauacuugcagagcguacgcaaggaagcgcugcgggucuuuaacugcauugacugggugcacaaacucacccuggagaucacugauuucgacggcuccgugucaacaauugauuuaggggccagcaguucuagauuuacgaauuggggauccgucagccugucgcuugacgcugaaggcaucucagguucuaacaguuucuccuucauagagagcccggggaagggauaugccauuguugaugagccuuuuucugaaaucccaaggcagggcuucuugggugagauucgcuguaauagcgaauccucagugcucagugcacaugagagcugccugcgagcucccaaccuaaucucuuacaaaccuaugauagaccagcuggaaugcaccacuaaucucaucgaucccuuuguaguguucgagcggggcucccugccacaaacacguaacgagaagaccuuugccgcaucaaaagggaacagaggaguccaggccuucaguaagggcagcgugcaggcugaccuuacauugauguuugacaauuucgaaguugauuuugugggggcggccgucuccugugacgcagcuuuccugaacuuaacuggaugcuauucuuguaaugccggcgccagggugugccucucgauuaccagcacggguaccgggacacugucagcucacaacaaggauggaucccuucauaucguucugccuagugagaauggcacuaaagaccaaugucagauuuugcacuuuaccgugcccgaagucgaggaggaguucauguacucuugcgauggugacgagcgcccacuccugguaaagggcacacuaaucgcaauagauccguuugacgaucggagagaagccgggggagagagcacugugguuaacccuaaauccggcucauggaauuucuucgacugguuuucugggcugaugagcugguucggaggcccccucaagaccauucugcuuaucuguuuguacguggcgcugaguaucgguuuauuuuuccuccugauuuaucuugggaggacgggacuguccaaaauguggcuagcugccacaaagaaggcaagcuga

SEQ ID NO: 11132 - RNA, 3594 nt, Artificial Sequence
  derived and/or modified CDS sequence (opt3) from RVFV(MP12)__Z30318.1__GP
auguacgugcugcucaccauccuuacaagcguccugguuugcgaggccauuauaagaguguccuugucuucaacuagggaagagacguguuucggcgacaguaccaaccccgaaaugaucgagggggcuugggauagcuuacgggaagaggagaugccugaggaacuguccugcucuauuucgggaauccgcgaaguaaagacaucaagccaggagcuauaucgagcacucaaagccauuaucgcggcugacggucugaauaacauaacuugucacggcaaggauccagaggacaaaaucagucuuauuaaggggccgccccauaaaaagcgugugggaaucgucagaugcgaaaggcggcgcgaugccaagcaaauuggcagaaaaaccauggcagguaucgccaugacagugcugccugcuuuggcaguuuuugcccucgcuccaguggucuucgccgaggacccccaccugaggaaucggccugggaagggacauaacuacauagauggcaugacccaggaagacgcgacuuguaaaccagugacauaugcaggcgccugcuccucuuuugauguacugcucgagaaggggaaauuccccuuauuucagagcuacgcucaccaucgcacccugcuugaagccguucacgacacgauuaucgcaaaggcugauccuccauccugugacuugcugucagcccacggaaauccgugcaugaaggagaagcuagugaugaaaacucauugucccaacgauuaucagagugcgcaccaucucaauaacgacgguaaaauggccagcgucaagugcccuccaaaauacgagcugaccgaagacuguaauuucugccgacaaaugacaggcgcaucucuuaagaaaggguccuauccccugcaggauuuguuuugccagucaagcgaggacgauggaaguaagcucaagacuaaaaugaagggcgugugugaaguggguguccaggcucugaaaaagugcgacgggcaauuaucuaccgcccacgagguugugccuuucgcuguauuuaaaaacuccaagaagguguaccuggauaaacucgaccuuaagacagaagagaaucuguugccagauagcuucgucuguuuugagcacaaaggacaguacaagggcaccauggacucgggccagacgaaaagagaacuaaagucuuucgauauuucccagugccccaagaucgggggacaugguaguaaaaaguguacuggcgacgccgcauuuugcagugccuaugaguguacagcucaauacgcgaacgcauauugcagccacgccaauggguccggaaucgugcagauucagguuucuggcguguggaaaaagccgcugugugucgguuacgaaagggugguaguuaaacgggagcucagcgcuaagccuauacaacguguggaacccugcaccacuuguaucacaaagugcgagccacaugggcuggucgugcgcucaaccggcuucaaaauuaguuccgccgucgcaugcgccagcggaguguguguuacgggcucucagucaccuaguaccgagaucacacuuaaguaucccgggauaagccaguccucuggaggugauauuggcgugcacauggcucaugacgaccagucgguaagcuccaaaaucgucgcccacugcccaccccaagauccuugucuggugcacgacugcaucguuugugcacauggguugauuaacuaccagugccacacugcgcucucagcuuucguggucguguuuguauucaguucuaucgccauuauaugucuggcaaucuuauauagagugcugaagugccuaaaaauugccccaaggaagguucucaauccgcugauguggaucaccgcuuuuauccgguggauuuacaaaaagauggucgcccgaguggcacauaacauaaaccaggugaaucgcgaaaucggauggauggagggcggucagcuugucuuggggaaccccgcuccuauuccaagacacgcccccaucccuagguacagcacauaucugaugcuccugcuuauuguuuccuacgcgucagccuguagcgaacugauccaggcuucuucccggauaacuaccugcaguacagagggcgugaauaccaagugucgcuugagcggaacugcacucaucagagccggcucugugggggcugaggccugccugauguuaaaaggaguaaaggaagaucaaacgaaauuccugaagcuaaaaacagucuccucagagcucaguugcagggaaggucagagcuauuggaccggcucguuuuccccaaagugucugucuagccgucggugccaccuugugggggagugucauguuaaccgaugcuugucauggagagacaaugaaacuucagcagaguucuccuuugugggagagucuaccacaaugagggaaaacaaguguuucgagcagugcggcgguuggggguguggcugcuuuaaugucaaccccagcugucuguucgugcacaccuaccuccaauccguucgcaaagaagcgcugcggguguuuaauugcauugauuggguacauaaguuaacucuggagaucacagacuucgauggaucagucagcacgauugaccuuggcgccaguucuuccagauuuaccaacugggggagcgugucguugucacucgaugcugaaggaaucucuggcaguaauuccuucagcuucauagagucuccggguaaaggguaugccauuguggacgagccuuuuagcgaaaucccaaggcagggauuccugggcgagauucgcuguaacuccgaaucaaguguccuaagcgcacacgagucuugccugcgagcucccaaucucaucuccuacaagccuaugauagaucagcuggaaugcacuacaaaccuuaucgaccccuuuguuguguucgagcgggguucauugccacagacccguaaugauaaaacauuugccgcaaguaagggcaacagagggguacaagccuucagcaagggauccgugcaggcugaccugacuuuaauguuugacaacuucgaggucgauuuugugggcgcggccguuucuugugacgcagcuuuccucaaucugaccgggugcuauucguguaacgccggagccagggugugccuuagcauuacgucaaccggcacagguucccugagugcucauaauaaagaugggucuuugcacaucguccucccuagcgaaaacggaacuaaggaccagugucaaauucugcacuuuaccgugcccgagguugaagaggaguucauguacuccugcgauggcgacgaacgcccacuacuggugaaagguacacucaucgcaauagauccguuugacgaucggagagaggccggcggggaaucaacugucguaaauccuaagucuggaagcuggaacuucuucgacugguuuaguggccugauguccugguucgggggaccccuuaaaaccauuuugcugaucuguuuauacguggcgcucagcaucggccuguuuuuccuucugauuuaucuaggugggacgggacucucuaagauguggcuggcugccacaaagaaagcaucauga

SEQ ID NO: 11133 - RNA, 3594 nt, Artificial Sequence
  derived and/or modified CDS sequence (opt3) from RVFV__JQ068143.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaauugacucgggccagaccaagagagaguugaaaucuuucgauaucucccaaugccccaagaucgggggacacgguucaaagaaauguacgggcgacgccgcauuuugcagugccuacgaauguacugcucaguaugcgaacgcauacugcagccaugccaauggguccggaauuguucagauacaagugucuggcgucuggaagaaaccgcuauguguggguuaugagaggguaguugugaagcgggaacugagcgcuaaaccuauccagcgugucgagcccugcacaaccuguauuacuaagugcgagccacacgggcucgugguccgcucaacaggcuucaagaucaguuccgccguggcaugcgccagcggaguuugugugaccggcucucagucaccuaguacggaaauaacccugaaauaccccgggauuagccaguccucuggaggugauaucggcguacauauggcucacgacgaccaaucggucagcuccaagaucguggcccauugcccaccccaggauccuugucuuguucacgggugcauugugugugcacacggacugaucaacuaucagugccauacagcguugucagcuuucgucgugguauuuguguucaguucuguugccauuauaugucucgcaauccuguacaaagucuuaagaugccugaagauugccccgaaaaaggugcuaaauccacucauguggaucacugcuuuuaucagguggguguacaaaaagauggucgcccggguugcagacaacauuaaccaggugaaucgagagauaggcuggauggaaggugggcaacuggcucuuggcaaccccgccccuaucccacgccacgcgcccauuccuagauauagcaccuacuugaugcugcuccugaucauuuccuaugccucagcuuguagcgagcuuauccaggcaucuuccaggauaacaacuugcaguaccgagggagugaauacaaagugucggcugagcggcaccgccuugauccgcgcugggucuguaggagccgaagcaugccucaugcugaaaggugucaaggaggaucagacuaaauucuuaaagauuaaaacgguguccucagaacugaguugcagagagggccagagcuacuggacagggucguuuuccccaaagugucuaucuagcaggcguugccaucucguuggagaaugucacgugaaccggugccugucauggcgagacaaugagaccagugcggaguucuccuuugucggcgaaucuacuaccaugagagagaacaaguguuucgaacaaugcgguggguggggcuguggaugcuuuaaugugaaccccagcugucuuuucguucacacauauuugcaguccgugaggaaagaggcccugcgcguauuuaauugcaucgauuggguccauaagcucacccuggaaauuacugacuucgauggcucagugagcacaaucgacuuaggggcuaguucuucccgguuuacgaacuggggaagcgugucgcugucacuugaugccgagggcauaucugguaguaauuccuucagcuucauugagucuccggggaaaggauacgcaaucgucgacgaaccuuuuagcgagauuccaagacagggcuucuugggugaaaucagguguaacuccgagucaaguguucucagcgcucacgaaucuugccugcgcgcccccaaucuaauauccuauaagccuaugaucgaucagcuggagugcaccacuaaccucauugaccccuuugugguauucgagcgaggcucacugccacaaacacggaaugauaaaaccuuugcagccaguaaggggaaccguggagugcaggcuuucagcaagggcuccguccaggcggaccuuacauugauguuugacaacuucgaaguggauuuuguuggggccgcagugucuugugacgcugccuuccugaauuuaacuggaugcuacucguguaacgccggcgcuagagucugccucagcaucaccucaacggguaccgggacacuguccgcacauaauaaagauggaagucuucacauugugcugccuucugagaacggcacuaaggaccaaugucagaucuugcauuuuaccguucccgaaguggaggaggaguucauguacagcugcgauggugacgagaggccacuccuggucaaaggcacacuaauagccauugauccguuugacgaucgccgggaagcugggggagaguccacuguagugaauccuaagucaggcucuuggaacuucuucgacugguuuagcgggcugaugaguugguucggaggcccccucaaaaccauccugcuuaucuguuuguauguugcgcuguccauugguuuauuuuuccuccugaucuaccuugggagaacgggacugagcaagauguggcuagccgcaacaaagaaagccucuuga

SEQ ID NO: 11134 - RNA, 3594 nt, Artificial Sequence
  derived and/or modified CDS sequence (opt3) from RVFV(2007002445)__EU574037.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaggaacuguccugcucugugucggggauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaagaauaguaaaaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugacauaggcguccauauggcucacgaugaccaaucggugagcuccaagauuguugcccauugcccaccccaggacccuugucuugugcacgggugcaucgucugugcacacggacugaucaauuaucagugccauacagcguugucagcuuucgugguaauuuuuguguucaguucuacugccaucauuugucucgcaguucuguacagagucuuaaaaugccugaagauagccccaaggaaagugcuaaacccgcucauguggaucaccgcuuuuauucgguggguguacaagaaaauggucgcccgaguugcagauaacaucaaucaggugaaccgcgagaucggcuggauggaaggugggcaacuggcucuuggcaaucccgccccuauuccaagacacgcgcccauaccuagguauagcacauacuugaugcugcuccugaucguguccuaugccucagcuuguagcgagcuuauucaggcaucuucccggaucacuaccugcaguacagagggaguaaacaccaagugucgccugagcggcacugccuugauuagagcugggucugucggagccgaagcaugccucaugcugaagggugugaaagaggaccagacgaaguucuuaaaaaucaagacaguuuccucagaacugaguugcagggagggccagagcuacuggaccgggucguuuuccccaaaaugucuaucuagccgucggugccaucucgugggagaaugucacgucaaucgaugccugucauggagagauaacgagacuuccgcggaguucuccuuugugggcgaaucuaccacaaugagggagaauaaguguuucgaacaaugcgguggguggggcuguggaugcuuuaacguuaaucccagcugucuuuucgugcacaccuauuugcaguccguacgcaaggaggcccugcgggucuuuaacugcauagacugggugcauaaacucacucuggaaaucacagauuucgacggcucagugagcacgauugauuuaggggcuaguucuuccagauuuaccaauuggggaagcgucucgcugucacuugacgccgagggcaucucugguaguaacuccuucagcuucauugagucuccggggaagggauacgcaaucguugaugaaccuuuuagcgagauaccaaggcagggcuucuugggugaaauucgcuguaauuccgagucaagugugcucagcgcucacgaaucuugccugcgagcccccaaccuaguauccuauaaaccuaugaucgaccagcuggagugcacuacaaaucucauugaucccuuuguggucuucgagcggggcucacugccacaaacccguaacgaaaagacauuugcagccaguaaagggaacagaggagugcaggcuuucagcaagggcuccauccaggcggaccuuacuuugauguuugauaauuucgagguugacuuugugggggccgcagucucuugugacgcugccuuccugaacuuaaccggaugcuacucguguaaugccggcgcuagggugugccucagcauaacgucaaccgguacagggacucuguccgcacauaacaaggauggaagucuucacaucguucugccuucugaaaauggcaccaaagaccaaugucagauuuugcauuuuacagugcccgaggucgaggaagaguucauguacagcugcgauggugacgaacgcccacuccugguaaagggcacucuaaucgccauugauccguuugacgaucggagagaggcgggaggagaauccaccgugguuaacccuaaaucaggcucuuggaauuucuucgacugguuuagcgggcugaugaguugguucggaggcccccucaagacgauccugcuuauauguuuguauguggcucuguccauugguuuauuuuuccuccugaucuaccuugggaggacaggacugagcaaaauguggcuagccgcaaccaagaaggccucuuga

SEQ ID NO: 11135 - RNA, 3594 nt, Artificial Sequence
  derived and/or modified CDS sequence (opt3) from RVFV(2008/00101)__HE687306.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggggauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaagaauaguaaaaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugacauaggcguccauauggcucacgaugaccaaucggugagcuccaagauuguugcccauugcccaccccaggacccuugucuugugcacgggugcaucgucugugcacacggacugaucaauuaucagugccauacagcguugucagcuuucgugguaauuuuuguguucaguucuacugccaucauuugucucgcaguucuguacagagucuuaaaaugccugaagauagccccaaggaaagugcuaaacccgcucauguggaucaccgcuuuuauucgguggguguacaagaaaauggucgcccgaguugcagauaacaucaaucaggugaaccgcgagaucggcuggauggaaggugggcaacuggcucuuggcaaucccgccccuauuccaagacacgcgcccauaccuagguauagcacauacuugaugcugcuccugaucguguccuaugccucagcuuguagcgagcuuauucaggcaucuucccggaucacuaccugcaguacagagggaguaaacaccaagugucgccugagcggcacugccuugauuagagcugggucugucggagccgaagcaugccucaugcugaagggugugaaagaggaccagacgaaguucuuaaaaaucaagacaguuuccucagaacugaguugcagggagggccagagcuacuggaccgggucguuuuccccaaaaugucuaucuagccgucggugccaucucgugggagaaugucacgucaaucgaugccugucauggagagauaacgagacuuccgcggaguucuccuuugugggcgaaucuaccacaaugagggagaauaaguguuucgaacaaugcgguggguggggcuguggaugcuuuaacguuaaucccagcugucuuuucgugcacaccuauuugcaguccguacgcaaggaggcccugcgggucuuuaacugcauagacugggugcauaaacucacucuggaaaucacagauuucgacggcucagugagcacgauugauuuaggggcuaguucuuccagauuuaccaauuggggaagcgucucgcugucacuugacgccgagggcaucucugguaguaacuccuucagcuucauugagucuccggggaagggauacgcaaucguugaugaaccuuuuagcgagauaccaaggcagggcuucuugggugaaauucgcuguaauuccgagucaagugugcucagcgcucacgaaucuugccugcgagcccccaaccuaguauccuauaaaccuaugaucgaccagcuggagugcacuacaaaucucauugaucccuuuguggucuucgagcggggcucacugccacaaacccguaacgacaagacauuugcagccaguaaagggaacagaggagugcaggcuuucagcaagggcuccguucaggcggaucuuacuuugauguuugacaauuucgaaguggacuuugucggggccgcagugucuugugaugcugccuuccugaacuuaaccggaugcuacucguguaaugccggcgcuaggguuugccucagcaucacgucaaccgguacagggacucuguccgcacauaacaaggacggaagucuucacauagugcugccuucugagaauggcaccaaagaucaaugucagaucuugcauuuuacaguccccgaaguagaggaggaguucauguacagcugcgacggugaugagcgcccacuccuggugaagggcacucuaauugccaucgacccguuugaugaccggagagaagcgggaggagaguccaccguugugaacccuaaaucaggcucuuggaauuucuucgauugguuuagcgggcugaugaguugguucggaggcccccucaagacgacacugcuuauuuguuuguaugucgcucuguccaucgguuuauuuuuccuccugauauaccuugggaggaccggacugagcaaaauguggcuagccgcaacuaagaaggccucuuga

SEQ ID NO: 11136 - RNA, 3594 nt, Artificial Sequence
  derived and/or modified CDS sequence (opt3) from RVFV(Hv-B375)__DQ380218.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaaggagagaugccugaggaacuguccugcucuauuucggguauccgcgaggugaagaccucaagccaggaacuauaucgagcacucaaagccauuaucgcggcugacggccugaauaacauaacaugucacgggaaggauccagaggacaaaaucagucuuauuaagggaccgccccauaaaaagcgugucggcaucgugagaugcgagaggcggcgcgaugccaagcaaauugguagagaaacuauggcagggaucgccaugaccguucugccugcuuuggcaguguuugcccucgcuccagucguguucgccgaggacccccaccugaggaaucggccuggaaaaggccauaacuacauagauggcaugacacaggaagacgcgaccuguaagccaguaacuuaugcaggggccugcuccucuuuugauguucugcucgagaaaggaaaguuccccuuauuucagagcuacgcucaccaucgcacacugcuugaagccgugcacgacaccauuaucgcaaaagcugauccuccauccugugacuugcagucagcccacgguaauccgugcaugaaggagaagcuggucaugaaaacgcauugucccaacgauuaucaaagugcgcacuaccuaaauaacgacggcaagauggccagcgugaaaugcccuccaaagaaugagcucacugaagacuguaacuucugccgacagaugaccggggcaucucugaaaaagggauccuauccccuucaggaucuguuuugccagucaagcgaggacgauggcaguaaauugaagacaaagaugaaaggugugugugaagucgggguucaagcucucaagaaaugcgacggacagcugucuacugcccaugaggugguaccuuucgcuguguuuaaaaauuccaagaaggucuacuuagauaagcuggaccucaaaaccgaagagaaccuucugccagauagcuucguguguuuugagcacaagggccaguacaaaggcacaauggacucggggcagaccaagagagaauugaaaucuuucgauauuucccaaugccccaagaucggaggucacggcucaaagaaauguacgggggacgccgcauuuugcagugccuaugaguguacugcucaguacgcgaaugcauauugcagccaugccaacggauccggcaucguucagauucaagugucuggugucuggaagaaaccgcuaugugugggguacgaaaggguaguugugaagcgggagcugagcgcuaaaccuauacagcgugucgaacccugcacaaccuguaucacuaagugcgagccacacggccucgugguccgcucaacaggauucaagauuaguuccgccguggcaugcgccagcggcguuugugugaccgggucucagucaccuaguacggagaucacccugaaauaucccggaauaagccaguccucugguggcgauauugggguacauauggcucacgacgaccaaucggucagcuccaagaucguggcccauugcccaccccaggauccuugucuuguucacggaugcaucgugugugcacacggccugauuaauuaccagugccauacagcguugucagcuuucgucgugguauuuguguucaguucuaucgccauuauaugucucgcaauccuguauagaguuuuaaaaugccugaagauugccccaaggaaaguccuaaacccgcucauguggaucacugcuuuuauccgguggguguacaagaaaaugguggcccgagucgcagacaacauuaaucagguuaaccgcgaaauagguuggauggaagggggccaacuggugcuuggaaaucccgcuccuaucccaagacacgcccccauuccuagguacagcaccuauuugaugcugcuccugaucguguccuacgcgucagccuguagcgagcuuauucaggcuucuucccggaucacaacuugcaguaccgagggcguaaacacaaagugucgccugagcgggaccgcauugauaagagccggaucugucggugcugaggccugccucaugcugaagggcgugaaagaagaucagacuaaguucuuaaaaaucaagacgguuuccucagagcugaguugcagggaagggcagagcuauuggacaggaucguuuuccccaaaaugucuaucuagccgucggugccaucucgugggcgagugucacgucaaucgaugccugucauggagagacaacgaaaccagugcagaguucuccuuugugggugagucuacuaccaugagggaaaauaaguguuucgagcaaugcgggggcuggggauguggcugcuuuaacguuaaucccagcugucuuuucgugcacacauacuugcaguccguacgcaaggaagcgcugcgggucuuuaacugcauugauugggugcauaaacucacccuggagaucacugacuucgaugggucagugagcacaauugacuuaggagccaguucuuccagauuuacgaauuggggcagcgucucgcugucacuugaugcugaagguaucucugggaguaacuccuucagcuucauagagucuccgggaaagggcuaugccauuguugacgagccuuuuagcgaaaucccaaggcaggguuucuugggcgagauucgcuguaauuccgaaucaagugugcucagcgcacacgagucuugccugcgagcucccaaccuaaucuccuacaaaccuaugauagaucagcuggaaugcaccacuaaucucaucgaccccuuuguaguguucgagcgggggucacugccacaaacacguaacgauaagaccuuugccgcaaguaaaggaaacagaggcguccaggccuucagcaagggguccgugcaggcugaccuuacauugauguuugacaauuucgagguugauuuugugggagcggccgucucuugugacgcagcuuuccugaacuuaacuggcugcuauucguguaaugccggugccagggugugccucagcauuaccucaacggggaccggaacacuguccgcucauaacaaggauggcagucuucacaucguucugccuucugaaaaugguacuaaagaccaaugucagauuuugcauuuuaccgugcccgaggucgaagaggaguucauguacagcugcgauggcgacgaacgcccacuccugguaaaggggacacuaaucgcaauagauccguuugacgaucggagagaggccggaggcgaauccacugugguuaacccuaaaucagggucuuggaauuucuucgacugguuuagcggacugaugaguugguucggcgguccccucaagaccauucugcuuaucuguuuguacguggcgcuguccaucggguuauuuuuccuccugauuuaucuuggaaggacgggccugagcaaaauguggcuagcugccacaaagaaggcaucuuga

SEQ ID NO: 11137 - RNA, 3594 nt, Artificial Sequence
  derived and/or modified CDS sequence (opt3) from RVFV(763/70)__DQ380188.1__GP
auguacgugcugcucaccauccuuauuacaguccugguuugcgaggccgugauaagaguaagccuguccucuacuagggaagagacguguuucggcgacucaaccaaccccgaaaugaucgagggggcuugggauaguuuacgggaagaggagaugccugaagaguugagcugcuccauuucuggaauccgcgaagugaagacaucgucacaggagcuauaucgagcacucaaagccauuaucgcggcugacggucugaauaacauaacuugucacggcaaggauccagaggacaaaaucagccuugucaaggggccgccccauaaaaagcgugugggaauuguuagaugcgaaaggcggcgcgaugccaagcaaaucggcagagagaccauggcagguauugccaugacagugcugccugcuuuggcagucuuugcccucgcuccagugguauucgccgaagacccccaccugaggaaucggccugggaaaggacauaacuacaucgauggcaugacccaggaggacgcgacuuguaagccaguuacauaugcaggcgccugcaguuccuuugaugugcugcucgaaaaagggaaguuccccuuauuucagucuuacgcucaccaucgcacccugcuugaggccguccacgacacgauaauugcaaaagcugauccuccaagcugugacuugcaguccgcccacggaaauccgugcaugaaggagaagcuggugaugaaaacucauugucccaacgauuaucaaucagcgcacuaccuaaauaacgacgguaagauggccagugugaaaugcccuccaaaguauggccucaccgaagacuguaauuucugccgacagaugacaggggcaagccugaaaaagggaucuuacccccuucaggaucuguuuugccaguccucagaggacgauggcagcaaauugaagacuaagaugaaaggugucugugaaguuggggugcaagcucucaagaaaugcgacggacagcugaguaccgcccaugagguagugccuuucgcugucuuuaagaacucuaaaaagguguacuuagauaagcuggaccucaaaacagaagagaaucuucugccagauuccuucguuuguuuugagcacaagggccaguauaaaggcaccauggacagcgggcagacgaagagagaauugaaaucguucgauaucucucaaugccccaagauuggaggucacggcuccaagaaauguacuggggacgccgcauuuugcucagccuacgaguguacagcucaguaugcgaacgcauacugcagucaugccaauggaagcggcaucgugcagauccaagucuccgguguguggaagaaaccgcuauguguaggguaugaaaggguuguggucaagcgggagcugucugcuaaaccuauucagcguguggaacccugcaccacuuguauaacaaagugcgagccacacggccucgucgugcgcagcaccggauucaagaucucaagugccguugcaugcgccuccggcguguguguaacggggagccagucuccuucaaccgagauuacacugaaauaccccggaaucagucagagcuccgguggcgauauagggguccauauggcucacgacgaccaaucugugucgagcaagauuguugcccauugcccaccccaggauccuugucuugugcacggaugcaucgucugugcacacggccugaucaacuaucagugccauacugcguuguccgcuuucgugguaguguuuguuuucucaagugucgccauuaucugucucgcaauucuguacaaaguguuaaagugccugaaaauagccccaagaaaggugcuaaauccgcucauguggaucaccgcuuuuauuaggugggucuacaaaaagaugguugcccggguggcagacaacaucaaccaggugaaucgagaaaucgguuggauggagggaggccaacuggcucuuggaaaccccgccccuauuccacgccacgcgcccauaccuagauauucuacauacuugaugcugcuccugaucguaagcuaugccuccgcuuguucagaacuuauucaggcaagcucuaggaucacuaccugcuccacagagggcgucaauaccaagugucggcugagugggacugccuugauucgcgcuggaagcgugggugccgaggcaugccucaugcugaaaggcguuaaggaagaucagacgaaauucuuaaagaucaaaacagugucuuccgagcugucaugcagagaagggcagaguuacuggaccgggagcuuuucgccaaagugucuauccucuaggcguugccaucucgucggcgagugucacgugaaccggugccugagcuggcgagacaaugaaacuucagcggaguucaguuuuguuggugaguccaccacaaugagagaaaacaaguguuucgagcaaugcgggggcuggggauguggcugcuuuaaugugaaccccucuugucuuuucguacacaccuauuugcagagcgucaggaaagaagcccugcgcguguuuaauugcauagauugggugcauaagcucacucuggagaucacagacuucgauggguccgucucaacgauugacuuaggagcuagcaguucucgguuuaccaacuggggcuccguuagccugucgcuugaugccgaagguaucucagggucuaauaguuucuccuucauugagagcccgggaaaaggcuacgcaaucguggacgagccuuuuucugaaauaccaagacaggguuucuugggcgagauuagguguaacagcgaauccucaguacucagugcucacgagagcugccugcgcgcccccaaucuaaucucuuauaagccuaugauugaucagcuggaaugcacuacaaaccucaucgaccccuuuguggucuucgagcgagggucccugccacaaacccggaaugauaaaacauuugcagccucaaagggaaaccguggcgugcaggcuuucaguaaggggagcguucaggcggaccuuacuuugauguuugacaacuucgagguggauuuugucggagccgcaguguccugugacgcugccuuccugaauuuaaccggcugcuacucuuguaacgccggugcuagaguuugccucucgauaacgagcaccgggacaggaacucugucagcacauaauaaagauggcucccuucacaucgugcugccuagugaaaacgguaccaaggaccaaugucagauuuugcauuuuacaguccccgagguagaagaggaguucauguacucuugcgauggcgacgaaaggccacuccuggugaaagggacucuaaucgccauugauccguuugacgaucgccgggaggcgggaggcgaaagcaccguugugaauccuaaguccgggucauggaacuucuucgacugguuuucuggacugaugagcugguucggcgguccccucaaaacgauccugcuuauauguuuguaugucgcucugaguauuggguuauuuuuccuccugaucuaccuuggaagaacaggccuguccaagauguggcuagccgcaaccaagaaagccagcuga

SEQ ID NO: 11138 - RNA, 3594 nt, Artificial Sequence
  derived and/or modified CDS sequence (opt3) from RVFV(RVFBJ01/2016)__KX785331.1__GP
auguacgugcugcucaccauccuuauuagcguccugguuugcgaggccauaaucagaguguccuugucuucaacaagggaagagacuuguuucggcgacaguacgaaccccgaaaugauugagggggcuugggauagcuuacgggaagaggagaugccugaagaacuguccugcucuaucucggggauucgcgaaguaaagaccucaagccaggagcuauaucgagcacucaaagccaucauagcggcugacggucugaauaacaucacaugucacggcaaggauccagaggacaaaauuagucuuaucaaggggccgccccauaaaaagcgugugggaauugucagaugcgaaaggcggcgcgaugccaagcaaaucggcagagagacuauggcagguauagccaugaccgugcugccugcuuuggcaguuuuugcccucgcuccaguggucuucgccgaagacccccaccugaggaaucggccugggaaaggacauaacuacauugauggcaugacacaggaggacgcgaccuguaagccagugacuuaugcaggcgccugcuccucuuuugauguacugcucgaaaaagggaaguuccccuuauuucagagcuacgcucaccaucgcacacugcuugaggccguucacgacaccaucauugcaaaagcugauccuccauccugugacuugcagucagcccacggaaauccgugcaugaaggagaagcuggugaugaaaacgcauugucccaacgauuaucaaagugcgcacuaccuaaauaacgacgguaagauggccagcgucaaaugcccuccaaagcaugaacucacugaggacuguaauuucugccgacagaugaccggcgcaucucugaaaaagggguccuauccccuucaggaucuguuuugccagucaagcgaagacgauggaaguaaauugaagacaaagaugaaaggcgugugugagguggguguccaagcucucaagaaaugcgacgggcagcugucuacugcccacgaaguugugccuuucgcuguauuuaagaacuccaaaaagguguacuuagauaagcuggaccucaaaaccgaggagaaucuucugccagauagcuucgucuguuuugaacacaagggacaguacaaaggcacaauggacucgggccagaccaagagagaguugaaaucuuucgauaucucccaaugccccaagaucgggggacaugguucaaagaaauguacgggcgacgccgcauuuugcagugccuaugaauguacugcucaguacgcgaacgcauauugcagccacgccaauggguccggaauugugcagauacaaguuucuggcguguggaagaaaccgcuaugugucgguuacgagagggugguaguuaagcgggaacugagcgcuaaaccuauccagcguguggagcccugcacaaccuguauuacuaagugcgagccacaugggcucgucgugcgcucaacaggcuucaagaucaguuccgccgucgcaugcgccagcggaguguguguuaccggcucucagucaccuaguacggaaauaacccugaaauaucccgggauuagccaguccucuggaggugauaucggcgugcacauggcucaugacgaccaaucgguaagcuccaagaucgucgcccacugcccaccccaggauccuugucuugugcacgggugcauuguuugugcacauggacugaucaacuaccagugccacacagcguugucagcuuucguggucguguuuguauucaguucuguggccauuauaugucucgcaauccuguauaaaguuuuaagaugccugaagauugccccgaaaaagguccuaaauccacucauguggaucacugcuuuuaucagguggguguacaaaaagaugguggcccgggucgcagacaacauuaaccagguuaaucgagagauaggcuggauggaaggugggcaacuggcucuuggcaaccccgccccuaucccacgccaugcgcccauuccuagauacagcaccuauuugaugcugcuccugaucauuuccuacgccucagcuuguagcgagcuuauccaggcaucuuccaggauaacaacuugcaguaccgagggagugaauacaaagugucggcugagcggcaccgccuugauccgcgcugggucugugggagccgaagcaugccucaugcugaaagguguaaaggaggaucagacuaaauucuuaaagauuaaaacggucuccucagaacugaguugcagagagggccagagcuauuggacagggucguuuuccccaaagugucuaucuagcaggcguugccaccucgugggagaaugucacguuaaccggugccugucauggcgagacaaugagaccagugcggaguucuccuuugugggcgaaucuacuaccaugagagagaacaaguguuucgaacaaugcgguggguggggcuguggaugcuuuaaugucaaccccagcugucuuuucgugcauacauacuugcaguccguuaggaaagaggcccugcgcguguuuaauugcaucgauuggguacacaagcucacccuggaaauuacugacuucgauggcucagucagcacaaucgacuuaggggcuaguucuucccgguuuacgaacuggggaagcgugucgcugucacuugaugccgagggcauaucugguaguaauuccuucagcuucauugagucuccggggaaaggauaugcaaucguggacgaaccuuuuagcgagauuccaagacagggcuucuugggugaaaucagguguaacuccgagucaaguguccucagcgcucaugaaucuugccugcgcgcccccaaucuaauauccuacaagccuaugaucgaucagcuggagugcaccacuaaccucauugaccccuuuguuguguucgagcgaggcucacugccacaaacacggaaugauaaaaccuuugcagccaguaaggggaaccguggaguacaggcuuucagcaagggcuccgugcaggcggaccuuacauugauguuugacaacuucgaagucgauuuugugggggccgcaguuucuugugacgcugccuuccugaauuuaacuggaugcuauucguguaacgccggcgcuagagugugccucagcaucaccucaacggguaccgggacacuguccgcacacaauaaagauggaagucuucauauuguccugccuucugagaacggcacuaaggaccaaugucagaucuugcacuuuaccgugcccgaaguugaggaggaguucauguacagcugcgauggugacgagaggccacuccuggugaaaggcacacuaauagccauugauccguuugacgaucgccgggaagcgggaggagaguccacugucguaaauccuaagucaggcucuuggaacuucuucgacugguuuagcgggcugaugaguugguucggaggcccccucaaaaccauccugcuuaucuguuuguacguggcucuguccauugguuuauuuuuccuccugaucuaucuugggagaacgggacugagcaagauguggcuagccgcaacaaagaaagccucuuga

SEQ ID NO: 11139 - RNA, 3594 nt, Artificial Sequence
  derived and/or modified CDS sequence (opt3) from RVFV(Lunyo)__KU167026.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcacaaugguuucgggccagaccaagagagaguugaaaucuuucgacauuucccaaugccccaagaucgggggacacgguucaaagaaauguacgggcgaugccgcauuuugcagugccuacgaauguacugcucaguaugcgaacgcauacugcagccaugccaauggguccggaaucgugcagauucaagucucuggcguguggaagaaaccgcuauguguagguuaugagaggguuguggucaagcgggaacugagcgcuaaaccuauacagcguguggagcccugcacaaccuguaucacuaagugcgagccacacgggcucgucgugcgcucaacaggcuucaagauuaguuccgccguugcaugcgccagcggaguguguguaaccggcucucagucaccuaguacggaaaucacccugaaauaccccgggauaagccaguccucuggaggugacauuggcguccauauggcucacgaugaccaaucggugagcuccaagaucguugcccauugcccaccccaggacccuugucuugugcacgggugcaucgucugugcacacggacugauuaacuaucagugccauacagcguugucagcuuucgugguaguguuuguuuucaguucugucgccaucauuugucucgcaauacuguacaaaguguuaaagugccugaaaaucgccccaagaaaggugcuaaauccgcucauguggauuacugcuuuuaucaggugggucuacaaaaagaugguugcccggguggcagauaacaucaaccaggugaaucgagagauuggcuggauggaaggugggcaacuggcucuuggcaaccccgccccuauaccacgccacgcgcccaucccuagauauagcaccuacuugaugcugcuccugauuguauccuaugccucagcuuguagcgagcuuauccaggcaucuuccaggauuacaacuugcaguaccgagggagucaauacacggugucgccugagcggcaccgccuugaucagagcugggucugugggagccgaagcaugccucaugcugaaggguguuaaagaggaccagacuaaguucuuaaaaauaaagacgguguccucagaacugaguugcagggagggccagagcuacuggacagggucguuuuccccaaaaugucuaucuagccgucggugccaucucgucggagaaugucacgugaaccgaugccugucauggagagauaaugagaccagugcggaguucuccuuuguuggcgaaucuacuaccaugagggagaacaaguguuucgaacaaugcgguggguggggcuguggaugcuuuaaugugaaccccagcugucuuuucguacacacauauuugcaguccguccgcaaggaggcccugcggguguuuaauugcaucgacugggugcauaaacucacccuggaaauuacugauuucgacggcucagucagcacaaucgauuuaggggcuaguucuuccagauuuacgaacuggggaagcguuucgcugucacuugacgccgagggcauuucugguaguaauuccuucagcuucaucgagucuccggggaagggauacgcaauaguggaugaaccuuuuagcgagauuccaaggcagggcuucuugggugaaauccgcuguaacuccgagucaaguguacucagcgcucacgaaucuugccugcgagcccccaaucuaauuuccuauaaaccuaugaucgaccagcuggagugcaccacuaaccucauagaucccuuuguggucuucgagcggggcucacugccacaaacacguaaugacaagaccuuugcagccaguaaagggaacagaggagugcaggcuuucagcaagggcuccguucaggcggaucuuacauugauguuugacaacuucgaaguggacuuugucggggccgcagugucuugugaugcugccuuccugaauuuaacuggaugcuacucguguaacgccggcgcuaggguuugccucagcaucaccucaacggguaccgggacacuguccgcacauaauaaggacggaagucuucacauugugcugccuucugagaacggcacuaaagaucaaugucagaucuugcauuuuaccguccccgaaguagaggaggaguucauguacagcugcgacggugaugagcgcccacuccuggugaagggcacacuaauugccaucgacccguuugaugaccggagagaagcugggggagaguccacuguugugaauccuaaaucaggcucuuggaacuucuucgauugguuuagcgggcugaugaguugguucggaggcccccucaagaccauacugcuuauuuguuuguaugucgcgcuguccaucgguuuauuuuuccuccugaucuaccuugggaggacgggacugagcaaaauguggcuagccgcaacaaagaaggccucuuga

SEQ ID NO: 11140 - RNA, 3594 nt, Artificial Sequence
  derived and/or modified CDS sequence (opt3) from RVFV(2007000234)__JF326191.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggggauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaauuguuagaugcgaaaggcggcgcgacgccaagcaaaucagaagggagacuauggcaggcauugccaugaccgugcugccugcuuuggcagucuuugcccucgcuccagugguauucgccgaagauccccaucugcggaaccgcccugguaaagggcacaauuacaucgacggaaugacacaggaggaugcgaccuguaagccaguuacuuaugcaggcgccugcuccucuuuugacgugcugcucgaaaaaggcaaguuccccuuauuucagagcuacgcucaccaucgaacacugcuugaggccguccacgauaccauaauugcaaaagcugacccuccauccugugauuugcagucagcccacgggaacccgugcaugaaggagaagcuggugaugaaaacgcauugucccaaugacuaucaaagugcgcacuaccuaaacaaugauggaaagauggccagcgugaaaugcccuccaaaguaugaacucacugaggacuguaacuucugcagacagaugaccggugcaucucugaaaaagggcuccuacccccuucaggaccuguuuugccagucaagcgaagaugacgggaguaaauugaagacaaagaugaaaggagucugugagguuggcgugcaagcucucaagaaaugcgauggucagcugucuacugcccaugaaguagugccuuucgcugucuuuaagaauaguaaaaagguguacuuagacaagcuggaucucaaaaccgaggagaaccuucugccagacagcuucguuuguuuugaacacaaggggcaguauaaaggaacaauggauucgggccagaccaagagggaguugaaaucuuucgacaucucccaaugccccaagauuggcgggcacggaucaaagaaauguacgggugaugccgcauuuugcagugccuacgaauguacugcucaguaugcgaaugcauacugcagccaugccaacggcuccgggaucgugcagauccaagucucuggaguguggaagaaaccgcuauguguaggcuaugagcggguuguggucaagcgugaacugagcgcuaaaccuauucagcgcguggagcccugcacaaccuguauaacuaagugcgagccacacggucucgucgugagaucaacaggguucaagaucaguuccgccguugcaugcgccagcggcguguguguaaccggaucucagucaccuaguacggaaauuacccugaaauaccccggcaucagccaguccucugggggagacauagguguccauauggcucacgaugaccaaucggugagcuccaagauuguugcccauugcccaccccaggacccuugucuugugcacggcugcaucgucugugcacacgggcugaucaauuaucagugccauacagcguugucagcuuucgugguaauuuuuguguucaguucuacugccaucauuugucucgcaguucuguacagggucuuaaaaugccugaagauagccccacggaaagugcuaaacccgcucauguggaucaccgcuuuuauucgauggguguacaagaaaauggucgcccgcguugcagauaacaucaaucaggugaacagagagaucggauggauggaaggcggucaacuggcucuugggaaucccgccccuauuccaaggcacgcgcccauaccucgguauagcacauacuugaugcugcuccugaucguguccuaugccucagcuuguagcgagcuuauucaggcaucuucccgcaucacuaccugcaguacagagggcguaaacaccaaguguagacugagcggaacugccuugauuagggcuggcucugucggggccgaagcaugccucaugcugaagggagugaaagaggaccagacgaaguucuuaaaaaucaagacaguuuccucagaacugaguugccgugagggucagagcuacuggaccggcucguuuuccccaaaaugucuaucuagccggcgaugccaucucgugggggaaugucacgucaauagaugccugucauggagggauaacgagacuuccgcggaguucuccuuugugggagaaucuaccacaaugcgcgagaauaaguguuucgaacaaugcggcgguuggggguguggcugcuuuaacguuaaucccagcugucuuuucgugcacaccuauuugcaguccguacggaaggaggcccugagagucuuuaacugcauagacugggugcauaaacucacucuggaaaucacagauuucgacggaucagugagcacgauugauuuaggcgcuaguucuuccagguuuaccaauugggggagcgucucgcugucacuugacgccgagggaaucucuggcaguaacuccuucagcuucauugagucuccggguaagggguacgcaaucguugaugaaccuuuuagcgagauaccacgccagggauucuugggcgaaauucgauguaauuccgagucaagugugcucagcgcucacgaaucuugccugcgggcccccaaccuaguauccuauaaaccuaugaucgaccagcuggagugcacuacaaaucucauugaucccuuuguggucuucgagcgugguucacugccacaaaccagaaacgacaagacauuugcagccaguaaaggcaacaggggagugcaggcuuucagcaagggauccguucaggcggaucuuacuuugauguuugacaauuucgaaguggacuuugucggcgccgcagugucuugugaugcugccuuccugaacuuaaccgggugcuacucguguaaugccggagcucgcguuugccucagcaucacgucaaccggcacagguacucuguccgcacauaacaaggacgggagucuucacauagugcugccuucugagaauggaaccaaagaucaaugucagaucuugcauuuuacaguccccgaaguagaggaggaguucauguacagcugcgacggcgaugagcggccacuccuggugaaggguacucuaauugccaucgacccguuugaugacagaagggaagcgggcggggaguccaccguugugaacccuaaaucaggaucuuggaauuucuucgauugguuuagcggccugaugaguugguucgggggaccccucaagacgauucugcuuaucuguuuguaugucgcucuguccauaggcuuauuuuuccuccugauuuaccuuggucgaacagggcugagcaaaauguggcuagccgcaaccaagaaggccucuuga

SEQ ID NO: 11141 - RNA, 3594 nt, Artificial Sequence
  derived and/or modified CDS sequence (opt3) from RVFV(KEN07-KUR340)__EF460404.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggggauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaagaauaguaaaaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugacauaggcguccauauggcucacgaugaccaaucggugagcuccaagauuguugcccauugcccaccccaggacccuugucuugugcacgggugcaucgucugugcacacggacugaucaauuaucagugccauacagcguugucagcuuucgugguaauuuuuguguucaguucuacugccaucauuugucucgcaguucuguacagaauguuaaaaugccugaagauagccccaaggaucguccuaaacccgcucauguggauuaccgcuuuuauccgguggguguacaaaaagaugguggcccgagucgcagauaacaucaaucagguuaaccgcgagauuggcuggauggaaggugggcaacuggcucuuggcaaucccgccccuauaccaagacacgcgcccaucccuagguauagcacauacuugaugcugcuccugauuguguccuaugccucagcuuguagcgagcuuauccaggcaucuucccggauuacuaccugcaguacagagggagugaacaccaaaugucgccugagcggcacugccuugaucagagcugggucuguaggagccgaagcaugccucaugcugaagggugucaaggaggaccagacgaaauucuuaaagauaaaaacaguguccucagaacugaguugcagggagggccagagcuacuggaccgggucguuuuccccaaagugucuaucuagccgucggugccaucucguuggagaaugucacgugaaucgaugccugucauggagagauaacgagacuuccgcggaguucuccuuugucggcgaaucuaccacaaugagggagaauaaauguuucgaacaaugcgguggguggggcuguggaugcuuuaacgugaaucccagcugucuuuucguucacaccuauuugcaguccgugcgcaaggaggcccugcggguauuuaacugcaucgacuggguccauaagcucacucuggaaauuacagauuucgacggcucagugagcacgaucgauuuaggggcuaguucuuccagauuuaccaauuggggaagcgugucgcugucacuugacgccgagggcauuucugguaguaacuccuucagcuucaucgagucuccggggaaaggauacgcaauagucgaugaaccuuuuagcgagauuccaaggcagggcuucuugggugaaauccgcuguaauuccgagucaaguguucucagcgcucacgaaucuugccugcgagcccccaaccuaguguccuauaagccuaugauugaccagcuggagugcacuacaaaucucaucgaucccuuuguaguguucgagcggggcucacugccacaaacccguaacgacaaaacauuugcagccaguaaggggaacagaggaguccaggcuuucagcaaaggcuccgugcaggcggaucuuacuuugauguuugacaauuucgaaguugacuuugugggggccgcagucucuugugaugcugccuuccugaacuuaaccggaugcuacucguguaaugccggcgcuagggugugccucagcauaacgucaaccgguacagggacucuguccgcacauaacaaggacggaagucuucacaucguucugccuucugagaauggcaccaaggaucaaugucagauuuugcauuuuacagugcccgaagucgaggaggaguucauguacagcugcgacggugaugagcgcccacuccugguaaaaggcacucuaaucgccauugacccguuugaugaccggagagaagcgggaggagaguccaccgugguuaacccuaagucaggcucuuggaauuucuucgauugguuuagcgggcugaugaguugguucggaggcccccucaaaacgauccugcuuauauguuuguauguggcucuguccauugguuuauuuuuccuccugaucuaccuugggaggacaggacugagcaagauguggcuagccgcaaccaaaaaggccucuuga

SEQ ID NO: 11142 - RNA, 3594 nt, Artificial Sequence
  derived and/or modified CDS sequence (opt3) from RVFV(2373/74)__DQ380194.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacauguuacggcaaggauccagaggacaaaaucagucuuauuaaggggccgccccacaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaucugaggaaucggccugggaaaggacacaacuauauagauggcaugacacaggaggacgcgaccuguaagccaguaacuuacgcaggcgccugcuccucuuuugauguucugcucgaaaaagggaaguuccccuuauuucagagcuaugcucaucaccgcacacugcuugaggccgugcaugacaccauuaucgcaaaagcugauccuccauccugugacuugcagucagcccacggaaauccgugcaugaaggagaagcuggucaugaaaacgcacugucccaacgauuaccaaagugcgcauuaucuaaauaacgacgguaagauggccagcgugaaaugcccuccaaaguacgaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccacgaagugguaccuuucgcuguguuuaagaacuccaaaaaggucuauuuagauaagcuggaccucaaaaccgaggagaaucuucugccagauagcuucguguguuuugaacauaagggacaguacaaaggcacaauggacucgggccagaccaagagagaguugaaaucuuucgauauuucccaaugccccaagaucgggggacacgguucaaagaaauguacgggcgacgccgcauuuugcagugccuaugaauguacugcucaguacgcgaacgcauauugcagccacgccaauggguccggaaucguucagauucaagugucuggcgucuggaagaaaccgcuauguguggguuacgagaggguaguugugaagcgggaacugagcgcuaaaccuauacagcgugucgagcccugcacaaccuguaucacuaagugcgagccacaugggcucgugguccgcucaacaggcuucaagauuaguuccgccguggcaugcgccagcggaguuugugugaccggcucucagucaccuaguacggaaaucacccugaaauaucccgggauaagccaguccucuggaggugauauuggcguacacauggcucaugacgaccaaucggucagcuccaagaugguggcccacugcccaccccaggauccuugucuuguucaugggugcaucgugugugcacacggacugaucaacuaccagugccacacagcguugucagcuuucgucgugguauuuguguucaguucuguugccauuaucugucucgcaauucuguacaaagucuuaaagugccugaaaauagccccaagaaaggugcuaaauccgcucauguggaucacugcuuuuauuagguggguguauaaaaagauggucgcccggguugcagacaacaucaaccaggugaaucgagagaucggcuggauggaaggugggcaacuggcucuuggcaaccccgccccuauuccacgccaugcgcccauaccuagauacagcaccuauuugaugcugcuccugaucguguccuacgccucagcuuguagcgagcuuauucaggcaucuuccaggaucacaacuugcaguaccgagggaguaaauacaaagugucggcugagcggcaccgccuugauucgcgcugggucugucggagccgaagcaugccucaugcugaaaggugugaaggaggaucagacuaaauucuuaaagaucaaaacgguuuccucagaacugaguugcagagagggccagagcuauuggacagggucguuuuccccaaagugucuaucuagcaggcguugccaccucgugggagaaugucaugucaaccggugccugucauggcgagacaaugagaccagugcggaguucuccuuugugggcgaaucuacuaccaugagagagaacaaguguuucgaacaaugcgguggguggggcuguggaugcuuuaauguuaaccccagcugucuuuucgugcacacauacuugcaguccguaaggaaagaggcccugcgcgucuuuaauugcauagauugggugcacaagcucacccuggaaaucacugacuucgauggcucagugagcacauuagaccugggggcuaguucuucccgguuuacgaacuggggaagcgucucgcuuucauuggaugccgagggcauuucugguaguaauuccuucagcuucaucgagucuccggggaaaggauaugcaauuguugacgaaccuuuuagcgagaucccaagacagggcuuccucggugaaauaagguguaacuccgagucaagugugcugagcgcucaugaaucuugccuacgcgcccccaaucugauuuccuacaagccuaugaucgaucagcucgagugcaccacuaaccugauugaccccuuuguaguguucgagcgaggcucacuuccacaaacacggaaugagaaaaccuuugcagccaguaaggggaaccguggaguccaggcuuucagcaagggcuccgugcaggcggauuugacacugauguuugacaacuucgagguugacuuugugggggccgcagucucuugugaugcugccuucuuaaaucucacuggaugcuacucguguaacgccggcgcuagagugugccugagcaucaccucaacggguaccgggacacuuuccgcacacaauaaagacggaagucugcauauaguuuugccuucugaaaacggcacuaaggaucaaugucagauccuccacuuuaccgugcccgaggucgaggaagaguucauguauagcugcgacggugaugaaaggccacugcuaguaaaaggcacacugauugccaucgacccguuugaugaccgccgggaggcugggggagaauccacugugguuaauccuaagucaggcucuuggaacuucuucgauugguuuagcgggcucaugaguugguucggaggcccccugaaaaccauucuuuugaucugucuguacguggcguuauccauaggucucuuuuuccugcuuauuuaucuggggagaacgggacuaagcaagauguggcucgccgcaacaaagaaagccucuuga

SEQ ID NO: 11143 - RNA, 3594 nt, Artificial Sequence
  derived and/or modified CDS sequence (opt3) from RVFV(200803169)__JF311384.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaggaacuguccugcucugugucggggauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaagaauaguaaaaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccgcuauguguagguuaugagaggguuguggucaagcgggaacugagcgcuaaaccuauucagcguguggagcccugcacaaccuguauaacuaagugcgagccacacgggcucgucgugcgcucaacaggcuucaagaucaguuccgccguugcaugcgccagcggaguguguguaaccggcucucagucaccuaguacggaaauuacccugaaauaccccgggaucagccaguccucuggaggugacauaggcguccauauggcucacgaugaccaaucggugagcuccaagauuguugcccauugcccaccccaggacccuugucuugugcacgggugcaucgucugugcacacggacugaucaauuaucagugccauacagcguugucagcuuucgugguaauuuuuguguucaguucuacugccaucauuugucucgcaguucuguacagagucuuaaaaugccugaagauagccccaaggaaagugcuaaacccgcucauguggaucaccgcuuuuauucgguggguguacaagaaaauggucgcccgaguugcagauaacaucaaucaggugaaccgcgagaucggcuggauggaaggugggcaacuggcucuuggcaaucccgccccuauuccaagacacgcgcccauaccuagguauagcacauacuugaugcugcuccugaucguguccuaugccucagcuuguagcgagcuuauucaggcaucuucccggaucacuaccugcaguacagagggaguaaacaccaagugucgccugagcggcacugccuugauuagagcugggucugucggagccgaagcaugccucaugcugaagggugugaaaguugaccagacgaaguucuuaaaaaucaagacaguguccucagagcugaguugcagggaaggccagagcuacuggaccgggucguuuuccccaaaaugucuaucuagccgucggugccaucucgucggagagugucacgugaaucgaugccugucauggagagauaacgaaacuuccgcggaguucuccuuuguuggcgagucuaccacaaugagggaaaauaaguguuucgagcaaugcgguggguggggcuguggaugcuuuaacgugaaucccagcugucuuuucguacacaccuauuugcaguccguccgcaaggaagcccugcggguguuuaacugcauagacugggugcauaaacucacucuggagaucacagauuucgacggcucagucagcacgauugauuuaggggcuaguucuuccagauuuaccaauuggggaagcguuucgcugucacuugacgccgaaggcaucucugguaguaacuccuucagcuucauugagucuccggggaagggauacgcaaucguggaugagccuuuuagcgaaauaccaaggcagggcuucuugggugagguacgcuguaauuccgaaucaagugugcucagcgcucacgagucuugccugcgagcccccaaccuagucuccuauaaaccuaugauugaccagcuggaaugcacuacaaaucucaucgaucccuuugugguuuucgagcggggcucacugccacaaacccguaacgacaagacauuugcagccaguaaagggaacagaggagugcaggcuuucagcaagggcuccguccaggcggaucuuacuuugauguuugacaauuucgagguggacuuuguuggggccgcagugucuugugaugcugccuuccugaacuuaaccggaugcuacucguguaaugccggcgcuagggucugccucagcauuacgucaaccgguacagggacucuguccgcacauaacaaggacggaagucuucacaucguacugccuucugaaaauggcaccaaagaucaaugucagauauugcauuuuacagugcccgagguugaagaggaguucauguacagcugcgacggugaugaacgcccacuccuggugaagggcacucuaaucgccauugacccguuugaugaccggagagaggcgggaggagaauccaccgucgugaacccuaaaucaggcucuuggaauuucuucgauugguuuagcgggcugaugaguugguucggaggcccccucaagacgauccugcuuauuuguuuguauguagcucuguccaucgguuuauuuuuccuccugauauaccuugggaggacaggacugagcaaaauguggcuagccgcaaccaagaaggccucuuga

SEQ ID NO: 11144 - RNA, 3594 nt, Artificial Sequence
  derived and/or modified CDS sequence (opt3) from RVFV(200803167)__JF311382.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaggaacuguccugcucugugucggggauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagaucugcaccugaggaaccggcccgggaaaggacauaauuacaucgacggcaugacacaggaggaugcgaccuguaagccuguuacuuaugcaggcgccugcuccucuuuugacgugcucuuagaaaaagggaaguucccacuguuucagagcuacgcucaccaucgcacacuuuuggaggccguccacgauaccauaauugcaaaagcugaucccccuuccugugaccugcagucagcccacggaaacccaugcaugaaggagaagcuagugaugaaaacgcauuguccgaaugacuaucaaagugcgcacuaccucaacaaugaugguaagauggccagcgugaaaugucccccuaaguaugaacugacugaggacugcaacuucugccgacagaugaccggcgcaucucuuaaaaagggguccuacccacugcaggacuuguuuugccagucaagcgaagaugacggaaguaaacucaagacaaagaugaaaggcgucugugagguuggugugcaagcucugaagaaaugcgaugggcaguuaucuacugcccaugaaguagugcccuucgcugucuuuaaaaauuccaagaagguguaccuggacaagcucgaucuuaaaaccgaggagaaccuguugccugacagcuucguuuguuuugaacacaagggacaguauaaaggcacaauggauucgggccagaccaagagagagcuaaaaucuuucgacaucucccaaugcccaaagauugggggacacgguucaaagaaauguacgggcgaugccgcauuuugcagugccuacgaauguacugcucaguaugcgaaugcauacugcagccaugccaacggguccggaaucgugcagauccaagucucuggcguguggaagaaaccccuguguguagguuaugagaggguuguggucaagcgggaacucagcgcuaaaccgauucagcguguggagccuugcacaaccuguauaacuaagugcgagccccacgggcuggucgugcgcucaacaggcuucaagaucaguuccgccguugcaugcgccagcggaguguguguaaccggcucucagucaccaaguacggaaauugcucuuaaauacccugggaucagccaguccucuggaggugacauaggcguccauauggcccacgaugaccaaucggugagcuccaagauuguugcacauugucccccacaggaccccugccuggugcacgggugcaucgucugugcgcacggauugaucaauuaucagugccauaccgcucucucagccuucgugguaguguuuguuuucaguucuauugcaaucauuugucuggccauauuauacagaguccugaaaugccuaaagaucgcuccuaggaaagugcucaacccacugauguggauuacagccuuuauccgguggguguacaagaaaauggucgcacgaguugcugauaacaucaaucaggugaaccgcgagauuggcuggauggaaggugggcaacuuguguugggcaauccggcccccauaccuagacacgcgccaauccccagguauagcacuuaccugaugcuccugcuuauuguauccuaugccucagcuuguagcgagcugauccaggcaucuucccggauuaccacaugcaguacugagggagucaacaccaagugucgcuugagcggcacagcccucaucagagcugggucugugggagccgaagcaugccugauguuaaaggguguuaaagaggaccagaccaaguuccugaaaauaaagacuguguccucagaacuaaguugcagggagggccagagcuacuggacggggucguuuuccccuaaaugucucucuagccgucggugccaucuggucggagaaugucacgugaaucgaugccuuucauggagagauaacgagacaagugcggaguucuccuuuguuggcgaaucuaccacuaugagggagaauaaguguuucgaacaaugcgguggguggggcuguggaugcuuuaacgugaauccaagcuguuuguucguacacaccuaucugcaguccguccgcaaggaggcccuccggguguuuaacugcaucgacugggugcauaaacugacauuagaaauuaccgauuucgacggcucagucagcacuaucgaucugggggcuaguucuuccagauuuacaaauuggggaagcguuucgcuuucauuggacgccgagggcauuucugguaguaacuccuucagcuucaucgagucucccgggaagggauacgcaauaguggaugaaccguuuagcgagauuccuaggcagggcuuccucggugaaauccgcuguaauuccgagucaaguguacugagcgcucacgaaucuugccuacgagccccaaaccugauuuccuauaaacccaugaucgaccagcucgagugcacgaccaaucugauagauccuuuuguggucuucgagcggggcucacuuccccaaacucguaacgacaagacauuugcagccaguaaagggaacagaggagugcaggcuuucagcaagggcuccguucaggcggauuugacccugauguuugacaauuucgaaguggacuuugucggggccgcagugucuugugaugcugccuucuuaaaccucacaggaugcuacucguguaaugccggcgcuaggguuugccugagcaucacuucaaccgguacggggacccuuuccgcacauaacaaggacggaagucugcacauuguguugccaucugagaauggcacaaaagaucaaugucagauccuccauuuuacugucccugaaguagaggaggaguucauguacagcugcgacggugaugaacgcccccugcuagugaagggcacccugauugccaucgacccauuugaugaccggagagaagcgggaggagaguccacaguugugaacccgaaaucaggcucuuggaauuucuucgauugguuuagcgggcucaugaguugguucggaggcccucugaagacuaugcuuuugauaugucuguaugucgcuuuauccauuggucucuuuuuccugcuuaucuaccuggggaggaccggacuaagcaaaauguggcucgccgcaacgaagaaggccucuuga

SEQ ID NO: 11145 - RNA, 3594 nt, Artificial Sequence
  derived and/or modified CDS sequence (opt3) from RVFV(Entebbe)__DQ380191.1__GP
auguacgcccugcucaccauccuuauuagcgugcuggucugcgaggcuguuauaagaguguccuugucuucaacaagggaagagacuuguuucggcgacaguacgaaccccgaaaugaucgagggggcaugggauagcuuacgggaagaggagaugccugaagaacuguccugcucuauuucgggaauccgcgaaguaaagaccucaagccaggagcuacaccgagcccucaaagcgauuaucgcugccgacggucugaauaacauaacaugucauggcaaggauccagaggacaaaaucagucuuauuaaggggccgccccacaaaaagcgugugggagucgugagaugcgaaaggcggcgcgaugcaaagcaaaucggcagagagacuauggccgguauugcuaugaccguucugccugcauuggccguguuugcucucgccccagucguguucgcggaagacccccaucugaggaaucggccugggaaaggacacaacuauaucgauggcaugacacaggaggacgcaaccuguaagccaguaacuuacgccggcgcuugcuccucuuuugauguucugcucgaaaaagggaaguuccccuuauuucagagcuaugcccaucaccgcacacugcuugaggcagugcacgacaccauaauugcuaaagccgauccuccauccugugacuugcagucagcgcauggaaauccgugcaugaaggagaagcuggucaugaaaacgcacugucccaacgauuaccaaagugcccauuaucuaaauaacgacgguaagauggcaagcgugaaaugcccuccaaaguacgaacucacugaggacuguaauuucugccgacagaugaccggcgcuucucugaaaaagggguccuauccccuucaggaucuguuuugccagucaagcgaagacgauggaaguaaauugaagacaaagaugaaaggcgugugugaggucgguguucaagcccucaagaaaugcgacgggcagcugucuacugcucacgaagugguaccuuucgccguguuuaagaacuccaaaaaggucuacuuagauaagcuggaccucaaaaccgaggagaaucuucugccagauagcuucguguguuuugaacacaagggacaguacaaaggcacaauggacucgggccagaucaagagagaguugaaaucuuucgauauuucccaaugccccaagaucgggggacaugguucaaagaaauguaccggcgacgcagccuuuugcagugcuuaugaauguacggcgcaguacgcaaacgccuauugcagccacgcuaauggguccggaaucguucagauucaagugucuggcgucuggaagaaaccgcuauguguggguuacgagaggguaguugugaagcgggaacugagcgccaaaccuauacagcgugucgagcccugcacuacauguaucaccaagugcgagccacaugggcucgugguccgcucaacuggcuucaagauuaguuccgcaguggccugcgcuagcggaguuugugugacaggcucucagucaccuaguaccgaaaucacgcugaaauaucccgggauaagccaguccucuggaggugauauuggcguacacauggcccaugacgaccaaucggucagcuccaagaucguggcacacugcccaccccaggauccuugucuuguucacgggugcaucgugugugcgcauggacugauuaacuaccagugccacaccgcuuugucagccuucgucgugguauuuguguucaguucuguugcaaucauuugucucgccauacuguauaaagucuuaaagugccugaaaaucgcuccaagaaaggugcuaaauccgcucauguggauuacagccuuuaucagguggguguacaaaaagauggucgcacggguugcugacaacaucaaccaggugaaucgagagauuggcuggauggaaggugggcaacuggugcuuggcaaccccgccccuauaccacgccaugcgcccaucccuagauacagcacuuauuugaugcugcuccugauuguauccuacgccucagcuuguagcgagcuuauccaggcaucuuccaggauuaccacaugcaguacugagggagucaauaccaagugucggcugagcggcacagccuugauccgcgcugggucugugggagccgaagcaugccucaugcugaaagguguuaaggaggaucagaccaaauucuuaaagauaaaaacuguguccucagaacugaguugcagagagggccagagcuauuggacggggucguuuuccccaaagugucuaucuagcaggcguugccaccucgucggagaaugucacgugaaccggugccugucauggcgagacaaugagacaagugcggaguucuccuuuguuggcgaaucuaccacuaugagagagaacaaguguuucgaacaaugcgguggguggggcuguggaugcuuuaaugugaaccccagcugucuuuucguacauaccuacuugcaguccgucaggaaagaggcccugcgcguguuuaauugcaucgauugggugcacaagcucacacuggaaauuaccgacuucgauggcucagucagcacuguugacuuaggggcuaguucuucccgguuuacaaacuggggaagcgugucgcugucacuugaugccgagggcaucucugguaguaauuccuucagcuucauugagucuccggggaaaggauaugcaaucguagacgaaccuuuuagcgagauaccaagacagggcuucuugggugaaauuagguguaacuccgagucaagugugcucagcgcucaugaaucuugccugcgcgcccccaaucuaaucuccuacaagccuaugauugaucagcuggagugcacgaccaaccucaucgaccccuuugucguguucgagcgaggcucacugccacaaacucggaaugauaaaacauuugcagccaguaaggggaaccguggaguucaggcuuucagcaagggcuccgugcaggcggaccuuaccuugauguuugacaacuucgaagucgauuuugugggggccgcaguuucuugugacgcugccuuccugaauuuaacaggaugcuauucguguaacgccggcgcuagagugugccucagcauaacuucaaccgguacggggacccuguccgcacacaauaaagauggaagucuucauaucguccugccuucugagaacggcacaaaggaccaaugucagauuuugcacuuuacuguacccgaaguggaggaggaguucauguacagcugcgauggugacgagaggccacuccugguuaaaggcacccuaaucgccauugauccguuugacgaucgccgggaagcugggggagaguccacaguggucaauccuaagucaggcucuuggaacuucuucgacugguuuagcgggcugaugaguugguucggaggcccccucaaaacuauccugcuuauauguuuguacguggcgcuguccauugguuuauuuuuccuccugaucuaucuugggagaaccggacugagcaagauguggcuagccgcaacgaagaaagccucuuga

SEQ ID NO: 11146 - RNA, 3594 nt, Artificial Sequence
  derived and/or modified CDS sequence (opt3) from RVFV(25010-24)__KM210509.1__GP
auguacgugcugcucacaauccuuauuagcguccugguuugcgaggccgugauaagaguauccuugucuucaacaagggaagagacuuguuucggcgacaguacgaaccccgaaaugaucgagcgggcuugggauagcuuacgcgaagaggagaugccugaggaacuguccugcucuauuucggggauccgagaagugaagaccucaagccaggagcuauaucgugcacucaaagccauuaucgcggcugacggacugaauaacauaacaugucacgguaaggauccagaggacaaaaucagucuuauuaagggcccgccccauaaaaagagagucgggaucgugaggugcgaacggcgcagagaugccaagcaaguuggaagggagacuauggcaggcauugccaugaccgugcugccugcuuuggcagucuuugcccucgcuccagugguauucgccgaagacccccaucugcggaaucgcccugguaaagggcacaacuacaucgauggaaugacacaggaggacgcgaccuguaagccaguuacuuaugcaggcgccugcuccucuuuugaugugcugcucgaaaaaggcaaguuccccuuauuucagagcuacgcucaccaucgaacacugcuugaggccguccacgacaccauaauugcaaaagcugauccuccauccugugacuugcagucagcccacgggaauccgugcaugaaggagaagcuggugaugaaaacgcauugucccaacgauuaucaaagugcgcacuaccuaaauaacgacggaaagauggccagcgugaaaugcccuccaaaguaugaacucacugaggacuguaauuucugcagacagaugaccggugcaucucugaaaaagggcuccuacccccuucaggaucuguuuugccagucaagcgaagacgaugggaguaaauugaagacaaagaugaaaggagucugugagguuggcgugcaagcucucaagaaaugcgacggucagcugucuacugcccaugaaguagugccuuucgcugucuuuaagaacuccaaaaagguguacuuagauaagcuggaccucaaaaccgaggagaaucuucugccagauagcuucguuuguuuugaacacaaggggcaguauaaaggaacaauggacucgggccagaccaagagggaguugaaaucuuucgauaucucccaaugccccaagauuggcgggcacggaucaaagaaauguacgggugacgccgcauuuugcagugccuacgaauguacugcucaguaugcgaacgcauacugcagccaugccaauggcuccgggaucgugcagauccaagucucuggaguguggaagaaaccgcuauguguaggcuaugagcggguuguggucaagcgugaacugagcgcuaaaccuauucagcgcguggagcccugcacaaccuguauaacuaagugcgagccacacggucucaucgucagaucaacaggguucaagauuaguuccgccguggcaugcgccagcggcguuugugugaccggaucucagucaccuaguacggaaaucacccugaaauaccccggcauaagccaguccucugggggagauauugguguacauauggcucacgacgaccaaucggucagcuccaagaucguggcccauugcccaccccaggauccuugucuuguucacggcugcaucgugugugcacacgggcugauuaacuaucagugccauacagcguugucagcuuucgucgugguauuuguguucaguucuguugccaucauuugucucgcaauacuguacaaagucuuaaagugccugaaaaucgccccaaagaaagugcuaaauccgcucauguggauuacugcuuuuaucagguggguguacaagaagauggucgcccggguugcagacaacaucaaccaggugaaucgagagauuggauggauggaaggcggucaacuggcucuugggaaccccgccccuauaccacgccacgcgcccaucccuagauauagcaccuacuugaugcugcuccugauuguguccuaugccucagcuuguagcgagcuuauccaggcaucuuccaggauuacaacuugcaguaccgagggcguaaauacaaaaugucggcugagcggaaccgccuugauccgcgcuggcucugucggggccgaagcaugccucaugcugaagggagugaaagaugaccagacuaaguucuuaaaaauaaagacgguuuccucagagcugaguugcagagaaggucagagcuacuggacaggcucguuuuccccaaagugucuaucuagcaggcguugccaucucgugggggagugucacgucaaccggugccugucauggcgagauaaugaaaccagugcggaguucuccuuugugggagagucuacuaccaugagagaaaacaaauguuucgagcaaugcggcgguuggggguguggcugcuuuaauguuaaccccagcugucuuuucgugcacacauauuugcaguccguaaggaaggaagcccugcgcgucuuuaauugcaucgacugggugcauaaacucacccuggagauuacugauuucgacggaucagugagcacaaucgauuuaggcgcuaguucuucccgguuuacgaacugggggagcgucucgcugucacuugacgccgaaggaauuucuggcaguaauuccuucagcuucaucgagucuccggguaagggguacgcaauaguugaugagccuuuuagcgaaauuccaagacagggauucuugggcgagaucagguguaacuccgaaucaagugugcucagcgcucacgagucuugccugcgcgcccccaaucuaauuuccuauaaaccuaugaucgaccagcuggaaugcaccacuaaccucauagaucccuuuguaguguucgagcgagguucacugccacaaacacggaaugacaagaccuuugcagccaguaagggcaaccgugggguccaggcuuucagcaaaggauccgugcaggcggaccuuacauugauguuugauaacuucgagguugacuuugugggcgccgcagucucuugugaugcugccuuccugaauuuaacugggugcuacucguguaacgccggagcuagagugugccucagcaucaccucaacgggcaccgguacacuguccgcacauaauaaggacgggagucuucacauuguucugccuucugaaaacggaacuaaagaucaaugucagaucuugcauuuuaccgugcccgaggucgaagaggaguucauguacagcugcgacggcgaugaaaggccacuccugguaaaggguacacuaauugccaucgacccguuugaugaccgccgggaggcgggcggggaauccacugugguuaauccuaaaucaggaucuuggaacuucuucgauugguuuagcggccugaugaguugguucgggggaccccucaagaccauacugcuuauuuguuuguauguggcucuguccaucggcuuauuuuuccuccugaucuaccuugguagaacggggcugagcaagauguggcuagccgcaaccaaaaaggccucuuga

SEQ ID NO: 11147 - RNA, 3594 nt, Artificial Sequence
  derived and/or modified CDS sequence (opt3) from RVFV(Kenya 9800523)__DQ380196.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggguauucgcgaagucaagaccucaagccaggagcuauaucgagcacucaaagccaucauugcggcugacggacugaauaacaucacaugucacggcaagaauccagaggauaaaauaagucuuaucaaggggccgccccauaaaaagcgugugggaauuguuagaugcgaaaggcggcgcgacacuaagcaaaucggcagagagaccauggccgguauugcaaugacagugcugccugccuuggcugucuuugcacucgccccagugguauucgcugaagauccccaccugaggaaccggccugggaaaggacauaauuacaucgacggcaugacccaggaggaugccacuuguaagccaguuacauaugcgggcgcaugcuccucuuuugacgugcugcucgaaaaagggaaguuccccuuauuucagagcuacgcccaccaucgcacccugcuugaggcuguccacgauacgauaauugccaaagcagacccuccauccugugauuugcagucagcucacggaaacccgugcaugaaggagaagcuggugaugaaaacucauugucccaaugacuaucaaagugcccacuaccuaaacaaugaugguaagauggcgagcgugaaaugcccuccaaaguaugaacucaccgaggacuguaacuucugccgacagaugacaggcgccucucugaaaaagggguccuacccccuucaggaccuguuuugccagucaagcgaagaugacggaaguaaauugaagacuaagaugaaaggcgucugugagguuggugugcaagcacucaagaaaugcgaugggcagcugucuaccgcucaugaaguagugccuuucgccgucuuuaagaauaguaaaaagguguacuuagacaagcuggaucucaaaacagaggagaaccuucugccagacagcuucguuuguuuugaacacaagggacaguauaaaggcaccauggauucgggccagacgaagagagaguugaaaucuuucgacaucucccaaugccccaagauugggggacacgguucaaagaaauguacuggcgaugcugccuuuugcagugcauacgaauguacagcccaguaugcuaaugcguucugcagccaugcaaacggguccggaaucgugcagauccaagucucuggcguguggaagaaaccgcuauguguagguuacgagaggguuguggucaagcgggaacugagcgccaaaccuauucagcguguggagcccugcaccacuuguauaacaaagugcgagccacacgggcucgucgugcgcucaaccggcuucaagaucaguuccgcuguugccugcgcaagcggaguguguguaacgggcucucagucaccuaguaccgaaauuacacugaaauaucccgggaucagccaguccucuggaggugacauaggcguccauauggcccacgaugaccaaucggugagcuccaagauuguugcucauugcccaccccaggacccuugucuugugcacgggugcaucgucugugcccacggacugaucaauuaccagugccauacugcauugucagcguuugugguaguguucguuuuuaguucuauugcuaucauuugucucgccauacuguauagagucuuaaaaugccugaagaucgcaccaaggaaagugcuaaacccgcucauguggauuaccgccuucauccgguggguguacaagaaaauggucgcucgaguugccgauaacaucaaucaggugaaccgcgagauuggcuggauggaaggugggcaacuggugcuuggcaaucccgcaccuauaccaagacacgcucccaucccuagguacagcacauauuugaugcugcuccugauuguauccuacgccucagcguguagcgagcuuauccaggccucuucccggauuacuaccugcaguacagagggagucaacaccaagugucgccugagcggcacugcuuugaucagagcagggucugugggagccgaggcuugccucaugcugaaggguguuaaagaggaccagacgaaguuuuuaaaaauaaagacaguguccucagaacugaguugcagggagggccagagcuauuggaccgggucguucuccccaaaaugucuaucuagccgucggugccaucucgucggagaaugucacgugaaucgaugccugucauggagagauaacgagacuuccgccgaguuuuccuucguuggcgaaucuaccacaaugagggagaauaaguguuuugaacaaugcgguggguggggcuguggaugcuucaacgugaaucccagcugucuuuuuguacacaccuacuugcaguccguccgcaaggaggcacugcggguguucaacugcaucgacugggugcauaaacucacucuggaaauuacagauuuugacggcucagucagcacgaucgauuuaggggcgaguucuuccagauucaccaauuggggaagcguuucgcugucacuugacgccgagggcauuucugguaguaacuccuucagcuuuaucgagucuccggggaagggauaugcuauaguggaugaaccuuucagcgagauuccaaggcagggcuuuuugggugaaauccgcuguaauuccgagucaaguguacucaacgcccacgaaagcugccugcgagcacccaaucuaauuucuuacaaaccuaugaucgaccagcuggagugcacuacaaaccucauagaucccuucguggucuuugagcggggcucccugccacaaacccguaacgacaagacauucgcugccucaaaagggaauagaggagugcaggcauuuaguaagggcagcguucaggccgaucuuacuuugauguucgacaacuuugaaguggacuucgucggggcugcgguguccugugaugccgcauuucugaauuuaaccggaugcuauucuuguaacgcuggcgccaggguuugccucucgaucacgagcaccgguacagggacucugucagcccauaauaaggagggaucccuucacauugugcugccuagugaaaacggcaccaaagaccaaugucagaucuugcauuucacaguccccgagguagaggaagaguuuauguacucuugcgauggugacgaacgcccacuccuggugaagggcacucuaauugcuaucgauccguucgacgaucggagagaggcagggggagaaagcaccguugugaauccuaaauccggcucauggaacuucuuugacugguucucugggcugaugagcugguuuggaggcccccucaagacgauacugcuuauuuguuuguacgucgcccugaguaucgguuuauucuuucuccugaucuaucuugggaggacaggacuguccaaaauguggcuagcggcuaccaagaaggccagcuga

SEQ ID NO: 11148 - RNA, 3594 nt, Artificial Sequence
  derived and/or modified CDS sequence (opt3) from RVFV(ANK-6087)__DQ380216.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguaugaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccaugaagugguaccuuucgcuguguuuaagaacuccaaaaaggucuacuuagauaagcuggaccucaaaaccgaggagaaucuucugccagauagcuucguguguuuugaacacaagggacaguauaaaggcaaguuggacucgggccagacaaaaagagagcuaaagucuuucgauauuucccaaugccccaagaucgggggacacgguaguaaaaaguguaccggcgacgccgcauuuugcucagccuacgaauguacggcucaguaugcgaacgcauacugcagccaugccaauggguccggaaucguucagauucaagugucuggcgucuggaaaaagccgcuguguguggguuaugagaggguaguugugaaacgggaacucagcgcuaagccuauacagcgugucgagcccugcacuacauguaucaccaagugcgagccacacgggcuggugguccgcucaacuggcuucaaaauuaguuccgccguggcaugcgccagcggaguuugugugacaggcucucagucaccuaguaccgaaaucacgcuuaaguaccccgggauaagccaguccucuggaggugauauuggcguacauauggcucacgacgaccaaucggucagcuccaaaaucguggcccauugcccaccccaggauccuugucugguucacgggugcaucgugugugcacacggauugauuaacuaucagugccauaccgcgcucucagcuuucgucgugguauuuguguucaguucuaucgccauuauaugucuggcaaucuuauacagaguucugaagugccuaaaaauugccccaaggaagguccucaauccgcugauguggaucacagcuuuuauccgguggguguaccgaaaaaugguggcccgcgucgcagacaacauuaaccagguuaauagagagauaggcuggauggaaggugggcaacuuguguugggcaaccccgcuccuaucccaaggcacgugcccauuccucgguauagcacuuaccugaugcuccugcuuaucguauccuaugccucagcguguagcgagcugauucaggccucuucccgcaucaccacaugcaguacugagggagucaauaccaaguguagauugagcggcacagcucucauaagggcagggucugugggagccgaggcuugccugauguuaaaggguguuaaagaggaucagaccaaguuccugaaaaucaagacuguguccucagaacuaaguugccgugagggccagagcuacuggacggggucguuuuccccaaaaugucucucuagccggcgaugccaucuggucggagaaugucacgugaacagaugccuuucauggagggacaaugagacaagugccgaguucuccuuuguuggcgaaucuaccacuaugcgcgagaacaaguguuucgaacaaugcgguggguggggcuguggaugcuuuaaugugaaccccagcuguuuguucguacacaccuaucugcaguccguccggaaggaggcacucagaguguuuaauugcauugauugggugcauaaacugacauuagaaaucaccgacuucgauggcucagucagcacuauugaccugggggcgaguucuuccagguuuacaaacuggggaagcguuucgcuuucauuggaugccgagggcaucucugguaguaauuccuucagcuucauagagucuccggggaagggauacgcuauuguggacgaaccuuuuagcgagaucccacgccagggcuuccucggugaaauucgauguaacuccgagucaaguguacugagcgcccacgaaucuugccuacgggcacccaaucugaucuccuauaaaccuaugauagaucagcucgagugcucaacgaaccugaucgaccccuuuguggucuucaagcguggcagucuuccacaaaccagaaaugauaaaacuuuugcugccagcaaggggaacaggggagugcaggcauucuccaagggcucuguucaggccgacuugacacugauguuugacaacuucgagguggauuuugucggggcugcggugucgugugacgccgcauucuuaaaucucaccggaugcuacagcuguaacgcuggcgcccgcguuugccugucaauuacauccacugguaccgggacgcuuagugcccauaauaaagauggaucucugcacaucguguugccuagcgaaaacggcaccaaggaccaaugucagauucuccauuuuacaguccccgagguagaagaggaguucauguacuccugcgauggugacgaacggccacugcuagugagaggcacucugaucgcuauagauccguuugacgauaggcgagaggcagggggagaaucaaccguugugaauccuaaaucuggcagcuggaacuucuucgacugguuuagugggcucauguccugguucggaggcccccugaagacaauucuuuugaucugucuguaugucgccuuaagcaucggucucuuuuuccugcuuauuuaccuggggcgcacuggacuaucuaaaauguggcucgcggcuaccaagaaggccucauga

SEQ ID NO: 11149 - RNA, 3594 nt, Artificial Sequence
  derived and/or modified CDS sequence (opt3) from RVFV(SAUDI 200010901)__KU978778.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaggagcuguccugcucugugucggguauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaauuguuagaugcggcaggcggcgcgacacuaagcaaaucgguagagaaaccauggccgggauugcaaugacagugcugccugccuuggcugucuuugcacucgccccagugguauucgcugaggauccccaccugaggaaccggccuggaaaaggccauaauuacaucgacggcaugacccaggaagaugccacuuguaagccaguuacauaugcgggggcaugcuccucuuuugacgugcugcucgagaaaggaaaguuccccuuauuucagagcuacgcccaccaucgcacccugcuugaagcuguccacgauacgauaauugccaaagcagacccuccauccugugauuugcagucagcucacgguaacccgugcaugaaggagaagcuggugaugaaaacucauugucccaaugacuaucaaagugcccacuaccuaaacaaugauggcaagauggcgagcgugaaaugcccuccaaaguaugagcucaccgaagacuguaacuucugccgacagaugacaggggccucucugaaaaagggauccuacccccuucaggaccuguuuugccagucaagcgaggaugacggcaguaaauugaagacuaagaugaaaggugucugugaaguuggggugcaagcacucaagaaaugcgauggacagcugucuaccgcucaugagguagugccuuucgccgucuuuaagaauaguaaaaagguguacuuagacaagcuggaucucaaaacagaagagaaccuucugccagacagcuucguuuguuuugagcacaagggccaguauaaaggcaccauggauucggggcagacgaagagagaauugaaaucuuucgacaucucccaaugccccaagauuggaggucacggcucaaagaaauguacuggggaugcugccuuuugcagugcauacgaguguacagcccaguaugcuaaugcguucugcagccaugcaaacggauccggcaucgugcagauccaagucucugguguguggaagaaaccgcuauguguaggguacgaaaggguuguggucaagcgggagcugagcgccaaaccuauucagcguguggaacccugcaccacuuguauaacaaagugcgagccacacggccucgucgugcgcucaaccggauucaagaucaguuccgcuguugccugcgcaagcggcguguguguaacggggucucagucaccuaguaccgagauuacacugaaauaucccggaaucagccaguccucugguggcgacauagggguccauauggcccacgaugaccaaucggugagcuccaagauuguugcucauugcccaccccaggacccuugucuugugcacggaugcaucgucugugcccacggccugaucaauuaccagugccauacugcauugucagcguuugugguaguguucguuuuuaguucuauugcuaucauuugucucgccauacuguauagagucuuaaaaugccugaagaucgcaccaaggaaagugcuaaacccgcucauguggauuaccgccuucauccgguggguguacaagaaaauggucgcucgaguugccgauaacaucaaucaggugaaccgcgaaauugguuggauggaagggggccaacuggugcuuggaaaucccgcaccuauaccaagacacgcucccaucccuagguacagcacauauuugaugcugcuccugauuaucuccuacgccucagcguguagcgaacuuauucaggccucuucccggaucacuaccugcaguacagagggcguaaacaccaagugucgccugagcgggacugcuuugauaagagcaggaucugucggugccgaggcuugccucaugcugaagggcgugaaagaagaccagacgaaguuuuuaaaaaucaagacaguuuccucagagcugaguugcagggaagggcagagcuauuggaccggaucguucuccccaaaaugucuaucuagccgucggugccaucucgugggcgagugucacgucaaucgaugccugucauggagagauaacgaaacuuccgccgaguuuuccuucgugggugagucuaccacaaugagggaaaauaaguguuuugagcaaugcgggggcuggggauguggcugcuucaacguuaaucccagcugucuuuuugugcacaccuacuugcaguccguacgcaaggaagcacugcgggucuucaacugcauugacugggugcauaaacucacucuggagaucacagauuuugacgggucagugagcacgauugauuuaggagcgaguucuuccagauucaccaauuggggcagcgucucgcugucacuugacgccgaagguaucucugggaguaacuccuucagcuuuauagagucuccgggaaagggcuaugcuauuguugaugagccuuucagcgaaaucccaaggcagggauuuuugggcgagauucgcuguaauuccgaaucaagugugcucagcgcccacgagucuugccugcgagcacccaaccuaaucuccuacaaaccuaugauagaccagcuggaaugcacuacaaaucucaucgaucccuucguaguguuugagcgggggucacugccacaaacccguaacgagaagacauucgcugccaguaaaggaaacagaggcguccaggcauuuagcaagggguccgugcaggccgaccuuacuuugauguucgauaauuuugaaguugacuucgugggagcugcggucucuugugacgccgcauuucugaacuuaaccggcugcuauucguguaaugcuggugccagggugugccucagcauuacgucaaccgggacaggaacucuguccgcccauaacaaggauggcagucuucacaucguucugccuucugagaaugguaccaaagaccaaugucagauuuugcauuucacagugcccgaagucgaggaggaauuuauguacagcugcgauggcgacgagcgcccacuccugguaaaggggacucuaaucgcuauagauccguucgacgaucggagagaagcaggaggcgaguccaccgugguuaacccuaaaucagggucuuggaauuucuuugacugguucagcggacugaugaguugguuuggcgguccccucaagacgauucugcuuaucuguuuguacguggcccuguccaucggguuauucuuucuccugauuuaucuuggaaggacaggccugagcaaaauguggcuagcggcuaccaagaaggccucuuga

SEQ ID NO: 11150 - RNA, 3594 nt, Artificial Sequence
  derived and/or modified CDS sequence (opt3) from RVFV(35/74)__JF784387.1__GP
auguacgugcugcucaccauccuuauuacaguccugguuugcgaggccgugauaagagugagcuuguccucuacuagggaagagacguguuucggcgacuauaccaaccccgaaaugaucgagggggcuugggauucauuacgggaagaggagaugccugaagaacugaguugcagcauuuccggaauccgcgaaguaaagacaucuucgcaggagcuauaccgagcacucaaagccauuaucgcggcugacggucugaauaacauaacuugucacggcaaggauccagaggacaaaaucucacuugucaaggggccgccccauaaaaagcgugugggaauuguuagaugcgaaaggcggcgcgaugccaagcaaaucggcagagagaccauggcagguauugccaugacagugcugccugcuuuggcagucuuugcccucgcuccagugguauucgccgaagacccccaccugaggaaucggccugggaaaggacauaacuauaucgauggcaugacccaggaggacgcgacuuguaagccaguuacauacgcaggcgccugcagcaguuuugaugugcugcucgaaaaagggaaguuccccuuauuucaguccuaugcucaccaucgcacccugcuugaggccguccacgacacgauaauugcaaaagcugauccuccaucuugugacuugcagagcgcccacggaaauccgugcaugaaggagaagcuggugaugaaaacucauugucccaacgauuaccaauccgcgcacuaucuaaauaacgacgguaagauggccucagugaaaugcccuccaaaguacgaacucaccgaggacuguaauuucugccgacagaugacaggcgcaagucugaaaaaggggagcuacccccuucaggaucuguuuugccagucuuccgaagacgauggaucaaaauugaagacuaagaugaaaggcgucugugagguuggugugcaagcucucaagaaaugcgacgggcagcugagcaccgcccaugaaguagugccuuucgcugucuuuaagaacaguaaaaagguguauuuagauaagcuggaccucaaaacagaggagaaucuucugccagauucuuucguuuguuuugaacacaagggacaguacaaaggcaccauggacuccggccagacgaagagagaguugaaaucguucgauaucagccaaugccccaagauugggggacacgguucuaagaaauguacuggcgacgccgcauuuugcuccgccuaugaauguacagcucaguacgcgaacgcauauugcucacaugccaaugggaguggagugguccagauccaagugagcggcguauggaagaaaccgcuauguguugguuacgagaggguggucgugaagcgggaacuguccgcuaaaccuauccagcgugucgagcccugcaccacuuguauuacaaagugcgagccacacgggcucgugguucgcucuaccggcuucaagauaagcucagccguggcaugcgccaguggaguaugugucacgggcucccagagcccuucuaccgaaaucacacugaaauaucccgggauuucacagaguagcggaggugauaucggcgugcauauggcucacgacgaccaauccguuucuucgaagauaguggcccauugcccaccccaggauccuugucuuguccacgggugcauugugugugcacacggacugaucaacuaccagugccauacugcguugagcgcuuucguagugguuuuugucuucuccucaguggccaucauuugucucgcaauccuguacaaaguguuaaagugccugaaaauugccccaagaaagguccuagacccgcucauguggauaaccguuuuuaucagguggguguauaaaaagaugguggcucggguagccgauaauauuaaccaggucaaccgagagaucggcuggauggaaggugggcaacuggcacuuggcaaucccgcuccuaucccacgccacgcccccauuccuagauacaguacauauuugaugcugcuccugauagugucuuacgcgagcgccuguuccgagcuuauccaggcuucaagcaggauuacuaccugcucuacagagggaguuaacaccaagugucggcuguccggcacugcauugauccgcgccgggagugugggagcugaagccugccucaugcugaaaggugucaaggaggaccagacgaaauucuuaaagauuaaaacagugagcucugaacuguccugcagagagggccagucauauuggaccgggaguuuuagcccaaagugucuaucguccaggcguugccaucucguuggagaaugucacgugaaucggugccugucuuggcgagauaacgagacuagcgcagaguucucauuuguaggcgaaaguaccacaaugagagagaauaaguguuucgaacaaugcgguggguggggcuguggaugcuuuaacgucaaucccuccugucuuuucgugcacaccuacuugcagucugugaggaaagaggcgcugcgcgucuuuaacugcaucgacuggguucauaagcucacucuggaaauaacagauuucgacggcagcguguccacgaucgauuuaggggccucaagcagucgguuuaccaauuggggaucuguaucccugagccuugacgcugagggcauuucggguucaaacucuuucaguuucaucgaguccccggggaaaggauaugccauuguggaugaaccuuuuagcgagaucccaagacagggcuucuugggugaaauaagguguaauucugagagcuccguccucucagcacacgaaaguugccugcgcgcucccaaccuaauuagcuacaagccuaugaucgaccagcuggagugcacuacaaaucucauugaucccuuugugguuuucgagcgaggcucucugccacaaacccggaacgacaaaacauuugccgcauccaaggggaaucguggagugcaggccuucucaaagggcaguguccaggcugaccuuacuuugauguuugauaacuucgaaguggacuuuguuggggcggccgugagcugugaugcagcuuuccugaacuuaaccggaugcuacuccuguaaugccggcgccagagucugccucucuaucacgucgaccgguacagggacucugagcgcucauaacaaagacggaucacuucacauaguacugccuuccgagaauggcaccaaggaucaaugucagaucuugcauuuuacagugcccgaaguugaggaggaguucauguauaguugcgacggugaugagaggccacuccuggugaaaggcacucuaauugcaaucgacccguuugaugaccgccgggaagccgggggagagucuaccgucgugaacccuaagagcggcuccuggaauuucuucgauugguuuucagggcugaugucuugguucggaggcccccucaaaacgauucugcuuaucuguuuguacguagcgcugagcauagguuuauuuuuccuccugauuuaucuugggagaacaggacugaguaagauguggcuagcugccaccaagaaagcauccuga

SEQ ID NO: 11151 - RNA, 3594 nt, Artificial Sequence
  derived and/or modified CDS sequence (opt3) from RVFV(KEN/Kil-006/07)__HM586966.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggggauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaguugugagaugcgaaaggcggcgcgacgccaagcaaauuggcagagagacuauggcagguaucgccaugaccguccugccugcuuuggcaguguuugcccucgcuccaguaguuuucgccgaagauccccaccugaggaaccggccugggaaaggacauaauuacauugacggcaugacacaggaggaugcgaccuguaagccagugacuuaugcaggcgccugcuccucuuuugacguccugcucgaaaaagggaaguuccccuuauuucagagcuacgcucaccaucgcacacugcuugaggccgugcacgauaccaucauagcaaaagcugacccuccauccugugauuugcagucagccgacggaaacaagugcaugaaggagaaacuggugaugaagacgcacuguccgaaugauuaucaaagugcgcauuaccuaaacaaugacgguaaaauggccagcgucaagugucccccuaaauaugaacucacugaggacugcaacuucugccgacagaugaccggcgcaucucugaagaaaggguccuacccacuucaggaucuguuuugccagucaagcgaagacgauggaaguaaguugaagacaaaaaugaagggcguuugugagguggguguacaagcucucaaaaagugcgacgggcagcugucuacugcccacgaagugguccccuucgcuguguuuaaaaauuccaagaagguuuacuuagauaaacuggaccucaagaccgaggagaaccuucugccugauagcuucguguguuuugaacauaaaggacaguauaagggcacaauggacucgggccagaccaaaagagaguugaagucuuucgauauuucccaaugcccaaagaucgggggacacgguaguaaaaaguguacgggcgacgccgcauuuugcagugccuacgaauguacugcucaguaugcgaaugcauacugcagccacgccaacggguccggaauuguccagauccaagugucuggcguauggaaaaagccccuauguguugguuaugagaggguggucgugaaacgggaacugagcgcuaagccgauccagcgugucgagccuugcacaaccuguauuacuaagugcgagccccaugggcucgugguucgcucaacaggcuucaaaauaaguuccgccguggcaugcgccagcggaguaugugucaccggcucucagucaccaaguacggaaaucacccugaaguacccugggauuagccaguccucuggaggugauaucggcgugcacauggcucaugacgaccaaucgguuagcuccaaaauaguggcccacugucccccacaggaucccugccuuguccaugggugcauugugugugcacacggacugaucaauuaucagugccacacagcguugucagcuuucguagugaucuuuguuuucaguucuacugccauuaucugucucgcaguccuguacagaguguuaaagugccugaaaauugccccuaggaaggugcuaaacccacucauguggauaaccgcuuuuauccggugggucuacaaaaagaugguugcccgaguggcagacaacauuaaucaggugaaccgcgagaucggcuggauggaaggugggcaacuggcucuuggcaauccggcccccaucccuagacaugcgccaauucccagguauagcacauacuugaugcugcuccugauaguauccuaugccucagcuuguagcgagcuuauccaggcaucuucccggauuacuaccugcaguacagagggagucaacaccaagugucgccugagcggcacugccuugaucagagcugggucugugggagccgaagcaugccucaugcugaaagguguuaaggaggaucagacgaaauucuuaaagauuaaaacaguguccucagaacugaguugcagggagggccagagcuacuggaccgggucguuuuccccuaagugucuaucuagccgucggugccaccucgucggagaaugucaugugaaucgaugccugucauggagagacaacgagacuucagcggaguucuccuuuguuggcgaaucuaccacaaugagggagaauaaguguuucgaacaaugcgguggguggggcuguggaugcuuuaacgugaauccaagcugucuuuucguacacaccuauuugcaguccguccgcaaagaggcccugcggguguuuaacugcaucgauugggugcacaagcucacucuggaaauaacagacuucgauggcucagucagcacgaucgacuuaggggcuaguucuuccagauuuaccaauuggggaagcguuucgcugucacuugaugccgagggcauuucugguaguaacuccuucagcuucaucgagucucccgggaaaggauacgcaauuguggacgaaccguuuagcgagaucccuaggcagggcuucuugggugaaauacgcuguaauuccgagucaaguguacucagcgcucaugaaucuugccugcgagccccaaaccuaguguccuauaagcccaugauugaucagcuggagugcacuacaaaucucaucgacccuuuugucguguucgagcggggcucacugccccaaacccguaacgauaaaacauuugcagccaguaaggggaacagaggaguucaggcuuucagcaagggcuccgugcaggcggaccuuacuuugauguuugacaauuucgaagucgauuuugugggggccgcaguuucuugugacgcugccuuccugaacuuaaccggaugcuacucguguaaugccggcgcuagggugugccucagcauuacgucaaccgguacagggacucuguccgcacacaacaaagauggaagucuucauaucguccugccaucugagaauggcaccaaggaccaaugucagauauugcacuuuacaguaccugaaguggaggaggaguucauguacagcugcgauggugacgagcgcccccuccugguuaaaggcacucuaaucgccauugauccauuugacgaucggagagaagcgggaggagaguccaccguggucaacccgaagucaggcucuuggaauuucuucgacugguuuagcgggcugaugaguugguucggaggcccucucaaaacgauccugcuuauuuguuuguauguggcucuguccaucgguuuauuuuuccuccugauauaccuugggaggacaggacugagcaagauguggcuagccgcaaccaagaaagccucuuga

SEQ ID NO: 11152 - RNA, 3594 nt, Artificial Sequence
  derived and/or modified CDS sequence (opt3) from RVFV(MgH824)__DQ380210.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggauacaacuauauagauggcaugacacaggaggacgcgaccuguaagccaguaacuuacgcaggcgccugcuccucuuuugauguucugcucgaaaaagggaaguuccccuuauuucagagcuaugcucaucaccgcacacugcuugaggccgugcaugacaccauuaucgcaaaagcugauccuccauccugugacuugcagucagcccacggaaauccgugcaugaaggagaagcuggucaugaaaacgcacugucccaacgauuaccaaagugcgcauuaucuaaauaacgacgguaagauggccagcgugaaaugcccuccaaaguacgaacucacugaggacuguaauuucugccgacagaugaccggcgcaucucugaaaaagggguccuacccccuucaggaucuguuuugccagucaagcgaagacgauggaaguaaauugaagacaaagaugaaaggcgugugugaggucgguguucaagcucucaagaaaugcgacgggcagcugucuacugcccacgaagugguaccuuucgcuguguuuaagaacuccaaaaaggucuauuuagauaagcuggaccucaaaaccgaggagaaucuucugccagauagcuucguguguuuugaaagaaagggacaguacaaaggcacaauggacucgggccagaccaagagggaguugaaaucuuucgauauuucccaaugccccaagaucgggggacaugguucaaagaaauguacgggcgacgccgcauuuugcagugccuaugaauguacuacacaguacgcuaacgcguauugcagccacgcaaauggguccggaguugugcagauccaagucucuggcguguggaagaaaccgcuauguguagguuacgagcggguuguggucaagcgugaacugagcgccaaaccuauucagcgcguggagcccugcaccacuuguauaacaaagugcgagccacacgggcucgucgugagaucaaccggcuucaagaucaguuccgcuguugccugcgcaagcggaguguguguaacgggcucucagucaccuaguaccgaaauuacacugaaauaucccgggaucagccaguccucuggaggugauauaggcguccauauggcccacgacgaccaaucggugagcuccaagauuguugcucauugcccaccccaggauccuugucuugugcacgggugcaucgucugugcccauggacugaucaacuaccagugccacacugcauugucagcguucgugguaguguuuguuuucaguucuauugcuaucauuugucucgccauacuguacagggucuuaaaaugccugaagaucgcaccacggaaagugcuaaauccgcucauguggauuaccgccuuuauccgauggaucuauaagaaaaugguggcucgcgucgccgacaacauuaaccagguuaauagagagauaggcuggauggaaggugggcaacuggugcuuggcaaccccgcaccuaucccaaggcacgcucccauuccucgguacagcacauauuugaugcugcuccugaucguguccuacgccucagcguguagcgagcuuauucaggccucuucccgcaucacuaccugcaguacagagggaguagauaccaaguguagacugagcggcacugcuuugauaagggcagggucugucggagccgaggcuugccucaugcugaagggugugaaagaggaccagacgaaguucuuaaaaaucaagacaguuuccucagaacugaguugccgugagggccagagcuauuggaccgggucguuuuccccaaaaugucuaucuagccggcgaugccaucucgugggagaaugucacgucaauagaugccugucauggagggauaacgagaccagugccgaguucuccuuugugggcgaaucuacuacaaugcgcgagaauaaguguuucgaacaaugcgguggguggggcuguggaugcuuuaacguuaaucccagcugucuuuucgugcauaccuacuugcaguccguacggaaggaggcacugagagucuuuaacugcauugacugggugcacaaacucacucuggaaaucacagauuucgacggcucagugagcacgauugauuuaggggcgaguucuuccagguuuaccaauuggggaagcgucucgcugucacuugacgccgagggcaucucugguaguaacuccuucagcuucauagagucuccggggaagggauaugcuauuguugaugaaccuuuuccagagaucccccgccagggcuucuugggugaaauucgauguaauagcgaguccucagugcucagugcccacgaaagcugccugcgggcaccuaaccuaaucucuuacaaacccaugauagaccagcuggagugcacuacaaaucucaucgauccauuuguaguguucgagcguggcucccugccucaaaccagaaacgacaagacauuugcugccucaaaagggaauaggggaguccaggcauucaguaagggcagcgugcaggccgaccuuacuuugauguuugauaacuucgaaguugacuuugugggggcugcggucuccugugaugccgcauuccugaacuuaaccggaugcuacucuuguaaugcuggcgcccgcgugugccucucgauuacgagcaccgguacagggucacuguccgcccauaacaaggacggaagucuucacaucguucugcccucugagaauggcacuaaagaucaaugucagauuuugcauuuuaccgugccagaagucgaggaggaguucauguauagcugcgacggugaugaacggccgcuccugguaaagggcacacuaaucgcuauagacccuuuugaugacagaagggaagcagggggagaguccacugugguuaaccccaaaucaggcucuuggaauuucuucgauugguuuagcgggcugaugaguugguucggaggcccacucaagaccauucugcuuaucuguuuguacguggcccuguccaucgguuuauuuuuccuccugauuuaucuugggcgaacgggacugagcaaaauguggcuagcggcuacaaagaaggccucuuga

SEQ ID NO: 11153 - RNA, 3594 nt, Artificial Sequence
  derived and/or modified CDS sequence (opt3) from RVFV(Kenya 57 (Rintoul))__DQ380192.1__GP
auguacgcccugcucaccauccuuauuagcgugcuggucugcgaggcuguuauaagaguguccuugucuucaacaagggaagagacuuguuucggcgacaguacgaaccccgaaaugaucgagggggcaugggauagcuuacgggaagaggagaugccugaagaacuguccugcucuauuucgggaauccgcgaaguaaagaccucaagccaggagcuacaccgagcccucaaagcgauuaucgcugccgacggucugaauaacauaacaugucauggcaaggauccagaggacaaaaucagucuuauuaaggggccgccccacaaaaagcgugugggagucgugagaugcgaaaggcggcgcgaugcaaagcaaaucggcagagagacuauggccgguauugcuaugaccguucugccugcauuggccguguuugcucucgccccagucguguucgcggaagacccccaucugaggaaucggccugggaaaggacacaacuauaucgauggcaugacacaggaggacgcaaccuguaagccaguaacuuacgccggcgcuugcuccucuuuugauguucugcucgaaaaagggaaguuccccuuauuucagagcuaugcccaucaccgcacacugcuugaggcagugcacgacaccauaauugcuaaagccgauccuccauccugugacuugcagucagcgcauggaaauccgugcaugaaggagaagcuggucaugaaaacgcacugucccaacgauuaccaaagugcccauuaucuaaauaacgacgguaagauggcaagcgugaaaugcccuccaaaguacgaacucacugaggacuguaauuucugccgacagaugaccggcgcuucucugaaaaagggguccuauccccuucaggaucuguuuugccagucaagcgaagacgauggaaguaaauugaagacaaagaugaaaggcgugugugaggucgguguucaagcccucaagaaaugcgacgggcagcugucuacugcucacgaagugguaccuuucgccguguuuaagaacuccaaaaaggucuacuuagauaagcuggaccucaaaaccgaggagaaucuucugccagauagcuucguguguuuugaacacaagggacaguacaaaggcacaauggacucgggccagaucaagagagaguugaaaucuuucgauauuucccaaugccccaagaucgggggacaugguucaaagaaauguaccggcgacgcagccuuuugcagugcuuaugaauguacggcgcaguacgcaaacgccuauugcagccacgcuaauggguccggaaucguucagauucaagugucuggcgucuggaagaaaccgcuauguguggguuacgagaggguaguugugaagcgggaacugagcgccaaaccuauacagcgugucgagcccugcacuacauguaucaccaagugcgagccacaugggcucgugguccgcucaacuggcuucaagauuaguuccgcaguggccugcgcuagcggaguuugugugacaggcucucagucaccuaguaccgaaaucacgcugaaauaucccgggauaagccaguccucuggaggugauauuggcguacacauggcccaugacgaccaaucggucagcuccaagaucguggcacacugcccaccccaggauccuugucuuguucacgggugcaucgugugugcgcauggacugauuaacuaccagugccacaccgcuuugucagccuucgucgugguauuuguguucaguucuguugcaaucauuugucucgccauacuguauaaagucuuaaagugccugaaaaucgcuccaagaaaggugcuaaauccgcucauguggauuacagccuuuaucagguggguguacaaaaagauggucgcacggguugcugacaacaucaaccaggugaaucgagagauuggcuggauggaaggugggcaacuggugcuuggcaaccccgccccuauaccacgccaugcgcccaucccuagauacagcacuuauuugaugcugcuccugauuguauccuacgccucagcuuguagcgagcuuauccaggcaucuuccaggauuaccacaugcaguacugagggagucaauaccaagugucggcugagcggcacagccuugauccgcgcugggucugugggagccgaagcaugccucaugcugaaagguguuaaggaggaucagaccaaauucuuaaagauaaaaacuguguccucagaacugaguugcagagagggccagagcuauuggacggggucguuuuccccaaagugucuaucuagcaggcguugccaccucgucggagaaugucacgugaaccggugccugucauggcgagacaaugagacaagugcggaguucuccuuuguuggcgaaucuaccacuaugagagagaacaaguguuucgaacaaugcgguggguggggcuguggaugcuuuaaugugaaccccagcugucuuuucguacauaccuacuugcaguccgucaggaaagaggcccugcgcguguuuaauugcaucgauugggugcacaagcucacacuggaaauuaccgacuucgauggcucagucagcacuguugacuuaggggcuaguucuucccgguuuacaaacuggggaagcgugucgcugucacuugaugccgagggcaucucugguaguaauuccuucagcuucauugagucuccggggaaaggauaugcaaucguagacgaaccuuuuagcgagauauccagacagggcuucuugggugaaauuagguguaacucagagaguagcgugcucucugcucaugaauccugccugcgcgccccaaaucuaaucucauacaagcccaugauugaucagcuggagugcacgaccaaccucaucgacccuuuugucguguucgagcgaggcagucugccccaaacucggaaugauaaaacauuugcagccagcaaggggaaccguggaguucaggcuuucuccaagggcucugugcaggcggaccuuaccuugauguuugacaacuucgaagucgauuuugugggggccgcaguuucgugugacgcugccuuccugaauuuaacaggaugcuauagcuguaacgccggcgcuagagugugccucucaauaacuuccaccgguacggggacccugagugcacacaauaaagauggaucucuucauaucguccugccaagcgagaacggcacaaaggaccaaugucagauuuugcacuuuacuguaccugaaguggaggaggaguucauguacuccugcgauggugacgagaggccccuccugguuaaaggcacccuaaucgccauugauccauuugacgaucgccgggaagcugggggagagucaacaguggucaauccgaagucuggcagcuggaacuucuucgacugguuuagugggcugauguccugguucggaggcccucucaaaacuauccugcuuauauguuuguacguggcgcugagcauugguuuauuuuuccuccugaucuaucuugggagaaccggacugucuaagauguggcuagccgcaacgaagaaagccucauga

SEQ ID NO: 11154 - RNA, 3594 nt, Artificial Sequence
  derived and/or modified CDS sequence (opt3) from RVFV(SA-75)__DQ380189.1__GP
auguacgugcugcucaccauccuuauuacaguccugguuugcgaggccgugauaagaguaagccuguccucuacuagggaagagacguguuucggcgacuauaccaaccccgaaaugaucgagggggcuugggauucauuacgggaagaggagaugccugaagaacugaguugcagcauuuccggaauccgcgaagugaagacaucuucgcaggagcuauaccgagcacucaaagccauuaucgcggcugacggucugaauaacauaacuugucacggcaaggauccagaggacaaaaucucacuugucaaggggccgccccauaaaaagcgugugggaauuguuagaugcgaaaggcggcgcgaugccaagcaaaucggcagagagaccauggcaaggauugccaugacagugcugccugcuuuggcagucuuugcccucgcuccagugguauucgccgaagacccccacuugcggaaucgcccugguaaagggcauaacuauaucgauggaaugacccaggaggacgcgacuuguaagccaguuacauacgcaggcgccugcagcaguuuugaugugcugcucgaaaaaggcaaguuccccuuauuucaguccuaugcucaccaucgaacccugcuugaggccguccacgacacgauaauugcaaaagcugauccuccaucuugugacuugcagagcgcccacgggaauccgugcaugaaggagaagcuggugaugaaaacucauugucccaacgauuaccaauccgcgcacuaucuaaauaacgacggaaagauggccucagugaaaugcccuccaaaguacgaacucaccgaggacuguaauuucugcagacagaugacaggugcaagucugaaaaagggcagcuacccccuucaggaucuguuuugccagucuuccgaagacgaugggucaaaauugaagacuaagaugaaaggagucugugagguuggcgugcaagcucucaagaaaugcgacggucagcugagcaccgcccaugaaguagugccuuucgcugucuuuaagaacaguaaaaagguguauuuagauaagcuggaccucaaaacagaggagaaucuucugccagauucuuucguuuguuuugaacacaaggggcaguacaaaggaaccauggacuccggccagacgaagagggaguugaaaucguucgauaucagccaaugccccaagauuggcgggcacggaucuaagaaauguacuggugacgccgcauuuugcuccgccuaugaauguacagcucaguacgcgaacgcauauugcucacaugccaauggcaguggggugguccagauccaagugagcggaguauggaagaaaccgcuauguguuggcuacgagcggguggucgugaagcgugaacuguccgcuaaaccuauccagcgcgucgagcccugcaccacuuguauuacaaagugcgagccacacggucucgugguuagaucuaccggguucaagauaagcucagccguggcaugcgccaguggcguaugugucacgggaucccagagcccuucuaccgaaaucacacugaaauaucccggcauuucacagaguagcgggggagauaucggugugcauauggcucacgacgaccaauccguuucuucgaagauaguggcccauugcccaccccaggauccuugucuuguccacggcugcauugugugugcacacgggcugaucaacuaccagugccauacugcguugagcgcuuucguagugguuuuugucuucuccucaguggccaucauuugucucgcaauccuguacaaaguguuaaagugccugaaaauugccccaaggaagguccuaaauccgcucauguggauaaccguuuuuauccgguggguguauaaaaagaugguggcucgaguagccgacaacauuaaccaggucaaucgcgagaucggauggauggaaggcggucaacuggcacuugggaaccccgcuccuaucccaagacacgcccccauuccuagguacaguacauauuugaugcugcuccugauagugucuuacgcgagcgccuguuccgagcuuauccaggcuucaagccggauuacuaccugcucuacagagggcguuaauaccaagugucgccuguccggaacugcauugaucagagccggcagugugggggcugaagccugccucaugcugaaaggagucaaggaggaucagacgaaauucuuaaagauuaaaacagugagcucugaacuguccugcagggagggucagucauauuggaccggcaguuuuagcccaaagugucuaucgucccgucggugccaucucguuggggaaugucacgugaaccgaugccugucuuggagagacaaugagacuagcgcagaguucucauuuguaggagaaaguaccacaaugagggagaacaaguguuucgaacaaugcggcgguuggggguguggcugcuuuaaugucaaccccuccugucuuuucgugcacaccuacuugcagucugugcgcaaagaggcgcugcgggucuuuaauugcaucgauuggguucauaagcucacucuggaaauaacagacuucgauggaagcguguccacgaucgacuuaggcgccucaagcaguagauuuaccaacugggggucuguaucccugagccuugaugcugagggaauuucgggcucaaauucuuucaguuucaucgaguccccggguaaaggguaugccauuguggacgaaccuuuuagcgagaucccaaggcagggauucuugggcgaaauacgcuguaacucugagagcuccguccucucagcacacgaaaguugccugcgagcucccaaucuaauuagcuacaagccuaugaucgaucagcuggagugcacuacaaaccucauugaccccuuugugguuuucgagcgggguucucugccacaaacccguaaugauaaaacauuugccgcauccaagggcaacagaggggugcaggccuucucaaagggaaguguccaggcugaccuuacuuugauguuugacaacuucgaaguggauuuuguuggcgcggccgugagcugugacgcagcuuuccugaauuuaaccgggugcuacuccuguaacgccggagccagggucugccucucuaucacgucgaccggcacagguacucugagcgcucauaauaaagaugggucacuucacauaguacugccuuccgagaacggaaccaaggaccaaugucagaucuugcauuuuacagugcccgaaguugaggaggaguucauguauaguugcgauggcgacgagcgcccacuccuggugaaagguacucuaauugcaaucgauccguuugacgaucggagagaagccggcggggagucuaccgucgugaauccuaagagcggauccuggaacuucuucgacugguuuucaggccugaugucuugguucgggggaccccucaaaacgauucugcuuaucuguuuguacguagcgcugagcauaggcuuauuuuuccuccugauuuaucuugguaggacagggcugaguaagauguggcuagcugccaccaagaaagcauccuga

SEQ ID NO: 11155 - RNA, 3594 nt, Artificial Sequence
  derived and/or modified CDS sequence (opt3) from RVFV(SA01-1322)__KX096942.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaggagcuguccugcucugugucggguauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaauuguuagaugcggcaggcggcgcgacacuaagcaaaucgguagagaaaccauggccgggauugcaaugacagugcugccugccuuggcugucuuugcacucgccccagugguauucgcugaggauccccaccugaggaaccggccuggaaaaggccauaauuacaucgacggcaugacccaggaagaugccacuuguaagccaguuacauaugcgggggcaugcuccucuuuugacgugcugcucgagaaaggaaaguuccccuuauuucagagcuacgcccaccaucgcacccugcuugaagcuguccacgauacgauaauugccaaagcagacccuccauccugugauuugcagucagcucacgguaacccgugcaugaaggagaagcuggugaugaaaacucauugucccaaugacuaucaaagugcccacuaccuaaacaaugauggcaagauggcgagcgugaaaugcccuccaaaguaugagcucaccgaagacuguaacuucugccgacagaugacaggggccucucugaaaaagggauccuacccccuucaggaccuguuuugccagucaagcgaggaugacggcaguaaauugaagacuaagaugaaaggugucugugaaguuggggugcaagcacucaagaaaugcgauggacagcugucuaccgcucaugagguagugccuuucgccgucuuuaagaauaguaaaaagguguacuuagacaagcuggaucucaaaacagaagagaaccuucugccagacagcuucguuuguuuugagcacaagggccaguauaaaggcaccauggauucggggcagacgaagagagaauugaaaucuuucgacaucucccaaugccccaagauuggaggucacggcucaaagaaauguacuggggaugcugccuuuugcagugcauacgaguguacagcccaguaugcuaaugcguucugcagccaugcaaacggauccggcaucgugcagauccaagucucugguguguggaagaaaccgcuauguguaggguacgaaaggguuguggucaagcgggagcugagcgccaaaccuauucagcguguggaacccugcaccacuuguauaacaaagugcgagccacacggccucgucgugcgcucaaccggauucaagaucaguuccgcuguugccugcgcaagcggcguguguguaacggggucucagucaccuaguaccgagauuacacugaaauaucccggaaucagccaguccucugguggcgacauagggguccauauggcccacgaugaccaaucggugagcuccaagauuguugcucauugcccaccccaggacccuugucuugugcacggaugcaucgucugugcccacggccugaucaauuaccagugccauacugcauugucagcguuugugguaguguucguuuuuaguucuauugcuaucauuugucucgccauacuguauagagucuuaaaaugccugaagaucgcaccaaggaaagugcuaaacccgcucauguggauuaccgccuucauccgguggguguacaagaaaauggucgcucgaguugccgauaacaucaaucaggugaaccgcgaaauugguuggauggaagggggccaacuggugcuuggagaccccgcaccuauaccaagacacgcucccaucccuagguacagcacauauuugaugcugcuccugauuaucuccuacgccucagcguguagcgaacuuauucaggccucuucccggaucacuaccugcaguacagagggcguaaauaccaagugucgccugagcgggacugcuuugauaagagcaggaucugucggugccgaggcuugccucaugcugaagggcgugaaagaagaucagacgaaguuuuuaaaaaucaagacaguuuccucagagcugaguugcagggaagggcagagcuauuggaccggaucguucuccccaaaaugucuaucuagccgucggugccaucucgugggcgagugucacgucaaccgaugccugucauggagagacaaugaaacuuccgccgaguuuuccuucgugggugagucuaccacaaugagggaaaacaaguguuuugagcaaugcgggggcuggggauguggcugcuucaauguuaaccccagcugucuuuuugugcacaccuacuugcaguccguacgcaaggaagcacugcgggucuucaauugcauugauugggugcauaaacucacucuggagaucacagacuuugaugggucagugagcacgauugacuuaggagcgaguucuuccagauucaccaacuggggcagcgucucgcugucacuugaugccgaagguaucucugggaguaauuccuucagcuuuauagagucuccgggaaagggcuaugcuauuguugacgagccuuucagcgaaaucccaaggcagggauuuuugggcgagauucgcuguaacuccgaaucaagugugcucagcgcccacgagucuugccugcgagcacccaaucuaaucuccuacaaaccuaugauagaucagcuggaaugcacuacaaaccucaucgaccccuucguaguguuugagcgggggucacugccacaaacccguaaugagaagacauucgcugccaguaaaggaaacagaggcguccaggcauuuagcaagggguccgugcaggccgaucuuacuuugauguucgacaacuuugaaguugacuucgugggagcugcggucucuugugaugccgcauuucugaauuuaaccggcugcuauucguguaacgcuggugccagggugugccucagcauuacgucaaccgggacaggaacucuguccgcccauaauaaggacggcagucuucacaucguucugccuucugagaacgguaccaaagaucaaugucagauuuugcauuucacagugcccgaagucgaggaggaauuuauguacagcugcgacggcgaugagcgcccacuccugguaaaggggacucuaaucgcuauagacccguucgaugaccggagagaagcaggaggcgaguccaccgugguuaauccuaaaucagggucuuggaacuucuuugauugguucagcggacugaugaguugguuuggcgguccccucaagacgauucugcuuaucuguuuguacguggcccuguccaucggguuauucuuucuccugauuuaucuuggaaggacaggccugagcaaaauguggcuagcggcuaccaagaaggccucuuga

SEQ ID NO: 11156 - RNA, 3594 nt, Artificial Sequence
  derived and/or modified CDS sequence (opt3) from RVFV(KEN/Mal-032/07)__HM586967.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggggauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggccgccugcaggaggaugcgacauguaagccaguuaccuaugcaggcgccugcuccucuuuugacgugcucuuagaaaaagggaaguucccccuguuucagagcuacgcucaccaucgaacucuuuuggaggccguccacgauacaauaauugcaaaagcugacccuccauccugugaucugcagucagccgacggaaacaagugcaugaaggagaagcuagugaugaaaacccacuguccgaaugauuaucaaagugcgcauuaccucaacaaugacgguaaaauggccagcgugaagugucccccuaaauaugaacugacggaggacugcaacuucugcagacagaugacuggcgcaucucuuaagaaaggguccuacccacugcaggauuuguuuugccagucaagcgaagacgauggaaguaagcucaagaccaaaaugaagggcgucugugagguuggugugcaagcucugaaaaagugcgacgggcaguuaucuacagcccacgaaguagugcccuucgcugucuuuaaaaauuccaagaagguguaccuggauaaacucgaccuuaagacugaggagaaccuguugccugauagcuucguuuguuuugaacauaaaggacaguauaagggcaccauggacucgggccagacaaaaagggagcuaaagucuuucgauaucucccaaugcccaaagauugggggacacgguaguaaaaaguguaccggcgacgccgcauuuugcucagccuacgaauguacggcucaguaugcgaaugcauacugcagccacgccaacggguccggaaucgugcagauccaagucucuggcguguggaaaaagccccuguguguagguuaugagcggguuguggucaaacgugaacucagcgcuaagccgauucagcgcguggagccuugcacuacauguauaaccaagugcgagccccaugggcuggucgugagaucaacuggcuucaaaaucaguuccgccguugcaugcgccagcggaguguguguaacaggcucucagucaccaaguaccgaaauuacgcuuaaguacccugggaucagccaguccucuggaggugauauaggcguccacauggcucaugacgaccaaucggugagcuccaaaauuguugcccacugucccccacaggaucccugccuggugcaugggugcaucgucugugcacacggauugaucaauuaucagugccacaccgcgcucucagcuuucgugguaauuuuuguguucaguucuacagccaucauuugucuggcaguuuuauacaggguccugaagugccuaaaaauagccccucggaaggugcucaacccacugauguggaucacugcuuuuauucgauggguguacaaaaagauggucgcccgcguugcagacaacaucaaucaggugaacagagagaucggcuggauggaaggugggcaacuugcuuugggcaauccggcccccauuccuaggcaugcgccaauaccccgguauagcaccuaccugaugcuccugcuuaucguguccuaugccucagcuuguagcgagcugauucaggcaucuucccgcaucacaacuugcaguaccgagggaguaaacacaaaguguagauugagcggcaccgcccucauuagggcugggucugucggagccgaagcaugccugauguuaaaaggugugaaggaggaucagacuaaauuccugaagaucaaaacgguuuccucagaacuaaguugccgugagggccagagcuacuggacagggucguuuuccccuaagugucucucuagccggcgaugccaccuggugggagaaugucaugucaauagaugccuuucauggagggacaacgagaccagugcggaguucuccuuugugggcgaaucuacuaccaugcgcgagaauaaguguuucgaacaaugcgguggguggggcuguggaugcuuuaacguuaauccaagcuguuuguucgugcacacauaucugcaguccguacggaaagaggcccucagagucuuuaacugcauagauugggugcacaagcugaccuuagaaaucacugacuucgauggcucagugagcacaauugaccugggggcuaguucuuccagguuuacgaauuggggaagcgucucgcuuucauuggaugccgagggcaucucugguaguaacuccuucagcuucauugagucucccgggaaaggauacgcaaucguugacgaaccguuuagcgagauaccucgccagggcuuccucggugaaauucgauguaauuccgagucaagugugcugagcgcucaugaaucuugccuacgggccccaaaccugguauccuauaagcccaugaucgaucagcucgagugcaccacuaaucugauugacccuuuuguggucuucgagcguggcucacuuccccaaacaagaaacgauaaaaccuuugcagccaguaaggggaacaggggagugcaggcuuucagcaagggcuccguucaggcggacuugacacugauguuugacaauuucgaaguggauuuugucggggccgcagugucuugugacgcugccuucuuaaaccucacuggaugcuacucguguaaugccggcgcucgcguuugccugagcaucaccucaacggguaccgggacacuuuccgcacacaacaaagauggaagucugcauauaguguugccaucugagaauggcacuaaggaccaaugucagauccuccacuuuaccgucccugaaguagaggaggaguucauguacagcugcgauggugacgagcggccccugcuagugaaaggcacacugauugccaucgauccauuugacgauagaagggaagcgggaggagaguccacuguugugaacccgaagucaggcucuuggaauuucuucgacugguuuagcgggcucaugaguugguucggaggcccucugaaaaccauucuuuugaucugucuguaugucgcuuuauccauaggucucuuuuuccugcuuauuuaccuggggcgaacgggacuaagcaagauguggcucgccgcaacaaagaaagccucuuga

SEQ ID NO: 11157 - RNA, 3594 nt, Artificial Sequence
  derived and/or modified CDS sequence (opt3) from RVFV(KEN/Gar-008/06)__HM586965.1__GP
auguacgugcugcucaccauccuuauuagcguccugguuugcgaggccgugauaagaguauccuugucuucaacaagggaagagacuuguuucggcgacaguacgaaucccgaaaugaucgagggggcuugggauagcuuacgggaagaggagaugccugaggaacuguccugcucugugucggggauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaagaauaguaaaaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguucaaagaaauguacgggcgaugccgcauuuugcagugccuacgaauguacugcucaguaugcgaaugcauacugcagccaugccaacggguccggaaucgugcagauccaagucucuaggguguggaagaaaccgcuauguguaggcuaugagcggguuguggucaagcgugaacugagcgcuaaaccuauucagcgcguggagcccugcacaaccuguauaacuaagugcgagccacacggucucgucgugagaucaacaggguucaagaucaguuccgccguugcaugcgccagcggcguguguguaaccggaucucagucaccuaguacggaaauuacccugaaauaccccggcaucagccaguccucugggggagacauagguguccauauggcucacgaugaccaaucggugagcuccaagauuguugcccauugcccaccccaggacccuugucuugugcacggcugcaucgucugugcacacgggcugaucaauuaucagugccauacagcguugucagcuuucgugguaauuuuuguguucaguucuacugccaucauuugucucgcaguucuguacagggucuuaaaaugccugaagauagccccacggaaagugcuaaacccgcucauguggaucaccgcuuuuauucgauggguguacaagaaaauggucgcccgcguugcagauaacaucaaucaggugaacagagagaucggauggauggaaggcggucaacuggcucuugggaaucccgccccuauuccaaggcacgcgcccauaccucgguauagcacauacuugaugcugcuccugaucguguccuaugccucagcuuguagcgagcuuauucaggcaucuucccgcaucacuaccugcaguacagagggcguaaacaccaaguguagacugagcggaacugccuugauuagggcuggcucugucggggccgaagcaugccucaugcugaagggagugaaagaggaccagacgaaguucuuaaaaaucaagacaguuuccucagaacugaguugccgugagggucagagcuacuggaccggcucguuuuccccaaaaugucuaucuagccggcgaugccaucucgugggggaaugucacgucaauagaugccugucauggagggauaacgagacuuccgcggaguucuccuuugugggagaaucuaccacaaugcgcgagaauaaguguuucgaacaaugcggcgguuggggguguggcugcuuuaacguuaaucccagcugucuuuucgugcacaccuauuugcaguccguacggaaggaggcccugagagucuuuaacugcauagacugggugcauaaacucacucuggaaaucacagauuucgacggaucagugagcacgauugauuuaggcgcuaguucuuccagguuuaccaauugggggagcgucucgcugucacuugacgccgagggaaucucuggcaguaacuccuucagcuucauugagucuccggguaagggguacgcaaucguugaugaaccuuuuagcgagauaccacgccagggauucuugggcgaaauucgauguaauuccgagucaagugugcucagcgcucacgaaucuugccugcgggcccccaaccuaguauccuauaaaccuaugaucgaccagcuggagugcacuacaaaucucauugaucccuuuguggucuucgagcgugguucacugccacaaaccagaaacgacaagacauuugcagccaguaaaggcaacaggggagugcaggcuuucagcaagggauccguucaggcggaucuuacuuugauguuugacaaucugaagguggacuucgucggcgccgcagugucuugugaugcugccuuuuuaaaccucaccgggugcuacucguguaaugccggagcucgcguuugccugagcaucacgucaaccggcacagguacucuuuccgcacauaacaaagacgggagucugcacauaguguugccuucugaaaauggaaccaaggaucaaugucagauccuccauuucacaguccccgagguaaaagaagaguuuauguacagcugcgacggcgaugagcgggcccugcuaaugaaggguacucugauugcgaucgacccauucgaugacagaagggaagcuggcggggaguccaccgugguuaacccgaaaucaggaucuuggaacuuuuucgauugguucagcggccucaugaguugguuugggggaccucugaagacgauucuuuugaucugucuguauguggccuuauccauaggccucuucuuucugcuuauuuaccugggucgaacagggcuaagcaagauguggcucgcagccaccaaaaaggcuucuuga

SEQ ID NO: 11158 - RNA, 3594 nt, Artificial Sequence
  derived and/or modified CDS sequence (opt3) from RVFV(Kenya 56 (IB8))__DQ380190.1__GP
auguacgugcugcucaccauccuuauuacaguccugguuugcgaggccgugauaagagugagcuuguccucuacuagggaagagacguguuucggcgacucaaccagucccgaaaugaucgagggggcuugggauagcuuacgggaagaggagaugccugaggagcuguccugcucuauuucgggaauccgcgaaguaaaaacaucaagccaggagcuauaucgagcacucaaagccauuaucgcggcugacggucugaacaauauaacuugucacggcaaggauccagaggacaaaaucagucuuauuaaggggccgccccauaaaaagcaagucggaaucgugcguugcgaaagaaggcgggaugccaagcagauuggccgcgagaccauggcagguaucgccaugacaguucugccugcuuuggcaguguuugcccucgcuccagucguguucgccgaagacccccaccugagaaacaggccugggaaaggacauaauuacauagauggcaugacccagggcgacgcgacuuguaagccaguaacauaugcaggggccugcuccucuuuugauguucugcucgagaaaggaaaguuccccuuauuucagagcuacgcucaccaucggacccugcuugaagccgugcacgacacgauuaucgcaaaagcugauccuccauccugugacuugcaaucagcccacgguaacccgugcaugaaggagaagcuggucaugaaaacucauugucccaaggauuaucagagugcgcacuaccuaaauaacgacggcaaaauggccagcgugaagugcccuccaaaauaugagcucaccgaagacuguaauuucugccgccagaugacaggggcaucucugaagaaaggauccuacccccuucaggaucuguuuugccaaucaagcgaggacgauggcaguaaguugaagacuaaaaugaagggugugugugaagucgggguucaggcucucaaaaagugcgacggacagcugucuaccgcccaugaggugguaccuuucgcuguguuuaaaaacuccaagaaggucuacuuagauaaacuggaccucaagacagaagagaaucuucugccagauagcuucguguguuuugagcacaaaggccaguauaagggcaccauggacucggggcaaacgaaacgagaauugaagucuuucgauauuucccagugccccaagaucggaggucacggcaguaaaaaguguacuggggacgccgcauuuugcagugccuacgaguguacagcucaguaugcgaacgcauacugcagccaugccaauggauccggcaucguucaaauucaggugucuggugucuggaaaagaccgcuaugugugggguaugaaaggguaguugugaagcgggagcugagcgcuaaaccuauacagcgugucgaacccugcaccacuuguaucacaaagugcgagccacacggccucgugguccgcucaaccggauucaagauuaguuccgccguggcaugcgccagcggcguuugugugacggggucucagucaccuaguaccgagaucacacugaaauaccccggaaugagccaauccucugguggcgauauagggguacauauggcucacgacgaccagucggucagcuccaagauuguggcccauugcccaccccaggauccuugucuuguucacggaugcaucgugugugcacacggccugaucaacuaucagugccauacugcguugucagcuuucgucgugguauuuguguucaguucuguugccauuaucugucucgcaauucuguacaaagucuuaaagugccugaaaauagccccaagaaaggugcuaaauccgcucauguggaucaccgcuuuuauuagguggguguacaaaaagauggucgcccggguugcagacaacaucaaucaagugaaccgagaaaucgguuggauggaagggggccagcccgcucugggaaacccugccccaauuccccgccacgcgccuauaccaagauauagcacauaccuuauguugcugcucaucguguccuaugccucagcuuguagcgaacugauucaggcaucuuccaggaucacuaccugcaguacagagggcguaaauaccaagugucggcuuagcgggacugcccugauucgcgcuggaucugucggugccgaggcaugcuugaugcucaaaggcgugaaggaagaucagacgaaauuccugaagaucaaaacaguuuccucagaguuaaguugcagagaagggcaaagcuacuggaccggaucguuuucccccaagugucugucuagcaggcguugccaucuagugggcgagugucacgucaaccggugccucucauggcgagacaaugaaacuucagcggaguucuccuuugugggugagucuaccacaaugagagaaaacaaguguuucgagcagugcgggggcuggggauguggcugcuuuaauguuaacccgagcugucuguucgugcacaccuaucuucaguccguaaggaaagaagccuugcgcgucuuuaauugcauagauugggugcauaagcugacucucgagaucacagacuucgaugggucagugagcacgauugaccugggagcuaguucuucccgguuuaccaacuggggcagcgucucguuaucacuggaugccgaagguaucucugggaguaauuccuucagcuucauugagucuccuggaaaaggcuacgcaaucguugacgagccauuuagcgaaauacccagacaggguuuccuuggcgagauuagguguaacuccgaaucaaguguguugagcgcucacgagucuugccuccgcgccccuaaucugaucuccuauaagcccaugauugaucaacuagaaugcacuacaaaccugaucgacccauuuguagcauucgagcgagggucacucccucagacccggaaugauaaaacauuugccgcuaguaagggaaaccguggcgugcaggcguucagcaagggguccguccaagccgaccugacucuuauguuugacaauuucgagguggauuuuguuggagcagcugugucuugugacgccgccuucuugaaccugaccggcugcuacucguguaacgcuggugcaagagucugcuuaagcauaacgucaaccgggacaggaacucucuccgcccauaauaaagauggcagucugcacaucgugcuucccucugaaaacgguaccaaggaccagugucagauucugcauuuuacaguuccagagguggaagaggaguucauguacagcugcgauggcgacgaaaggccguugcucgucaaagggacucugaucgcgauugauccuuuugacgaucgccgggaggcuggaggcgaauccaccguagugaaucccaagucagggucuuggaacuucuucgacugguuuagcggacuaaugaguugguucggcgguccacugaaaacgauccuccugauaugucuuuauguugccuuguccauugggcuguuuuucuuacucaucuaccugggaagaacaggccuuagcaagauguggcuggcagccaccaagaaggcuucuuga

SEQ ID NO: 11159 - RNA, 3594 nt, Artificial Sequence
  derived and/or modified CDS sequence (opt3) from RVFV(KEN/Bar-035/07)__HM586969.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggguauucgcgaagucaagaccucaagccaggagcuauaucgagcacucaaagccaucauugcggcugacggacugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggccgccugcaggaggaugcgacauguaagccaguuaccuaugcaggcgccugcuccucuuuugacgugcucuuagaaaaagggaaguucccccuguuucagagcuacgcucaccaucgaacucuuuuggaggccguccacgauacaauaauugcaaaagcugacccuccauccugugaucugcagucagccgacggaaacaagugcaugaaggagaagcuagugaugaaaacccacuguccgaaugauuaucaaagugcgcauuaccucaacaaugacgguaaaauggccagcgugaagugucccccuaaauaugaacugacggaggacugcaacuucugcagacagaugacuggcgcaucucuuaagaaaggguccuacccacugcaggauuuguuuugccagucaagcgaagacgauggaaguaagcucaagaccaaaaugaagggcgucugugagguuggugugcaagcucugaaaaagugcgacgggcaguuaucuacagcccacgaaguagugcccuucgcugucuuuaaaaauuccaagaagguguaccuggauaaacucgaccuuaagacugaggagaaccuguugccugauagcuucguuuguuuugaacauaaaggacaguauaagggcaccauggacucgggccagacaaaaagggagcuaaagucuuucgauaucucccaaugcccaaagauugggggacacgguaguaaaaaguguaccggcgacgccgcauuuugcucagccuacgaauguacggcucaguaugcgaaugcauacugcagccacgccaacggguccggaaucgugcagauccaagucucuggcguguggaaaaagccccuguguguagguuaugagcggguuguggucaaacgugaacucagcgcuaagccgauucagcgcguggagccuugcacuacauguauaaccaagugcgagccccaugggcuggucgugagaucaacuggcuucaaaaucaguuccgccguugcaugcgccagcggaguguguguaacaggcucucagucaccaaguaccgaaauuacgcuuaaguacccugggaucagccaguccucuggaggugauauaggcguccacauggcucaugacgaccaaucggugagcuccaaaauuguugcccacugucccccacaggaucccugccuggugcaugggugcaucgucugugcacacggauugaucaauuaucagugccacaccgcgcucucagcuuucgugguaauuuuuguguucaguucuacagccaucauuugucuggcaguuuuauacaggguccugaagugccuaaaaauagccccucggaaggugcucaacccacugauguggaucacugcuuuuauucgauggguguacaaaaagauggucgcccgcguugcagacaacaucaaucaggugaacagagagaucggcuggauggaaggugggcaacuugcuuugggcaauccggcccccauuccuaggcaugcgccaauaccccgguauagcaccuaccugaugcuccugcuuaucguguccuaugccucagcuuguagcgagcugauucaggcaucuucccgcaucacaacuugcaguaccgagggaguaaacacaaaguguagauugagcggcaccgcccucauuagggcucguucugucggggccgaagcaugccugauguuaaaaggagugaaggaggaucagacuaaauuccugaagaucaaaacgguuuccucagaacuaaguugccgggagggucagagcuacuggacaggcucguuuuccccuaagugucucucuagccgaagaugccaccuggugggggaaugucaugucaauaggugccuuucauggcgcgacaacgagaccagugcggaguucuccuuugugggagaaucuacuaccaugcgggagaauaaguguuucgaacaaugcggcgguuggggguguggcugcuuuaacguuaauccaagcuguuuguucgugcacacauaucugcaguccguaagaaaagaggcccucagggucuuuaacugcauagauugggugcacaagcugaccuuagaaaucacugacuucgauggaucagugagcacaauugaccugggcgcuaguucuucccgcuuuacgaauugggggagcgucucgcuuucauuggaugccgagggaaucucuggcaguaacuccuucagcuucauugagucucccgguaaaggguacgcaaucguugacgaaccguuuagcgagauaccucgacagggauuccucggcgaaauucgguguaauuccgagucaagugugcugagcgcucaugaaucuugccuacgugccccaaaccugguauccuauaagcccaugaucgaucagcucgagugcaccacuaaucugauugacccuuuuguggucuucgagagagguucacuuccccaaacaaggaacgauaaaaccuuugcagccaguaagggcaaccgcggggugcaggcuuucagcaagggauccguucaggcggacuugacacugauguuugacaauuucgaaguggauuuugucggcgccgcagugucuugugacgcugccuucuuaaaccucacugggugcuacucguguaaugccggagcucggguuugccugagcaucaccucaacgggcaccgguacacuuuccgcacacaacaaagaugggagucugcauauaguguugccaucugagaauggaacuaaggaccaaugucagauccuccacuuuaccgucccugaaguagaggaggaguucauguacagcugcgauggcgacgagagaccccugcuagugaaagguacacugauugccaucgauccauuugacgauaggcgagaagcgggcggggaguccacuguugugaacccgaagucaggaucuuggaauuucuucgacugguuuagcggccucaugaguugguucgggggaccucugaaaaccauucuuuugaucugucuguaugucgcuuuauccauaggccucuuuuuccugcuuauuuaccugggucgcacggggcuaagcaagauguggcucgccgcaacaaagaaagccucuuga

SEQ ID NO: 11160 - RNA, 3594 nt, Artificial Sequence
  derived and/or modified CDS sequence (opt3) from RVFV(TAN/Dod-002/07)__HM586971.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggggauucgcgaagucaagaccucaagccaggagcuauaucgagcacucaaagccaucauugcggcugacggucugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggcaugacacaggaggaugcgaccuguaagccaguuacuuaugcaggcgccugcuccucuuuugacgugcugcucgaaaaagggaaguuccccuuauuucagagcuacgcucaccaucgcacacugcuugaggccguccacgauaccauaauugcaaaagcugacccuccauccugugauuugcagucagcccacggaaacccgugcaugaaggagaagcuggugaugaaaacgcauugucccaaugacuaucaaagugcgcacuaccuaaacaaugaugguaagauggccagcgugaaaugcccuccaaaguaugaacucacugaggacuguaacuucugccgacagaugaccggcgcaucucugaaaaagggguccuacccccuucaggaccuguuuugccagucaagcgaagaugacggaaguaaauugaagacaaagaugaaaggcgucugugagguuggugugcaagcucucaagaaaugcgaugggcagcugucuacugcccaugaaguagugccuuucgcugucuuuaagaauaguaaaaagguguacuuagacaagcuggaucucaaaaccgaggagaaccuucugccagacagcuucguuuguuuugaacacaagggacaguauaaaggcacaauggauucgggccagaccaagagagaguugaaaucuuucgacaucucccaaugccccaagauugggggacacgguaggaagaaauguacgggcgaugccgcauuuugcucagccuacgaauguacugcucaguaugcgaaugcauacugcagucaugccaacgggagcggaaucgugcagauccaagucuccggcguguggaagaaaccgcuauguguagguuaugagcggguuguggucaagcgugaacugucugcuaaaccuauucagcgcguggagcccugcacaaccuguauaacuaagugcgagccacacgggcucgucgugagaagcacaggcuucaagaucucaagugccguugcaugcgccuccggaguguguguaaccggcagccagucuccuucaacggaaauuacccugaaauaccccgggaucagucagagcuccggaggugacauaggcguccauauggcucacgaugaccaaucugugucgagcaagauuguugcccauugcccaccccaggacccuugucuugugcacgggugcaucgucugugcacaggcguggaucauuucccaguggcacacagcucugucagccuucgugguaaucuuuguguucaguucuacugcaauuauaugcuuggccguucucuauaggguccugaaauguuuaaagaucgcuccacggaaagugcugaauccgcuaauguggauuaccgccuuuauccgauggguguacaagaaaauggucgcacgcguugcugauaacaucaaccaagugaauagagagauuggauggauggaaggcggucagcucgcccuggggaaccccgcgccuauaccaaggcaugcccccaucccucgguacagcacauaucuuauguugcugcucauuguguccuacgcuucagcaugcagcgagcugauccaggccucuucccgcauuacuaccuguaguacagagggcguaaauaccaagugcagacuuagcggaacugcucugaucagggccggcucugucggggcagaagcguguuugaugcucaagggagugaaagaggaccagacgaaguuccugaaaauaaagacaguuuccucagaauuaaguugccgugagggucaaagcuauuggaccggcucguuuuccccaaaaugccugucuagccggcgaugucaccuagugggggaaugccaugucaacagaugucucucauggagggauaaugagacuuccgccgaguucuccuuugugggagaaucuaccacaaugcgcgagaacaagugcuucgaacaguguggcgguugggggugcggcuguuuuaauguuaaccccagcugccuguucgugcacaccuaccuucaguccguacggaaggaggcuuugagagucuuuaauuguaucgacugggugcacaaacugacucucgaaauuacagauuucgacggaucagugagcacgaucgaucugggcgccaguucuuccagguuuaccaacugggggagcgucucguuaucacuggacgcagagggaauuucuggcaguaauuccuucagcuucaucgagucuccggguaagggguaugcuauaguugaugaaccuuuuagcgagauuccacgccagggauuccuuggcgaaauccgaugcaacuccgagucaaguguguugagcgcccaugaaucuugucuccgggcacccaaucugguauccuacaaaccuaugauugaccaacuagagugcacuacaaaccugaucgaucccuuuguggucuucgagcgugguucacucccacagaccagaaaugacaagacauuugccgcuaguaaaggcaacaggggagugcaggcguucagcaagggauccguucaagccgaucugacucuuauguuugacaacuucgaaguggacuuugucggcgcagcugugucuugcgaugccgccuucuugaaucugaccggguguuauucgugcaacgcuggagcacgcguuuguuuaagcauaacgucaaccggcacagguacucucuccgcccacaauaaggacgggagucugcauaucgugcuuccuucugagaacggaaccaaagaucagugccagauucugcacuuuacaguccccgaaguagaggaggaguucauguacagcugugacggcgaugagcggccauugcucgugaaggguacucugaucgcgauugacccguuugaugacagaagggaagcuggcggggaguccaccguugugaauccuaaaucaggaucuuggaacuucuucgauugguuuagcggccuaaugaguugguucgggggaccccugaagacgauccuccugauaugccuuuacgucgccuuguccauuggccuguuuuucuuacucaucuaucugggucgaacagggcuuagcaaaauguggcuggcagccaccaagaaggcuucuuga

SEQ ID NO: 11161 - RNA, 3594 nt, Artificial Sequence
  derived and/or modified CDS sequence (opt3) from RVFV(Beijing-01)__KX611606.1__GP
auguacgugcugcucaccauccuuauuagcguccugguuuucgaggugguaauaagaguguccuugucuucaacaagggaagagacuugcuuuggcgacaguacgaaccccgaaaugaucgagggggccugggauagcuuacgggaagaggagaugccugaggaacuguccuguucuauuucgggaauccgcgaagucaagaccucaagccaggagcuauaucgagcucucaaagcaauuaucgccgcggacggucugaauaacauaacaugccacggcaaggauccagaggacaaaaucagucuuauuaaggggccgccccauaaaaagcgugugggaaucguuagaugugaaaggcggcgcgaugcuaagcaaauuggcagagagacuauggccgguaucgcaaugaccgugcugccugccuuggcugucuucgcacucgccccagugguauuugcugaagacccccaccugaggaaucggccugggaaaggacauaacuacauagauggcguuacacaggaggacgcuaccugcaagccagugacuuaugcgggcgcauguuccucuuucgauguccugcucgaaaaagggaaguuucccuuauuccagagcuacgcccaccaucgcacacugcuugaggcugugcacgacaccauuaucgccaaagcagauccuccauccugcgacuugcagucagcucacggaaauccguguaugaaggagaagcuggugaugaaaacgcauugccccaacgauuaucaaagugcccacuaccuaaauaacgacgguaagauggcgagcgucaaauguccuccaaaguaugaacucacugaggacugcaauuuuugucgacagaugaccggcgccucucugaaaaagggguccuacccccuucaggaucuguucugccagucaagcgaagacgauggaaguaaauugaagacaaagaugaaaggcguuugcgagguggguguacaagcacucaagaaaugugacgggagacugucuacugcucaugaaguggucccuuuugccguguucaagaacuccaaaaagguuuacuuagauaagcuggaccucaaaaccgaggagaaucuucugccagauagcuuugugugcuucgaacacaagggacaguauaaaggcacaauggacucgggccagaccaagagggaguugaaaucuuuugauauuucccagugucccaagaucgggggacacgguucaaagaaaugcacgggcgacgcugccuucuguagugcauacgaaugcacugcccaauaugcuaacgcguacuguagccaugcaaauggguccggaaucguccagauucaggugucuggcguauggaagaaaccgcuaugcguugguuaugagcggguggucgugaagcgugaacugagcgccaaaccuauacaacgcgucgagcccuguacaaccugcaucacuaagugugagccacacgggcucgugguuagaucaacaggcuucaagauuaguuccgcuguggccugcgcaagcggaguaugcgucaccggcucucagucaccuaguacggaaaucacccugaaauaccccgggauaagccaguccucuggaggugauauuggcgugcauauggcccacgacgaccagucgguuagcuccaagaucguguuugauuguccaccccaagacccuugccuuguccauggguguaucgugugcgcucacggacugauuaacuaucagugucacacagccuugucagcauucguagugguuuuugucuucaguucuguggcgaucauuugccucgcuauacuguacaaaguguuaaggugucugaagaucgccccgaaaaagguccuaaauccacucauguggauuacugcauuuauccgguggguuuacaaaaagaugguggcccgaguggcugauaacaucaaccagguaaaucgcgagauuggcuggauggaaggugggcagcuggcccuuggcaaccccgcaccuauaccaagacaugcucccaucccuagguauagcaccuacuugaugcugcuccugauuaucuccuaugccucagcgugcagcgagcuuauucaagccucuucccggaucacaacuuguaguaccgagggagucaauacaaagugccgccugagcggcaccgcuuugauaagagcagggucugugggagccgaagccugucucauguucgaggguguuaaagaagaccagacuaaguuucugaaaaucaagacgguguccucagaguuaaguugcagggaaggccagagcuacuggacagggucguucuccccaaaaugccugucuagccgucggugucaccuagucggagagugccaugugaaccgaugucucucauggagagauaaugagaccagugccgaauuuuccuucguuggcgagucuacuaccaugagggaaaacaagugcuuugagcagugugguggguggggcugcggauguuucaaugugaaccccagcugccuguuuguacacacauaucuucaauccguccgcaaggaagcauugcggguguucaauuguauugacugggugcacaaacugacccucgagaucacugauuucgacggcucagucagcacaauugaucugggggcgaguucuuccagauuuacgaacuggggaagcguuucguuaucacuggacgccgagggcaucucugguaguaauuccuucagcuuuauagaaucuccggggaagggauacgcuauuguggaugagccuuucagcgaaaucccaaggcagggcuuucuuggugagauucgcugcaacuccgaaucaaguguauugagcgcccaugagucuugucuccgagcacccaaucugaucuccuauaaaccuaugauagaccagcuagagugcaccacuaaccugaucgaucccuucguggucuuugaacggggcucacucccacagacacguaaugacaagaccuucgcugccaguaaagggaacagaggagugcaagcauuuagcaagggcuccguucaggccgaccugacacuuauguucgauaacuuugagguggacuucgucggggcugcggugucuugcgaugccgcauuuuugaaucugacuggauguuacucgugcaacgcuggcgccaggguuuguuuaagcauuaccucaacggguaccgggacacucuccgcccacaauaaggacggaagucugcauaucgugcuuccuucugaaaacggcacuaaagaucagugccaaauucugcacuucaccguccccgagguagaggaagaguucauguacagcugugacggugaugaacgcccauugcucgugaagggcacacugaucgcuauagacccguuugaugaccggagagaggcagggggagaauccacuguugugaauccuaaaucaggcucuuggaacuucuuugauugguucagcgggcuaaugaguugguuuggaggcccccugaagaccauucuccugaucugccuuuaugucgccuuguccaucggucuguucuuuuuacucauuuaccuggggaggacgggacuuagcaaaauguggcuggcggcuacaaagaaggccucuuga

SEQ ID NO: 11162 - RNA, 3594 nt, Artificial Sequence
  derived and/or modified CDS sequence (opt3) from RVFV(Smithburn)__DQ380193.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaggaacuguccugcucuauuucgggaauccgcgaagugaagaccucaagccaggagcuauaucgagcacucaaagccacaauugcggcugacggucugaauaacaucacuugucacggcaaggauccagaggacaaaauaagucuuaucaaggggccgccccauaaaaagcgugucggagugguuagaugcgaaaggcaacgggaugccaagcagauuggccgcgguaccauggcagggaucgccaugacaguguuuccugcucuggucguguucgcauuggccccaguaguuuuugcugaggacccccaccucagaaauaggccuggaaaaggccauaacuacauugauggcaugacccaggaagacgccacuuguaagccagugacauaugcgggggcaugcuccucuuucgauguccugcuggagaaaggaaaguuuccccucuuccagagcuacgcccaccaucggaccuuacuggaagcugugcacgacaucauaauugccaaagcagauccuccauccuguaaucuucaaucagcucacgguaacccgugcaugaaggagaaguuggugaugaaaacguauugucccaaugacuaccagagugcccauuaucugaacaaugauggcaagauggcgagcgucaaaugcccuccaaagcacgagcuaacugaagacuguaacuuuugccgccagaugaccggggccucucucaaagagggauccuacccccugcaggaccuuuucugccaaucaagcgaagaugacggcaguaagcugaaaacaaagaugaaggguguuugugagguggggguacagguguugaaaaagugcgauggacagcucucuacugcacaugaagucgugccuuuugcuguuuucaaaaauuccaagaaaguguaccuggacaaguuagaucugaagaccgaggagaaccuccuuccagacagcuuugucuguuucgaacacaaaggccaguauaagggcacaauggauucggggcaaaucaaacgagagcugaagucuuuugacauuucccagugccccaaaaucggaggucacggcucaaagaaguguaccggggaugccgcuuucugcagugccuacgaauguacggcacaguaugccaaugcuuacugcagccaugcgaacggauccggcaucgugcaaauucagguaucugguguuuggaaaaagccguugugugugggguaugagagagucguggucaaaagggaacuaagcgcaaagccuauacagcggguggagcccugcacuacauguaucaccaaaugcgagccacacggccugguugugcguucaacuggauucaagauuaguuccgccguagcuugcgccagcggcgucugugugacagggucucagucaccuaguaccgaaaucacgcucaaguaccccggaauaagccaauccucugguggcgacauugggguucauauggcacacgaugaccagucggugagcuccaaaaucgucgcccauugcccaccccaggacccuugucuggugcacggaugcaucguaugugcucacggccuuauuaauuaucagugccauaccgccuuuucagcauucgugguugucuuuguguucaguucuguggucaucauuugucuggcgauauuguacaagguucucaaaugccugaagaucgcuccacgcaaaguguuaaacccgcugauguggauuacagccuuuaucagauggguguacaagaaaaugguagcaagggucgccgauaacaucaaucaagugaaccgggagauugguuggauggaagggggccagcuaguucucggaaaucccgcuccuauaccacgacacgcccccaucccucgcuauagcacuuaccugaugcuuuugcugauuguguccuaugcaucagcuuguagcgagcucauccaggccucuuccagaauuaccacaugcaguacugagggcgucaacaccaaguguaggcugagcgggacagcgcuuauccgggccggaucugugggugcugaagcaugccugauguugaagggcguuaaagaggaccagaccaaguuccucaaaauaaagacuguguccucagaacugaguugccgcgaggggcaaagcuacuggacgggaucguuuuccccaaaauguuuaucuagcagaaggugccaucugguaggcgaaugucacgucaaucguugccuaucauggcgggauaacgagacaagugccgaguucuccuuugugggugaaucuaccacuaugcgagagaauaaguguuucgaacagugcgggggcuggggauguggcugcuuuaacgugaaucccagcugucucuucguccacaccuaucugcaguccguuagaaaggaggcucuuaggguguuuaacugcaucgacuggguacauaaauugacacuggaaauuaccgauuucgacgggucagugagcacugucgaucucggagccaguucuucccgcuucacaaauuggggcagcgugucgcugucauuagacgcagaggguaucucugggaguaacuccuuuagcuucauugagucuccgggaaagggcuacgcgaucguugaugaaccuuuuagcgagauaccacggcaggguuuccugggcgaaauuagauguaauuccgagucaagugugcuuagcgcccacgaaucuugcuugagggcucccaaccucaucuccuauaaaccuaugauugaccaacuggagugcacgaccaaucuaaucgaucccuuugucguguucgagcgcgggucacugccacagacucgaaacgacaagacauuugccgcaaguaaaggaaaccggggcguucaggcuuucagcaagggguccgugcaagccgaucucacccugauguuugacaauuucgaagucgacuuuguaggagcagccgugucuugugaugcugcguuccuuaacuugacaggcugcuacucguguaaugccggugcacguguuugccugagcauaacuucaaccgggacgggaaccuuauccgcucauaacaaggacggcagucuccacaucgugcugccuucugagaaugguacaaaagaucagugucagauucuucauuuuacuguccccgaaguggaggaggaauuuauguacagcugcgacggcgaugagagaccacuguugguaaaggggacccucaucgccauugacccguucgaugacaggcgcgaagccggaggcgaguccacaguggucaacccuaaaucagggucuuggaauuucuucgauugguuuagcggacugaugaguugguucggcgguccccuaaagacuauccugcucauaugucuguauguugcucuuuccauuggguuguuuuucuuucugaucuacuuaggacggaccggccucagcaaaauguggcuggcagccacgaagaaggcgucuuga

SEQ ID NO: 11163 - RNA, 3594 nt, Artificial Sequence
  derived and/or modified CDS sequence (opt3) from RVFV(KEN/Bar-032/07)__HM586968.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucugugucggguauucgcgaagucaagaccucaagccaggagcuauaucgagcacucaaagccaucauugcggcugacggacugaauaacaucacaugucacggcaagaauccagaggauaaaauaagucuuaucaaggggccgccccauaaaaagcgugugggaauuguuagaugcgaaaggcggcgcgacgccaagcaaaucggcagagagacuauggcagguauugccaugaccgugcugccugcuuuggcagucuuugcccucgcuccagugguauucgccgaagauccccaccugaggaaccggccugggaaaggacauaauuacaucgacggccgccugcaggaggaugcgacauguaagccaguuaccuaugcaggcgccugcuccucuuuugacgugcucuuagaaaaagggaaguucccccuguuucagagcuacgcucaccaucgaacucuuuuggaggccguccacgauacaauaauugcaaaagcugacccuccauccugugaucugcagucagccgacggaaacaagugcaugaaggagaagcuagugaugaaaacccacuguccgaaugauuaucaaagugcgcauuaccucaacaaugacgguaaaauggccagcgugaagugucccccuaaauaugaacugacggaggacugcaacuucugcagacagaugacuggcgcaucucuuaagaaaggguccuacccacugcaggauuuguuuugccagucaagcgaagacgauggaaguaagcucaagaccaaaaugaagggcgucugugagguuggugugcaagcucugaaaaagugcgacgggcaguuaucuacagcccacgaaguagugcccuucgcugucuuuaaaaauuccaagaagguguaccuggauaaacucgaccuuaagacugaggagaaccuguugccugauagcuucguuuguuuugaacauaaaggacaguauaagggcaccauggacucgggccagacaaaaagggagcuaaagucuuucgauaucucccaaugcccaaagauugggggacacgguaguaaaaaguguaccggcgacgccgcauuuugcucagccuacgaauguacggcucaguaugcgaaugcauacugcagccacgccaacggguccggaaucgugcagauccaagucucuggcguguggaaaaagccccuguguguagguuaugagcggguuguggucaaacgugaacucagcgcuaagccgauucagcgcguggagccuugcacuacauguauaaccaagugcgagccccaugggcuggucgugagaucaacuggcuucaaaaucaguuccgccguugcaugcgccagcggaguguguguaacaggcucucagucaccaaguaccgaaauuacgcuuaaguacccugggaucagccaguccucugucggagauauaggugugcacauggcucaugacgaccaaucgguuagcuccaaaauuguggcccacugucccccacaggaucccugccugguccauggcugcaucgugugugcacacggguugaucaauuaucagugccacaccgcgcucucagcuuucguagugauuuuuguuuucaguucuacagccaucauuugucuggcagucuuauacagggugcugaagugccuaaaaauagccccucggaaggugcucaacccacugauguggaucacugcuuuuauucgaugggucuacaaaaagaugguugcccgcguggcagacaacaucaaucaggugaacagagagaucggauggauggaaggcggucaacuugcuuuggggaauccggcccccauuccuaggcaugcgccaauaccccgguauagcaccuaccugaugcuccugcuuaucguauccuaugccucagcuuguagcgagcugauucaggcaucuucccgcaucacaacuugcaguaccgagggcgucaacacaaaguguagauugagccacaccgcccucauuagggcuggaucugugggcgccgaagcaugccugauguuaaaagggguuaaggaggaucagacuaaauuccugaagaucaaaacgguguccucagaacuaaguugccgugagggacagagcuacuggacagguucguuuuccccuaagugucucucuagccggcgaugccaucuggucggcgaaugucacgugaauagaugccuuucauggagggacaacgagaccagugcggaguucuccuuuguuggggaaucuacuaccaugcgcgagaauaaguguuucgaacaaugcggaggcugggguugugggugcuuuaacgugaauccaagcuguuuguucguacacacauaucugcaguccguccggaaagaggcccucagaguguuuaacugcauagauugggugcauaagcugaccuuagaaaucacugacuucgauggcucagucagcacaauugaccugggagcuaguucuuccagguuuacgaauuggggcagcguuucgcuuucauuggaugccgaggggaucucuggaaguaacuccuucagcuucauugagucucccggcaaagguuacgcaaucguggacgaaccguuuagcgagauaccucgccagggguuccucggagaaauucgauguaauuccgagucaaguguacugagcgcucacgaaucuugccuacgggccccaaaccugguguccuauaagcccaugaucgaucagcucgagugcaccacuaaucugauugacccuuuugucguguucgagcguggcucacuuccccaaacaagaaacgauaaaaccuuugcagccaguaaggguaacaggggcguucaggcuuucagcaagggguccgugcaggcggacuugacacugcgcuuugacaauuucgaagucgauuuugugggagccgcaguuucuugugacgcugccuucuuaaaccucacuggcugcuacucguguaaugccggggcucgggugugccugagcaucaccucaacgggaaccggcacacuuuccgcacauaacaaagaugguagucugcacauagucuugccaucugagaaugggacuaaggaccaaugucagauccuccauuuuaccguaccugaaguggaggaggaguucauguacagcugcgauggagacgagagaccccugcuaguuaaaggcacacugauugccaucgauccauuugacgauaggcgagaagcggguggcgaguccacuguggucaacccgaagucagggucuuggaauuucuucgacugguuuagcggacucaugaguugguucggcgggccucugaaaaccauucuuuugaucugucuguauguggcuuuauccauaggacucuuuuuccugcuuauuuaccugggccgcacgggucuaagcaagauguggcucgccgcaacaaagaaagccucuuga

SEQ ID NO: 11164 - RNA, 3594 nt, Artificial Sequence
  derived and/or modified CDS sequence (opt3) from RVFV(KEN/Gar-004/06)__HM586964.1__GP
auguacgugcugcucaccauccuuauuagcgucuggguuugcgaggccgugauaagaguaucccugucuucaacaagggaagagacuuguuucggcgacaguacgaaccccgaaaugaucgagggggcuugggauagcuugcgggaagaggagaugccugaagaguuauccugcucugugucggguauucgcgaagucaagaccucaagccaggagcuguaucgagcacuaaaagccaucauugcggcugacggacucaauaacaucacaugucacggcaagaauccagaggauaaaauaagucugaucaaggggccgccccauaaaaagcgugugggaauuguuagaugcgaaaggcggcgcgacgccaagcaaaucggcagagagacuauggcagguauugccaugaccgugcuuccugcucuggcagucuuugccuuggcuccagugguauucgccgaagauccccaccucaggaaccggccugggaaaggacauaauuacaucgacggcaugacacaggaggaugcgaccuguaagccaguuacuuaugcaggcgccugcuccucuuuugacgugcugcuggaaaaagggaaguucccccucuuucagagcuacgcucaccaucgcacauuacuggaggccguccacgauaccauaauugcaaaagcugacccuccauccugugaucuucagucagcccacggaaacccgugcaugaaggagaaguuggugaugaaaacgcauugucccaaugacuaucaaagugcgcacuaccugaacaaugaugguaagauggccagcgugaaaugcccuccaaaguaugaacuaacugaggacuguaacuucugccgacagaugaccggcgcaucucucaaaaagggguccuacccccugcaggacuuguuuugccagucaagcgaagaugacggaaguaaacugaagacaaagaugaaaggcgucugugagguuggugugcaagcucuuaagaaaugcgaugggcagcucucuacugcccaugaaguagugccuuucgcugucuuuaaaaauucccagaaaguguaccuggacaaguuagaucugaagaccgaggagaaccuccuuccagacagcuucguuuguuuugaacacaaaggacaguauaagggcacaauggauucgggccaaaccaaaagagagcugaagucuuucgacaucucccagugccccaaaauugggggacacgguaggaagaagcggacgggcgaugccgcauuuuguucagccuacgaaugcacugcucaguaugcgaaugcauacuguagucgugccaacgggagcggaaucgugcaaauccaggucucccgcguguggaaaaagccguugugcguaggcuaugagagaguuguggucaaaagggaacuaucugcuaagccuauucagcggguggagcccuguacaaccugcauaacuaaaugugagccacauggucuggucgugcgaagcacaggguucaagaucucaagugccguugcaugcgccuccggcgugugcguaaccggaagccagucuccuucaacggaaauuacccucaaguaccccggcaucagucaaagcuccgggggagacauagguguccacauggcucaugaugaccagucugugucgagcaaaauuguugcccacuguccaccccaggacccuugccuggugcauggcuguaucgucugcgcacacgggcuuaucaauaaccagucccacucagcgcugagugcuuucgugguaauuuuuguguucucuagcacagccaucauuuguuuggcaguucucuaucgcguccugaagugcuuaaaaauagccccaagaaaggugcugaacccgcuaauguggaucacugcuuuuauuagguggguguacaaaaagauggucgcccggguugcagauaauaucaaccaagugaaucgcgagaucggauggauggaaggcggucagcucgcucuggggaaccccgccccuauuccaagacaugcgcccauaccuagguacuccaccuaucuuauguugcugcucaucgugucauacgccagcgcuuguucugagcugauucaggcauccagucguaucacaacuugcagcaccgagggcguaaauacaaaaugucggcuuucuggaaccgcccugauucgagcuggcuccgucggggccgaagcaugcuugaugcucaagggagugaaggaggaccagacuaaauuccugaagaucaaaacgguuucaagugaauuaagcuguagagagggucaaucguauuggacaggcuccuuuucuccaaagugccugagcucaaggcgcugccaccuagugggggaaugucaugucaaccggugccucaguuggagagauaaugagaccuccgcggaguucucuuuugugggagaaagcacuaccaugagggagaacaaauguuucgaacagugcggcgguuggggguguggcugcuuuaauguuaaccccuccugucuguucgugcacacauaccuucagucaguacgcaaggaggccuugcgagucuuuaauugcauagacugggugcacaagcugacccucgaaaucacugauuucgacggaagcgugaguacaauugaucugggcgcuucuuccagccgguuuacgaacugggggucggucucauuaucucuggacgccgagggaaucaguggcuccaauagcuucucuuucauugagagcccggguaaaggguaugcaaucguugaugaaccuuuuuccgagauaccacgucagggauuccuuggcgaaauuagauguaacucagagaguagcguguugucugcucaugaauccugccucagggcccccaaucugguaucauacaagccuaugaucgaccaacuagaguguaccacuaaccugauugaucccuuuguggucuucgagcgcgguagucucccacagacacggaacgacaaaaccuuugcagccagcaagggcaauagaggggugcaggcuuucuccaaaggaucuguucaagcggaucugacacuuagguuugacaacuucgaaguggacuuugucggcgccgcagugucgugcgaugcugccuucuugaaucugacugggugcuauagcuguaacgccggagcucgaguuugcuuaucaaucaccuccacgggcaccgguacacucagugcacacaauaaggacgggucucugcauauagugcuuccuagcgagaacggaacuaaggaucagugucagauccugcacuuuaccguccccgaaguagaggaggaguucauguacuccugcgacggcgaugaacgcccauugcucgugaaagguacacugauugccaucgacccguuugaugaccggagagaagcgggcggggagucaacuguugugaauccuaagucuggaagcuggaacuucuucgauugguuuaguggccuaauguccugguucgggggaccccugaaaaccauucuccugaucugucuuuacgucgcuuugagcauaggccuguuuuucuuacucauuuaucuggguaggacggggcuuucuaagauguggcuggccgcaacaaagaaggccucauga

SEQ ID NO: 11165 - RNA, 3621 nt, Artificial Sequence
  derived and/or modified CDS sequence (opt3) from RVFV(RVFV)__M11157.1__GP
auguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaggagcuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcagucagcccacggaaauccgugcaugaaggagaagcuggucaugaaaacgcauugucccaacgauuaucaaagugcgcacuaccuaaauaacgacgguaagauggccagcgugaaaugcccuccaaaguauggccucacugaagacuguaauuucugccgacagaugaccggggcaucucugaaaaagggauccuacccccuucaggaucuguuuugccagucaagcgaggacgauggcaguaaauugaagacaaagaugaaaggugugugugaagucgggguucaagcucauaagaaaugcgacggacagcucucuacugcccacgaggugguaccuuucgcuguguuuaagaacuccaaaaaggucuaccuggauaaguuagaccugaaaaccgaagagaaucuccuuccagauagcuucguguguuuugagcacaagggccaguauaaaggcacaauggacucggggcagaccaagagagaacugaaaucuuucgauauuucccaaugccccaagaucggaggucauggcucaaagaaauguacgggggacgccgcauuuugcagugccuacgaguguacugcucaguaugcgaacgcauacugcagccacgccaauggauccggcaucguucagauucaagugucuggugucuggaagaaaccguugugugugggguaugaaaggguaguugugaagcgggagcuaagcgcuaaaccuauacagcgugucgaacccugcacaaccuguaucacuaagugcgagccacauggccuggugguccgcucaacaggauucaagauuaguuccgccguggcaugcgccagcggcguuugugugaccgggucucagucaccuaguacggagaucacccucaaauaccccggaauaagccaguccucugguggcgauauugggguacacauggcucaugacgaccaaucggucagcuccaagaucguggcccacugcccaccccaggauccuugucugguucacggaugcaucgugugugcacauggccuuauuaacuaucagugccacacagcgcugucagcuuucgucgugguauuuguguucaguucuaucgccauuauauguuuggcaguucucuacagaguccugaaaugcuuaaagaucgccccaaggaaagugcugaauccgcuaauguggauuacugcuuuuauccgguggaucuacaagaaaaugguggcccgagucgcacauaacauuaaccagguuaaucgcgaaauagguuggauggaagggggccaacucgugcugggaaaccccgcuccuaucccaagacacgcccccauuccuagguauagcaccuaccuuauguugcugcucaucguguccuaugcgucagccuguagcgaacugauucaggcuucuucccggaucacaacuugcaguaccgagggcguaaauacaaagugucgccuuagcgggaccgcacugauaagagccggaucugucggugcugaggccugcuugaugcucaagggcgugaaagaagaccagacuaaguuccugaaaaucaagacgguuuccucagaguuaaguugcagggaagggcagagcuacuggacaggaucgauuuccccaaaaugucugucuagccgucggugccaccuagugggcgagugucaugucaaccgaugccucucauggagagauaaugaaaccagugcagaguuuuccuucgugggugagucuacuaccaugagggaaaacaaguguuuugagcaaugcgggggcuggggauguggcugcuucaauguuaaccccagcugucuguuugugcacacauaucuucaguccguacgcaaggaagcguugcgggucuucaauugcaucgacugggugcauaaacugacccucgagauuacugauuuugacgggucagugagcacaaucgaucugggagccaguucuuccagauucacgaacuggggcagcgucucguuaucacuggacgcugaagguauaucugggaguaauuccuuuagcuucauugagucuccgagcaagggauacgccaucguugaugagccuuucuccgaaauuccaaggcagggcuuucuuggugagauccgcuguaacucagaaaguagcguguugucugcacacgaguccugccuccgagcucccaaucugauaucauauaaaccuaugaucgaccagcuagaaugcaccacuaaccugauugaucccuucguaguguuugagcggggcagucucccacaaacacguaaugacaagaccuucgccgcaagcaaagggaacagaggaguccaggccuuuuccaagggcucugugcaggcugaucugacacuuauguucgacaacuuugagguugacuucgugggggcggccgucucgugugaugcagccuuuuugaaucugacuggaugcuacagcuguaacgcuggcgccagggugugcuuaucaaucaccuccacggguaccgggagucucucugcucauaauaaggacggaagccugcacauuguucuuccuuccgaaaacggcacaaaagaucaaugucagauccugcacuucacugugcccgaggucgaagaggaguuuauguacucaugcgacggugaugaacgcccauugcucguaaagggcacccugauagcaauugacccguucgaugaccggagagaggccgggggagaaucuacagugguuaauccuaaaagcggcaguuggaacuuuuucgauugguucuccgggcuaaugagcugguuuggaggcccccugaagcucuauucuucauucgcguguaugcugcauuaccagcuugguuccuuuaguagcuuguauauccuggaggaacaggcuucguuaaaaugcgggcuccugccacuuaggcgaccccaccgcucugugcgggucaaggugaucuguuga

SEQ ID NO: 11166 - RNA, 3480 nt, Artificial Sequence
  derived and/or modified CDS sequence (opt3) from RVFV(ZH-548)__DQ380206.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcucagugcucacgggaacccaugcaugaaggaaaaguuagucaugaaaacccauuguccgaaugacuaccaguccgcccacuaucugaacaaugauggaaagauggcgucugugaaaugucccccuaaguacgagcuuacugaagacugcaacuuuugccggcaaaugacaggugccagcuugaaaaagggcuccuauccacugcaggaccuauucugucagucaagugaggaugacgggagcaaacucaagaccaagaugaaaggaguaugcgagguuggcgugcaggcacugaagaaaugcgauggucaacuuucuacggcucaugaagucgugcccuuugccguguucaaaaauuccaagaaggucuaccuggacaaguuggaucucaaaacugaggaaaaccuguuaccugacucauuuguuuguuucgagcacaaggggcaguacaaaggaaccauggauagcggccagacaaagcgcgaacugaaaaguuuugacauaucucagugcccaaagauuggcgggcacggauccaagaaauguacuggugaugcugccuucugcagcgcauaugaguguaccgcccaauacgcuaaugcguauugcucgcaugcaaacggcucugggaucgugcagauucagguauccggaguguggaagaaaccccucugugucggcuacgagcgagugguugugaagagagaacuuucagccaaaccgauccaaagggucgagccuugcacaaccuguaucacgaagugcgaaccccacggucuggugguacggaguacuggguuuaagauuagcuccgcuguugccugugcaucuggcgugugcgucacaggaagccagucaccaaguaccgagauaacuuugaaauauccuggcaucucccagagcucugggggagacauuggugugcauauggcccacgaugaccagucagucaguagcaagaucguggcucauugucccccacaagaccccugccuaguucacgauugcauagugugugcccacggccugauuaauuaccagugccauacagcacucuccgcguucguagucguguucguguuuucuucgaucgcuaucauuugucuggccauccuuuaucguguucugaaaugcuugaagauugcaccucgcaaaguccucaacccacugauguggauaaccgccuucaucagauggauuuacaagaaaaugguggcuaggguagccgacaauaucaaccaggugaaccgggaaaucggguggauggagggaggccaguuaguucuggguaauccggcacccauuccucgacacgcuccaauaccccgcuacagcacguaucuaaugcuccugcuuaucgucuccuacgccucagcguguagugaguugauucaagccucuagcagaaucaccacaugcuccacugaaggggugaacaccaaguguaggcugucaggcacagcucucauucgggcaggaagcgugggcgccgaggcuugccugaugcuuaagggggucaaagaagaucagacuaaguuucugaaaaucaagaccguuucuuccgaguugaguugucgcgagggacagagcuauuggacagguucuuucuccccuaaaugccucucaaguagaaggugccaucuggugggcgaaugucacgugaaucguugcuuaagcuggcgggacaacgagaccucggccgaauuuuccuucguaggggagucuacuacgaugcgagaaaauaaguguuuugagcagugcggaggcugggguugugggugcuucaacgucaauccaagcugucuguuugugcacacauaccuacaaucaguuagaaaggaggcacucaggguguucaacugcauagauuggguccauaaacugacccuugaaaucacugacuuugauggcaguguguccaccauugacuugggagcgucuagcucccgcuucacaaauuggggcucaguuagccugagucucgaugccgaggggaucucuggauccaacagcuuuucguucauugaaucacccggcaaggguuaugcuaucguggacgagccguucucugaaauaccucggcagggguuucugggagagauuagauguaauagugaguccagcguauuaucugcccacgaaagcugccugagggcaccaaaccuuaucuccuacaaacccaugauugaucaguuggaguguaccacuaaucucaucgacccuuucgucguguuugaacgcggcucacugccccagacacgaaacgauaagacguucgcugccaguaaagguaaucggggcgugcaagcauuuagcaaggggucuguccaggccgaccuaacccugauguucgacaacuuugagguugauuucgugggagcugcgguauccugcgacgccgcauuucucaaccugacuggcugcuauucauguaaugcuggggcccgugugugccuuaguauaacaagcaccggaacaggcuccuugucugcccauaacaaggaugguucgcugcacaucgucuuaccaagcgaaaaugggacuaaagaccagugucaaauucuccauuucaccgugccugagguugaggaagaguuuauguacucaugcgauggagacgaaagaccccugcuugugaagggcacgcugaucgcuauugauccauucgacgauaggcgcgaggccgguggcgaguccaccgucgugaacccgaaaagugggucuuggaacuuuuucgacugguucagcggauugauguccugguuuggcgggccucucaagacaauccugcuaauaugucuguacguugcacucucaauuggacuguucuuucuuuugaucuaucugggccggacugguuuaucuaaaauguggcucgcggcuaccaagaaggccagcuga

SEQ ID NO: 11167 - RNA, 3480 nt, Artificial Sequence
  derived and/or modified CDS sequence (opt3) from RVFV(ZS-6365)__DQ380205.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaagaaggucuaccuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcacggauccaagaaauguacuggugaugcugccuucugcagcgcauaugaguguaccgcccaguacgcuaaugcguauugcucgcaugcaaacggcucugggaucgugcagauucaaguauccggaguguggaagaaaccccugugugucggcuacgagcgagugguugugaagagagaacucucagccaaaccgauccagagggucgagccuugcacaaccuguaucacgaagugcgaaccccacggucuugugguacggaguacuggguuuaagauuagcuccgcuguugccugugcaucuggcgugugcgucacaggaagccagucaccaaguaccgagauaacucugaaauauccuggcaucucccagagcucugggggagacauuggugugcauauggcccacgaugaccaaucagucaguagcaagaucguggcucauugucccccacaggaccccugcuugguucacggcugcauagugugugcccacgggcuaauuaauuaccagugccauacagcacuguccgcguucguagucguguucguguuuucuucgaucgcuaucauuugucucgccauccuguaucguguucuuaaaugccugaagauugcaccucgcaaagucuugaacccacucauguggauaaccgccuucaucagauggauuuacaagaaaaugguggcuaggguagccgauaauaucaaccaggugaaccgggaaaucggauggauggagggcggucaacugguuuuagggaauccggcacccauuccucgacacgcuccaauaccccgcuacagcacguaucugaugcuacuccugaucgucuccuacgccucagcguguagugagcuuauucaggccucuagcagaaucaccacaugcuccacugaaggcgugaacaccaaguguagguugucaggaacagcucugauucgggcaggcagcgugggggccgaggcuugccucaugcugaagggagucaaagaagaccagacuaaguuucuuaaaaucaagaccguuucuuccgagcugaguugucgcgagggucagagcuauuggacaggcucuuucuccccuaaaugcuugucaaguagaaggugccaucucgugggggaaugucacgugaaucguugccugagcuggcgggauaacgagaccucggccgaauuuuccuucguaggagagucuacuacgaugcgagaaaauaaguguuuugagcaaugcggcgguuggggguguggcugcuucaacgucaauccaagcuguuuauuugugcacacauaccugcagucaguuagaaaggaggcacuaaggguguucaacugcauagacuggguccauaaacucacccuggaaaucacugauuuugacggaaguguguccaccauugaucuuggcgcgucuagcucccgcuucacaaauugggggucaguuagcuugagucuggacgccgagggaaucucuggcuccaacagcuuuucguucauugaaucacccgguaagggguaugcuaucguggaugagccguucucugaaauaccucggcagggauuucucggcgagauuagauguaauagugaguccagcguacugucugcccacgaaagcugcuuaagggcaccaaaccugaucuccuacaaacccaugauugaccagcuugaguguaccacuaauuugaucgauccuuucgucguguuugaacgcgguucacucccccaaacacgaaacgacaagacguucgcugccaguaaaggcaaucguggggugcaggcauuuagcaagggaucuguccaggccgaucugacccuaauguucgacaacuuugagguugacuucgugggcgcugcgguauccugcgaugccgcauuucugaaccucacugggugcuauucauguaaugcuggagcccgggugugccugaguauaacaagcaccggcacagguucccuuucugcccauaacaaggacgggucguugcacaucguccugccaagcgaaaauggaacuaaagaucaaugucagauuuuacauuucaccgugccugagguugaggaagaguuuauguacucaugcgacggcgaugaaagaccccuccuggugaaggguacgcuuaucgcuauugacccauucgaugacaggcgcgaggcaggcggggaguccaccgucgugaacccgaaaaguggaucuuggaacuuuuucgauugguucagcggccugauguccugguuugggggaccuuugaagacaauccuccugauaugucuauacguugcccugucaauuggccucuucuuucugcuuaucuauuugggucggacugggcugucuaaaaugugguuagcggcuaccaagaaggccagcuga

SEQ ID NO: 11168 - RNA, 3480 nt, Artificial Sequence
  derived and/or modified CDS sequence (opt3) from RVFV(MP-12)__DQ380208.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcucagugcucacgggaacccaugcaugaaggaaaaguuagucaugaaaacccauuguccgaaugacuaccaguccgcccaccaucugaacaaugauggaaagauggcgucugugaaaugucccccuaaguaugagcuuacugaagacugcaacuuuugccggcaaaugacaggugccagcuugaaaaagggcuccuacccacugcaggaccuauucugucagucaagugaggaugacgggagcaaacucaagaccaagaugaaaggaguaugcgagguuggcgugcaggcacugaagaaaugcgauggucaacuuucuacggcucacgaagucgugcccuuugccguguucaaaaauuccaagaaggucuaucuggacaaguuggaucucaaaacugaggaaaaccuguuaccugacucauuuguuuguuucgagcacaaggggcaguacaaaggaaccauggauagcggccagacaaagcgcgaacugaaaaguuuugacauaucucagugcccaaagauuggcgggcauggauccaagaaauguacuggugaugcugccuucugcagcgcauacgaguguaccgcccaauaugcuaaugcguacugcucgcacgcaaacggcucugggaucgugcagauucagguauccggaguguggaagaaaccccucugugucggcuaugagcgagugguugugaagagagaacuuucagccaaaccgauccaaagggucgagccuugcacaaccuguaucacgaagugcgaaccccauggucuggugguacggaguacuggguuuaagauuagcuccgcuguugccugugcaucuggcgugugcgucacaggaagccagucaccaaguaccgagauaacuuugaaauacccuggcaucucccagagcucugggggagacauuggugugcacauggcccaugaugaccagucagucaguagcaagaucguggcucacugucccccacaagaccccugccuaguucacgauugcauagugugugcccauggccugauuaauuaucagugccacacagcacucuccgcguucguagucguguucguguuuucuucgaucgcuaucauuugucuggccauccuuuaccguguucugaaaugcuugaagauugcaccucgcaaaguccucaacccacugauguggauaaccgccuucaucagauggauuuauaagaaaaugguggcuaggguagccgacaauaucaaccaggugaaccgggaaaucggguggauggagggaggccaguuaguucuggguaauccggcacccauuccucgacaugcuccaauaccccgcuacagcacguaccuaaugcuccugcuuaucgucuccuaugccucagcguguagugaguugauucaagccucuagcagaaucaccacaugcuccacugaaggggugaacaccaaguguaggcugucaggcacagcucucauucgggcaggaagcgugggcgccgaggcuugccugaugcuuaagggggucaaagaagaucagacuaaguuucugaaauugaagaccguuucuuccgagcucaguugucgcgagggacagagcuacuggacagguucuuucuccccuaaaugccugucaaguagaaggugccacuuagugggcgaaugucacgugaaucguugccugagcuggcgggacaacgagaccucggccgaauuuuccuucguaggggagucuacuacgaugcgagaaaauaaguguuuugagcagugcggaggcugggguugugggugcuucaacgucaauccaagcugucuauuugugcauacauaucuccaaucaguuagaaaggaggcacugaggguguucaacugcaucgauuggguccacaaacuuaccuuggaaauaacugacuuugauggcaguguguccaccaucgaccugggagcgucuagcucccgcuucacaaauuggggcucaguuagccucagucuggaugccgaggggauuucuggauccaacagcuuuucguucaucgaaucacccggcaaggguuacgcuauuguggacgagccguucucugaaaucccucggcagggguuuuuaggagagauaagauguaauagugaguccagcguacugucugcccaugaaagcugccuuagggcaccaaacuugauuuccuauaaacccaugaucgaucagcucgaguguaccacuaaucugauugacccuuucgucguguuugaacgcggcucacuaccccagacacgaaacgauaagacguucgcugccaguaaagguaaucggggcgugcaagcauuuagcaaggggucuguccaggccgaccugacccucauguucgacaacuuugagguugauuucgugggagcugcgguauccugcgacgccgcauuucugaaccuuacuggcugcuacucauguaaugcuggggcccgugugugcuugaguaucacaagcaccggaacaggcucccugucugcccacaacaaggaugguucguuacauauaguccucccaagcgaaaaugggacuaaagaccagugucaaauccugcacuucaccgugccugagguugaggaagaguuuauguauucaugcgauggagacgaaagaccccuucuggugaagggcacguugauugcuaucgauccauucgacgauaggcgcgaggccgguggcgaguccaccgucgugaacccgaaaagugggucuuggaacuuuuucgacugguucagcggacucauguccugguuuggcgggccucugaagacaauucuacugaucugucucuacguugcacugucaauaggacuuuucuuuuugcugauuuacuuaggcgguacugggcucucuaaaauguggcuggcggcuaccaagaaggccagcuga

SEQ ID NO: 11169 - RNA, 3480 nt, Artificial Sequence
  derived and/or modified CDS sequence (opt3) from RVFV(T1)__DQ380201.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaagaaggucuaccuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcacggauccaagaaauguacuggugaugcugccuucugcagcgcauaugaguguaccgcccaguacgcuaaugcguauugcucgcaugcaaacggcucugggaucgugcagauucaaguauccggaguguggaagaaaccccugugugucggcuacgagcgagugguugugaagagagaacucucagccaaaccgauccagagggucgagccuugcacaaccuguaucacgaagugcgaaccccacggucuugugguacggaguacuggguuuaagauuagcuccgcuguugccugugcaucuggcgugugcgucacaggaagccagucaccaaguaccgagauaacucugaaauauccuggcaucucccagagcucugggggagacauuggugugcauauggcccacgaugaccaaucagucaguagcaagaucguggcucauugucccccacaggaccccugcuugguucacggcugcauagugugugcccacgggcuaauuaauuaccagugccauacagcacuguccgcguucguagucguguucguguuuucuucgaucgcuaucauuugucucgccguucuguaucguguccuuaaaugccugaagaucgcaccucgcaaaguguugaacccacucauguggauuaccgccuucauaagauggaucuacaagaaaaugguagcuaggguggccgauaauauuaaccagguuaaccgggaaaucggauggauggagggcggucaacuggucuuagggaauccggcacccaucccucgacacgcuccaauuccccgcuacagcacguaucugaugcuacuccugauaguguccuacgccucagcguguagugagcuuauccaggccucuagcagaauuaccacaugcuccacugaaggcgugaacaccaaguguagguugucaggaacagcucugauccgggcaggcagcgucggggccgaggcuugccucaugcugaagggaguuaaagaagaccagacuaaguuucuuaaaauuaagaccgugucuuccgagcugaguugucgcgagggucagagcuauuggacaggcucuuucuccccuaaaugcuugucaaguagaaggugccaucucgugggggaaugucacguaaaucguugccugagcuggcgggauaacgagaccucggccgaauuuuccuucgucggagagucuacuacgaugcgagaaaauaaguguuuugagcaaugcggcgguuggggguguggcugcuucaacgugaauccaagcuguuuauuuguucacacauaccugcagucagugagaaaggaggcacuaagggucuucaacugcaucgacugggugcauaaacucacccuggaaauaacugauuuugacggaaguguuuccaccaucgaucuuggcgcgucuagcucccgcuucacaaauugggggucagugagcuugagucuggacgccgagggaauuucuggcuccaacagcuuuucguucaucgaaucacccgguaagggguaugcuauuguagaugagccguucucugaaaucccucggcagggauuucucggcgagauaagauguaauagugaguccagcguccugucugcccacgaaagcugcuuaagggcaccaaaccugauuuccuacaaacccaugaucgaccagcuugaguguaccacuaauuugauugauccuuucgugguguuugaacgcgguucacucccccaaacacgaaacgacaagacguucgcugccaguaaaggcaaucgugggguccaggcauuuagcaagggaucuguucaggccgaucugacccuaauguucgacaacuuugagguggacuucguaggcgcugcgguguccugcgaugccgcauuucugaaccucacugggugcuauucauguaaugcuggagcccgggucugccugaguaucacaagcaccggcacagguucccuuucugcccauaacaaggacgggucguugcacauagugcugccaagcgaaaauggaacuaaagaucaaugucagaucuuacauuucaccguuccugagguggaggaagaguuuauguacucaugcgacggcgaugaaagaccccuccuggucaaggguacgcuuauugcuaucgacccauucgaugacaggcgcgaggcaggcggggaguccaccgugguuaacccgaaaaguggaucuuggaacuuuuucgauugguucagcggccugauguccugguuugggggaccuuugaagacaauucuccugaucugucuauacguggcccugucaauaggccucuucuuucugcuuauuuauuugggucggacugggcugucuaaaaugugguuagcggcuaccaagaaggccagcuga

SEQ ID NO: 11170 - RNA, 3480 nt, Artificial Sequence
  derived and/or modified CDS sequence (opt3) from RVFV(1853/78)__DQ380220.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaagaauagcaaaaaggucuaccuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcacggauccaagaaauguacuggugaugcugccuucugcagcgcauaugaguguaccgcccaguacgcuaaugcguauugcucgcaugcaaacggcucuggggugguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagacaucgguguccauauggcccacgaugaccaaucagugaguagcaagauuguugcucauugucccccacaggaccccugcuuggugcacggcugcaucguaugugcccacgggcuaauaaauuaccagugccauacagcacuguccgcguucgucgugguuuucguguuuucuucgauugcuaucaucugucucgccauucuguaucguguccuuaaaugccugaagaucgcaccucgcaaaguguugaacccacucauguggauuaccgccuucauaagauggguauacaagaaaaugguggcuaggguugccgauaauaucaaccaggucaaccgggaaauuggauggauggagggcggucaacugguguuagggaauccggcacccaucccucgacacgcuccaaucccccgcuacagcacguaucugaugcuacuccugauuguguccuacgccucagcguguagugagcuuauacaggccucuagcagaaucaccacaugcuccacugaaggcgucaacaccaaguguagguugucaggaacagcucugauucgggcaggcagcguuggggccgaggcuugccucaugcugaagggagugaaagaagaccagacuaaguuucuuaaaaucaagaccgugucuuccgagcugaguugucgcgagggucagagcuauuggacaggcucuuucuccccuaaaugcuugucaaguagaaggugccaucucguaggggaaugucacgucaaucguugccugagcuggcgggauaacgagaccucggccgaauuuuccuucgugggagagucuacuacgaugcgagaaaauaaguguuuugagcaaugcggcgguuggggguguggcugcuucaacguuaauccaagcuguuuauuugugcacacauaccugcagucagucagaaaggaggcacuaaggguguucaacugcauugacuggguucauaaacucacccuggaaaucacugauuuugacggaaguguguccaccauagaucuuggcgcgucuagcucccgcuucacaaauugggggucaguauccuugagucuggacgccgagggaaucucuggcuccaacagcuuuucguucauugaaucacccgguaagggguaugcuaucgucgaugagccguucucugaaauuccucggcagggauuucucggcgagaucagauguaauagugaguccagcgugcugucugcccacgaaagcugcuuaagggcaccaaaccugauauccuacaaacccaugauugaccagcuugaguguaccacuaauuugaucgauccuuucguggucuuugaacgcgguucacucccccaaacacgaaacgacaagacguucgcugccaguaaaggcaaucgugggguucaggcauuuagcaagggaucugugcaggccgaucugacccuaauguucgacaacuuugagguagacuucgugggcgcugcggucuccugcgaugccgcauuucugaaccucacugggugcuauucauguaaugcuggagcccgggugugccugaguauuacaagcaccggcacagguacucuuuccgcccauaacaaggacgggucuuugcacaucguucugccaucggaaaauggaaccaaagaucaaugucagauauuacauuucacggugccugaggucgaggaagaguuuauguacagcugcgacggcgaugaaagaccccuccuggugaaggguacccuuaucgcuauugacccauucgaugacaggcgcgaggcaggcggggagucaacaguugugaacccgaaauccggaaguuggaacuuuuucgauugguucucuggccugaugagcugguuugggggaccuuugaagacuauccuccugauuugucuauacgucgcccuguccaucggccucuucuuucugcuuauauauuugggucggaccgggcugucaaaaaugugguuagcggcuacaaagaaggccucuuga

SEQ ID NO: 11171 - RNA, 3480 nt, Artificial Sequence
  derived and/or modified CDS sequence (opt3) from RVFV(CAR-R1622)__DQ380219.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaagaaggucuaccuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcacggauccaagaaauguacuggugaugcugccuucugcagcgcauaugaguguaccgcccaguacgcuaaugcguauugcucgcaugcaaacggcucugggaucgugcagauucaaguauccggaguguggaagaaaccccugugugucggcuacgagcgagugguugugaagagagaacucucagccaaaccgauccagagggucgagccuugcacaaccuguaucacgaagugcgaaccccacggucuugugguacggaguacuggguuuaagauuagcuccgcuguugccugugcaucuggcgugugcgucacaggaagccagucaccaaguaccgagauaacucugaaauauccuggcaucucccagagcucugggggagacauuggugugcauauggcccacgaugaccaaucagucaguagcaagaucguggcucauugucccccacaggaccccugcuugguucacggcugcauagugugugcccacgggcuaauuaauuaccagugccauacagcacuguccgcguucguagucguguucguguuuucuucgaucgcuaucauuugucucgccauccuguaucguguucuuaaaugccugaagauugcaccucgcaaagucuugaacccacucauguggauaaccgccuucaucagauggguguacaagaaaaugguagcuaggguggccgauaauauuaaccagguuaaccgggaaaucggauggauggagggcggucaacuggucuuagggaauccggcacccaucccucgacacgcuccaauuccccgcuacagcacguaucugaugcuacuccugauaguguccuacgccucagcguguagugagcuuauccaggccucuagcagaauuaccacaugcuccacugaaggcgugaacaccaaguguagguugucaggaacagcucugauccgggcaggcagcgucggggccgaggcuugccucaugcugaagggaguuaaagaagaccagacuaaguuucuuaaaauuaagaccgugucuuccgagcugaguugucgcgagggucagagcuauuggacaggcucuuucuccccuaaaugcuugucaaguagaaggugccaucucgugggggaaugucacguaaaucguugccugagcuggcgggauaacgagaccucggccgaauuuuccuucgucggagagucuacuacgaugcgagaaaauaaguguuuugagcaaugcggcgguuggggguguggcugcuucaacgugaauccaagcuguuuauuuguucacacauaccugcagucagugagaaaggaggcacuaagggucuucaacugcaucgacugggugcauaaacucacccuggaaauaacugauuuugacggaaguguuuccaccaucgaucuuggcgcgucuagcucccgcuucacaaauugggggucagugagcuugagucuggacgccgagggaauuucuggcuccaacagcuuuucguucaucgaaucacccgguaagggguaugcuauuguagaugagccguucucugaaaucccucggcagggauuucucggcgagauaagauguaauagugaguccagcguccugucugcccacgaaagcugcuuaagggcaccaaaccugauuuccuacaaacccaugaucgaccagcuugaguguaccacuaauuugauugauccuuucgugguguuugaacgcgguucacucccccaaacacgaaacgacaagacguucgcugccaguaaaggcaaucgugggguccaggcauuuagcaagggaucuguucaggccgaucugacccuaauguucgacaacuuugagguggacuucguaggcgcugcgguguccugcgaugccgcauuucugaaccucacugggugcuauucauguaaugcuggagcccgggucugccugaguaucacaagcaccggcacagguacucuuuccgcccauaacaaggacgggucuuugcacauagugcugccaucggaaaauggaaccaaagaucaaugucagaucuuacauuucacgguuccugagguggaggaagaguuuauguacagcugcgacggcgaugaaagaccccuccuggucaaggguacccuuauugcuaucgacccauucgaugacaggcgcgaggcaggcggggagucaacagugguuaacccgaaauccggaaguuggaacuuuuucgauugguucucuggccugaugagcugguuugggggaccuuugaagacuauucuccugaucugucuauacguggcccuguccauaggccucuucuuucugcuuauuuauuugggucggaccgggcugucaaaaaugugguuagcggcuacaaagaaggccucuuga

SEQ ID NO: 11172 - RNA, 3480 nt, Artificial Sequence
  derived and/or modified CDS sequence (opt3) from RVFV(2250/74)__DQ380209.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaagaaggucuaccuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcacggauccaagaaauguacuggugaugcugccuucugcagcgcauaugaguguaccgcccaguacgcuaaugcguauugcucgcaugcaaacggcucugggaucgugcagauucaaguauccggaguguggaagaaaccccugugugucggcuacgagcgagugguugugaagagagaacucucagccaaaccgauccagagggucgagccuugcacaaccuguaucacgaagugcgaaccccacggucuugugguacggaguacuggguuuaagauuagcuccgcuguugccugugcaucuggcgugugcgucacaggaagccagucaccaaguaccgagauaacucugaaauauccuggcaucucccagagcucugggggagacauuggugugcauauggcccacgaugaccaaucagucaguagcaagaucguggcucauugucccccacaggaccccugcuugguucacggcugcauagugugugcccacgggcuaauuaauuaccagugccauacagcacuguccgcguucguagucguguucguguuuucuucgaucgcuaucauuugucucgccauccuguaucguguucuuaaaugccugaagauugcaccucgcaaagucuugaacccacucauguggauaaccgccuucaucagauggauuuacaagaaaaugguggcuaggguagccgauaauaucaaccaggugaaccgggaaaucggauggauggagggcggucaacugguuuuagggaauccggcacccauuccucgacacgcuccaauaccccgcuacagcacguaucugaugcuacuccugaucgucuccuacgccucagcguguagugagcuuauucaggccucuagcagaaucaccacaugcuccacugaaggcgugaacaccaaguguagguugucaggaacagcucugauucgggcaggcagcgugggggccgaggcuugccucaugcugaagggagucaaagaagaccagacuaaguuucuuaaaaucaagaccguuucuuccgagcugaguugucgcgagggucagagcuauuggacaggcucuuucuccccuaaaugcuugucaaguagaaggugccaucucgugggggaaugucacgugaaucguugccugagcuggcgggauaacgagaccucggccgaauuuuccuucguaggagagucuacuacgaugcgagaaaauaaguguuuugagcaaugcggcgguuggggguguggcugcuucaacgucaauccaagcuguuuauuugugcacacauaccugcagucaguuagaaaggaggcacuaaggguguucaacugcauagacuggguccauaaacucacccuggaaaucacugauuuugacggaaguguguccaccauugaucuuggcgcgucuagcucccgcuucacaaauugggggucaguuagcuugagucuggacgccgagggaaucucuggcuccaacagcuuuucguucauugaaucacccgguaagggguaugcuaucguggaugagccguucucugaaauaccucggcagggauuucucggcgagauuagauguaauagugaguccagcguacugucugcccacgaaagcugcuuaagggcaccaaaccugaucuccuacaaacccaugauugaccagcuugaguguaccacuaauuugaucgauccuuucgucguguuugaacgcgguucacucccccaaacacgaaacgacaagacguucgcugccaguaaaggcaaucguggggugcaggcauuuagcaagggaucuguccaggccgaucugacccuaauguucgacaacuuugagguugacuucgugggcgcugcgguauccugcgaugccgcauuucugaaccucacugggugcuauucauguaaugcuggagccaaggugugccugaguauaacaagcaccggcacagguucccuuucugcccauaacaaagacgggucguugcacaucguccugccaagcgaaaauggaacuaaggaucaaugucagauuuuacauuucaccgugccugagguugaggaagaguuuauguacucaugcgacggcgaugaacggccccuccuggugaaagguacgcuuaucgcuauugacccauucgaugacagaagggaggcaggcggggaguccaccgucgugaacccgaagaguggaucuuggaacuuuuucgauugguucagcggccugauguccugguuugggggaccuuugaaaacaauccuccugauaugucuauacguugcccugucaauuggccucuucuuucugcuuaucuauuugggucgcacugggcugucuaagaugugguuagcggcuaccaagaaagccagcuga

SEQ ID NO: 11173 - RNA, 3480 nt, Artificial Sequence
  derived and/or modified CDS sequence (opt3) from RVFV(2007000094)__EU574055.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcaugcagcucguucgaugugcuucuggaaaaaggcaaguuuccauuguuccagucauaugcccaccauaggacccuccuggaggcuguccacgacacaaucauugccaaagcagaucccccuagcugugaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagauaucgguguccauauggcccacgacgaucaaucagugaguagcaagauuguugcucauugucccccacaggaccccugcuuggugcacggcugcaucguaugugcccacgggcuaauaaacuaccagugccauacagcacuguccgcguucgucgugguuuucguguuuucuucgauugcuaucaucugucucgccauucuguaucguguccuuaaaugccugaagaucgcaccucgcaaaguguugaauccacucauguggauuaccgccuucauaagauggguauacaagaaaaugguggcuaggguugccgacaacaucaaccaggucaaucgggaaauuggauggauggagggcggucaacugguguuagggaacccggcacccaucccucgacacgcuccaaucccccgcuacagcacguaucugaugcuacuccugauuguguccuacgccucagcguguagugagcuuauacaggccucuagcagaaucaccacaugcuccacugaaggcgucaauaccaaguguagguugucaggaacagcucugauucgggcaggcagcguuggggccgaggcuugccucaugcugaagggagugaaagaagaucagacuaaguuucuuaaaaucaagaccgugucuuccgagcugaguugucgcgagggucagagcuauuggacaggcucuuucuccccuaaaugcuugucaaguagaaggugccaucucguaggggaaugucacgucaaccguugccugagcuggcgggacaaugagaccucggccgaauuuuccuucgugggagagucuacuacgaugcgagaaaacaaguguuuugagcaaugcggcgguuggggguguggcugcuucaauguuaacccaagcuguuuauuugugcacacauaccugcagucagucagaaaggaggcacuaaggguguucaauugcauugauuggguucauaaacucacccuggaaaucacugacuuugauggaaguguguccaccauagaccuuggcgcgucuagcucccgcuucacaaacugggggucaguaucuuugagucuggaugccgagggaaucucuggcuccaauagcuuuucguucauugaaucacccgguaagggguaugcuaucgucgacgagccguucucugaaauuccucggcagggauuucucggcgagaucagauguaacagugaguccagcgugcugucugcccacgaaagcugcuuaagggcaccaaaucugauauccuacaaacccaugauugaucagcuugaguguaccacuaacuugaucgacccuuucguggucuuugaacgcgguucacucccccaaacacgaaaugauaagacguucgcugccaguaaaggcaaccgugggguucaggcauuuagcaagggaucugugcaggccgaccugacccuaauguucgauaacuuugagguagacuucgugggcgcugcggucuccugcgacgccgcauuucugaaucucacugggugcuauucauguaacgcuggagcccgggugugccugaguauuacaagcaccggcacagguacucuuuccgcccauaauaaggaugggucuuugcacaucguucugccaucggaaaacggaaccaaagaccaaugucagauauuacauuucacggugccugaggucgaggaagaguuuauguacagcugcgauggcgacgaaagaccccuccuggugaaggguacccuuaucgcuauugauccauucgacgauaggcgcgaggcaggcggggagucaacaguugugaauccgaaauccggaaguuggaacuuuuucgacugguucucuggccugaugagcugguuugggggaccuuugaagacuauccuccugauuugucuauacgucgcccuguccaucggccucuucuuucugcuuauauauuugggucggaccgggcugucaaaaaugugguuagcggcuacaaagaaggccucuuga

SEQ ID NO: 11174 - RNA, 3480 nt, Artificial Sequence
  derived and/or modified CDS sequence (opt3) from RVFV(ZM-657)__DQ380204.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaacaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaagaaggucuaccuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcacggauccaagaaauguacuggugaugcugccuucugcagcgcauaugaguguaccgcccaguacgcuaaggcguauugcucgcaugcaaauggcucugggaucgugcagauucaaguauccggaguguggaaaaagccccugugugucggcuacgagcgagugguugugaaaagagaacucucagccaagccgauccagagggucgagccuugcacaaccuguaucacgaagugcgaaccccacggucuugugguacggaguacuggguuuaaaauuagcuccgcuguugccugugcaucuggcgugugcgucacaggaagccagucaccaaguaccgagauaacucugaaguauccuggcaucucccagagcucugggggagacauuggugugcauauggcccacgaugaccaaucagucaguagcaaaaucguggcucauugucccccacaggaccccugcuugguucacggcugcauagugugugcccacgggcuaauuaacuaccagugccauacagcacuguccgcguucguagucguguucguguuuucuucgaucgcuaucauuugucucgccauccuguaucguguucuuaagugccugaaaauugcaccucgcaaggucuugaauccacucauguggauaaccgccuucaucagauggauuuacaaaaagaugguggcuaggguagccgauaacaucaaucaggugaaccgggaaaucggauggauggagggcggucaacugguuuuagggaacccggcacccauuccucgacacgcuccaauaccccgcuacagcacguaucugaugcuacuccugaucgucuccuacgccucagcguguagugagcuuauucaggccucuagcagaaucaccacaugcuccacugaaggcgugaauaccaaguguagguugucaggaacagcucugauucgggcaggcagcgugggggccgaggcuugccucaugcugaaaggagucaaggaagaccagacuaaauuucuuaagaucaaaaccguuucuuccgagcugaguugucgcgagggucagagcuauuggacaggcucuuucuccccuaagugcuugucaaguagaaggugccaucucgugggggaaugucacgugaaccguugccugagcuggcgggauaaugagaccucggccgaauuuuccuucguaggagagucuacuacgaugcgagaaaacaaguguuuugagcaaugcggcgguuggggguguggcugcuucaaugucaacccaagcuguuuauuugugcacacauaccugcagucaguuagaaaagaggcacuaaggguguucaauugcauagacuggguccauaagcucacccuggaaaucacugauuuugacggaaguguguccaccauugaucuuggcgcgucuagcucccgcuucacaaacugggggucaguuagcuugagucuggacgccgagggaaucucuggcuccaauagcuuuucguucauugaaucacccgguaaaggguaugcuaucguggaugagccguucucugaaauaccucggcagggauuucucggcgagauuagauguaacagugaguccagcguacugucugcccacgaaagcugcuuaagggcaccaaaucugaucuccuacaagcccaugauugaccagcuugaguguaccacuaacuugaucgauccuuucgucguguuugaacgcgguucacucccccaaacacgaaaugacaaaacguucgcugccaguaagggcaaccguggggugcaggcauuuagcaagggaucuguccaggccgaucugacccuaauguucgacaauuuugagguugacuucgugggcgcugcgguauccugcgaugccgcauuucugaaccucacugggugcuauucauguaacgcuggagcccgggugugccugaguauaacaagcaccggcacagguucccuuucugcccauaauaaagacgggucguugcacaucguccugccaagcgaaaacggaacuaaggaucaaugucagauuuuacauuucaccgugccugagguugaggaagaguuuauguacucaugcgacggcgaugaaagaccccuccuggugaaagguacgcuuaucgcuauugacccauucgaugacaggcgcgaggcaggcggggaguccaccgucgugaauccgaagaguggaucuuggaacuuuuucgauugguucagcggccugauguccugguuugggggaccuuugaaaacaauccuccugauaugucuauacguugcccugucaauuggccucuucuuucugcuuaucuauuugggucggacugggcugucuaagaugugguuagcggcuaccaagaaagccagcuga

SEQ ID NO: 11175 - RNA, 3480 nt, Artificial Sequence
  derived and/or modified CDS sequence (opt3) from RVFV(ZH-548M12)__M25276.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacggaaaacuauggccggcauugcaaugacggugcugcccgcccuagcuguauucgcacucgccccuguggucuuugcugaagauccacaucugcgcaacagacccgguaaggggcacaauuauaucgacggaaugacccaggaggaugccacauguaaaccugugacuuacgcgggcgcauguucuucguucgacguucuucuggagaagggcaaauuuccauuguuccagucauaugcccaccauaggacccuccuggaagcugugcacgauacaauuaucgccaaggcagaucccccuagcugcgaccugcucagugcucacgggaacccaugcaugaaggagaaauuagucaugaagacccauuguccgaaugacuaccaguccgcccaccaucugaacaaugauggaaaaauggcgucugugaagugucccccuaaauaugaacuuacugaggacugcaacuuuugccggcaaaugacaggugccagcuugaagaaaggcuccuacccacugcaggaccuauucugucagucaagugaagaugacgggagcaagcucaagaccaaaaugaagggaguaugcgagguuggcgugcaggcacugaaaaagugcgauggucaacuuucuacggcucacgaggucgugcccuuugccguguucaaaaauuccaagaaggucuaucuggacaaauuggaucucaagacugaagagaaccuguuaccugacucauuuguuuguuucgaacacaaagggcaguacaagggaaccauggauagcggccagacaaaacgcgagcugaagaguuuugacauaucucagugcccaaagauuggcgggcauggauccaaaaaguguacuggugaugcugccuucugcagcgcauacgaauguaccgcccaauaugcuaaugcguacugcucgcacgcaaacggcucugggaucgugcagauucagguauccggaguguggaaaaagccccucugugucggcuaugagcgagugguugugaaaagagagcuuucagccaagccgauccaaagggucgaaccuugcacaaccuguaucacgaagugcgagccccauggucuggugguacggaguacuggguuuaaaauuagcuccgcuguugccugugcaucuggcgugugcgucacaggaagccagucaccaaguaccgaaauaacuuugaaguacccuggcaucucccagagcucugggggagacauuggugugcacauggcccaugaugaccagucagucaguagcaaaaucguggcucacugucccccacaagaccccugccuaguucacgauugcauagugugugcccauggccugauuaauuaucagugccacacagcacucuccgcguucguagucguguucguguuuucuucgaucgcuaucauuugucuggccauccuuuaccguguucugaagugcuugaaaauugcaccucgcaagguccucaacccacugauguggauaaccgccuucaucagauggauuuauaaaaagaugguggcuaggguagccgacaauaucaaccaggugaaccgggagaucggguggauggaaggaggccaguuaguucuggguaauccggcacccauuccucgacaugcuccaauaccccgcuacagcacguaccuaaugcuccugcuuaucgucuccuaugccucagcguguagugaguugauucaagccucuagcagaaucaccacaugcuccacugagggggugaacaccaaguguaggcugucaggcacagcucucauucgggcaggaagcgugggcgccgaagcaugccugaugcuuaaaggggucaaggaggaucagacuaaauuucugaaguugaaaaccguuucuuccgaacucaguugucgcgagggacagagcuacuggacagguucuuucuccccuaagugccugucaaguagaaggugccacuuagugggcgagugucacgugaaucguugccugagcuggcgggacaacgaaaccucggccgaguuuuccuucguaggggaaucuacuacgaugcgagagaauaaguguuuugaacagugcggaggcugggguugugggugcuucaacgucaauccaagcugucuauuugugcauacauaucuccaaucaguuagaaaagaggcacugaggguguucaacugcaucgauuggguccacaaacuuaccuuggagauaacugacuuugauggcaguguguccaccaucgaccugggagcgucuagcucccgcuucacaaauuggggcucaguuagccucagucuggaugccgaagggauuucuggauccaacagcuuuucguucaucgagucacccggcaaggguuacgcuauuguggacgaaccguucucugagaucccucggcagggguuuuuaggagaaauaagauguaauagugaguccagcguacugucugcccaugagagcugccuuagggcaccaaacuugauuuccuauaagcccaugaucgaucagcucgaauguaccacuaaucugauugacccuuucgucguguuugagcgcggcucacuaccccagacacgaaacgauaaaacguucgcugccaguaaggguaaucggggcgugcaagcauuuagcaaggggucuguccaggccgaccugacccucauguucgacaacuuugaaguugauuucgugggagcugcgguauccugcgacgccgcauuucugaaccuuacuggcugcuacucauguaaugcuggggcccgugugugcuugaguaucacaagcaccggaacaggcucccugucugcccacaacaaagaugguucguuacauauaguccucccaagcgagaaugggacuaaggaccagugucaaauccugcacuucaccgugccugaaguugaggaggaauuuauguauucaugcgauggagacgagagaccccuucuggugaaaggcacguugauugcuaucgauccauucgacgauaggcgcgaagcugguggcgaguccaccgucgugaacccgaagagugggucuuggaacuuuuucgacugguucagcggacucauguccugguuuggcgggccucugaaaacaauucuacugaucugucucuacguugcccugucaauaggacuuuucuuuuugcugauuuacuuaggcgguacugggcucucuaagauguggcuggcggcuaccaagaaagccagcuga

SEQ ID NO: 11176 - RNA, 3480 nt, Artificial Sequence
  derived and/or modified CDS sequence (opt3) from RVFV(ZH-501-777)__DQ380202.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaaaaaggucuaccuugacaagcuggauuugaaaacugaggaaaaccuccugccugacucauuuguuuguuucgagcacaaggggcaguacaaaggaaccauggauccaggccagacaaagcgcgaauuaaagagcuuugacauaagucaaugccccaagauuggcgggcacggaucuaagaaauguacuggugaugcugccuucugcuccgcauaugaguguaccgcccaguacgcuaaugcguauugcagccaugcaaacggcucggggaucgugcagauucaaguaucuggaguguggaagaaaccgcugugugucggcuacgagcgagugguugugaagagagaacucuccgccaaaccuauccagagggucgagcccugcacaaccuguaucacgaagugcgaaccacacggucuugugguacggucaacuggguuuaagauuaguagcgcuguugccugugcauccggcgugugcgucacaggaucucagagcccuucaaccgagauaacucugaaauaucccggcaucagucaguccagcgggggagacauuggugugcauauggcccacgaugaccaaucugucucaaguaagaucguggcucauugcccaccccaggacccuuguuugguucacggcugcauagugugugcccacgggcuaauuaauuaccagugccauacagcacugagcgcguucguagucguguucguguuuuccucuaucgcuaucauuugucucgccguucuguaucguguccuuaaaugccugaagaucgcaccacgcaaaguguugaacccgcucauguggauuaccgccuucauaagauggaucuacaagaaaaugguagcuaggguggccgauaauauuaaccagguuaaccgggaaaucggauggauggagggcggucaacuggucuuagggaaucccgcaccuaucccacgacacgcucccauuccucgcuacucgacguaucugaugcuacuccugauagugagcuacgccuccgcguguucagagcuuauccaggccaguucuagaauuaccacaugcagcacugaaggcgugaacaccaaguguagguuguccggaacagcucugauccgggcaggcucagucggggccgaggcuugccucaugcugaagggaguuaaagaagaccagacuaaguuucuuaaaauuaagaccgugagcucugagcuguccugucgcgagggucagaguuauuggacaggcagcuucucuccaaaaugcuuguccucaagaaggugccaucucgugggggaaugucacguaaaucguugccugaguuggcgggauaacgagaccagcgccgaauuuucguucgucggagaguccacuacgaugcgagaaaauaaguguuuugagcaaugcggcgguuggggguguggcugcuucaacgugaaucccucuuguuuauuuguucacacauaccugcagagcgugagaaaggaggcacuaagggucuucaacugcaucgacugggugcauaaacucacccuggaaauaacugauuuugacggaucaguuaguaccaucgaucuuggcgcguccucuagccgcuucacaaauuggggguccgugucauugagccuggacgccgagggaauuaguggcucuaacuccuuuagcuucaucgaaucgccggguaagggguaugcuauuguagaugagccuuucucagaaaucccacggcagggauuucucggcgagauaagauguaauucugagaguuccguccugagcgcccacgaaucuugcuuaagggcacccaaccugauuagcuacaaaccuaugaucgaccagcuugaguguaccacuaauuugauugaucccuucgugguguuugaacgcgguucccucccacaaacacgaaacgacaagacguucgcugccucaaaaggcaaucgugggguccaggcauuuaguaagggaagcguucaggccgaucugacccuaauguucgacaacuuugagguggacuucguaggcgcugcggugucuugcgaugccgcauuucugaaccucacugggugcuauuccuguaaugcuggagcccgggucugccugucaaucacaaguaccggcacagguagccuuuccgcccauaacaaggacgggucuuugcacauagugcugccuucggaaaauggaacuaaagaucaaugucagaucuuacauuucaccguucccgagguggaggaagaguuuauguacagcugcgacggcgaugaaagaccacuccuggucaaggguacgcuuauugcuaucgacccguucgaugacaggcgcgaggcaggcggggagucaaccgugguuaacccuaaauccggaaguuggaacuuuuucgauugguucucuggccugaugagcugguuugggggacccuugaagacaauucuccugaucugucuauacguggcccuguccauaggccucuucuuucugcuuauuuauuugggucggacugggcugucaaaaaugugguuagcggcuaccaagaaggccucuuga

SEQ ID NO: 11177 - RNA, 3480 nt, Artificial Sequence
  derived and/or modified CDS sequence (opt3) from RVFV(T-46 (228113))__DQ380199.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaagaaggucuaccuugacaagcuggauuugaaaacugaggaaaaccuccugccugacucauuuguuuguuucgagcacaaggggcaguacaaaggaaccaaggauagcggccagacaaaacgcgaauuaaagaguuuugacauaucucaaugcccaaagauuggcgggcacggauccaaaaaguguacuggugaugcugccuucugcagcgcauaugaguguaccgcccaguacgcuaaugcguauugcucgcaugcaaacggcucugggaucgugcagauucaaguauccggaguguggaaaaagccccugugugucggcuacgagcgagugguugugaaaagagaacucucagccaagccgauccagagggucgagccuugcacaaccuguaucacgaagugcgaaccccacggucuugugguacggaguacuggguuuaaaauuagcuccgcuguugccugugcaucuggcgugugcgucacaggaagccagucaccaaguaccgagauaacucugaaguauccuggcaucucccagagcucugggggagacauuggugugcauauggcccacgaugaccaaucagucaguagcaaaaucguggcucauugucccccacaggaccccugcuugguucacggcugcauagugugugcccacgggcuaauuaauuaccagugccauacagcacuguccgcguucguagucguguucguguuuucuucgaucgcuaucauuugucucgccguucuguaucguguccuuaagugccugaaaaucgcaccucgcaagguguugaacccacucauguggauuaccgccuucauaagauggaucuacaaaaagaugguagcuaggguggccgauaauauuaaccagguuaaccgggaaaucggauggauggagggcggucaacuggucuuagggaauccggcacccaucccucgacacgcuccaauuccccgcuacagcacguaucugaugcuacuccugauaguguccuacgccucagcguguagugagcuuauccaggccucuagcagaauuaccacaugcuccacugaaggcgugaacaccaaguguagguugucaggaacagcucugauccgggcaggcagcgucggggccgaggcuugccucaugcugaaaggaguuaaggaagaccagacuaaauuucuuaagauuaaaaccgugucuuccgagcugaguugucgcgagggucagagcuauuggacaggcucuuucuccccuaagugcuugucaaguagaaggugccaucucgugggggaaugucacguaaaucguugccugagcuggcgggauaacgagaccucggccgaauuuuccuucgucggagagucuacuacgaugcgagaaaauaaguguuuugagcaaugcggcgguuggggguguggcugcuucaacgugaauccaagcuguuuauuuguucacacauaccugcagucagugagaaaagaggcacuaagggucuucaacugcaucgacugggugcauaagcucacccuggaaauaacugauuuugacggaaguguuuccaccaucgaucuuggcgcgucuagcucccgcuucacaaauugggggucagugagcuugagucuggacgccgagggaauuucuggcuccaacagcuuuucguucaucgaaucacccgguaaaggguaugcuauuguagaugagccguucucugaaaucccucggcagggauuucucggcgagauaagauguaauagugaguccagcguccugucugcccacgaaagcugcuuaagggcaccaaaccugauuuccuacaagcccaugaucgaccagcuugaguguaccacuaauuugauugauccuuucgugguguuugaacgcgguucacucccccaaacacgaaacgacaaaacguucgcugccaguaagggcaaucgugggguccaggcauuuagcaagggaucuguucaggccgaucugacccuaauguucgacaacuuugagguggacuucguaggcgcugcgguguccugcgaugccgcauuucugaaccucacugggugcuauucauguaaugcuggagcccgggucugccugaguaucacaagcaccggcacagguucccuuucugcccauaacaaagacgggucguugcacauagugcugccaagcgaaaauggaacuaaggaucaaugucagaucuuacauuucaccguuccugagguggaggaagaguuuauguacucaugcgacggcgaugaaagaccccuccuggucaaagguacgcuuauugcuaucgacccauucgaugacaggcgcgaggcaggcggggaguccaccgugguuaacccgaagaguggaucuuggaacuuuuucgauugguucagcggccugauguccugguuugggggaccuuugaaaacaauucuccugaucugucuauacguggcccugucaauaggccucuucuuucugcuuauuuauuugggucggacugggcugucuaagaugugguuagcggcuaccaagaaagccagcuga

SEQ ID NO: 11178 - RNA, 3480 nt, Artificial Sequence
  derived and/or modified CDS sequence (opt3) from RVFV(OS-3)__DQ380184.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaagaauagcaaaaaggucuaccuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcacggauccaagaaauguacuggugaugcugccuucugcagcgcauaugaguguaccgcccaguacgcuaaugcguauugcucgcaugcaaacggcucuggggugguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagacaucgguguccauauggcccacgaugaccaaucagugaguagcaagauuguugcucauugucccccacaggaccccugcuuggugcacggcugcaucguaugugcccacgggcuaauaaauuaccagugccauacagcacuguccgcguucgucgugguuuucguguuuucuucggucgcuauuaucugucucgccauccuguauaaagugcuuaagugccugaaaauugcaccucguaagguauugaacccacucauguggaucaccgccuucauucgcuggguguacaaaaagaugguugcuagagucgccgauaauauaaaccaggugaacagggaaaucggauggauggagggcggucaacuggcauuagggaauccggcucccauuccucggcacgccccaaucccccgauacagcacguaucugaugcuacuccugaucguguccuacgcgucagccuguagugagcuuauucaggcuucuagccgcauaaccacaugcuccacugaaggcgucaacaccaaguguagauugucaggaacagcacugaucagggccggcagcguuggggcugaggccugccucaugcugaaaggagugaaggaagaccagacuaaauuucuuaagauuaaaaccgugucuuccgagcugaguugucgggagggucagagcuauuggacaggcucuuucuccccuaagugcuugucaagucgcagaugccaucucguaggggaaugucacgucaauaggugccugagcuggcgugauaacgagaccucggcagaauuuuccuucgugggagagucuacuacgaugcgggaaaauaaguguuuugagcaaugcggcgguuggggguguggcugcuucaacguuaauccaagcuguuuauuugugcacacauaccugcagucaguccgaaaagaggcgcuaagaguguucaacugcaucgacuggguucauaagcucacccuggaaauuacugauuuugacggaaguguguccaccaucgaucuuggcgccucuagcuccagguucacaaauugggggucaguauccuugagucuggacgcugagggaauaucuggcuccaacagcuuuucguucaucgaaucacccgguaaaggguaugccauugucgaugagccguucucugaaaucccucgccagggauuucucggcgagauucgguguaauagugaguccagcgugcugucugcacacgaaagcugcuuaagagcuccaaaccugaucuccuacaagcccaugauagaccagcuugaguguaccacuaauuugauugauccuuucguggucuuugaaagggguucacucccccaaacacgcaacgacaaaacguucgccgcaaguaagggcaaucgagggguucaggccuuuagcaagggaucugugcaggcugaucugacccuaauguucgacaacuuugagguagacuucgugggcgcggccgucuccugcgaugcagcuuuucugaaccucacugggugcuauucauguaaugccggagcccgggugugccugaguaucacaagcaccggcacagguacucuuuccgcucauaacaaagacgggucuuugcacauuguucugccaucggaaaauggaaccaaggaucaaugucagaucuuacauuucacggugccugaggucgaggaagaguuuauguacagcugcgacggcgaugaacguccccuccuggugaaagguacccuuauagcaaucgacccauucgaugacagaagggaggccggcggggagucaacaguugugaacccgaaguccggaaguuggaacuuuuucgauugguucucuggccugaugagcugguuugggggaccuuugaaaacuauucuccugaucugucuauacgucgcgcuguccauuggccucuucuuucugcuuaucuauuugggucgcaccgggcugucaaagaugugguuagcugccacaaagaaagcaucuuga

SEQ ID NO: 11179 - RNA, 3480 nt, Artificial Sequence
  derived and/or modified CDS sequence (opt3) from RVFV(Sudan 86-2010)__JQ820489.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcaugcagcucguucgaugugcuucuggaaaaaggcaaguuuccauuguuccagucauaugcccaccauaggacccuccuggaggcuguccacgacacaaucauugccaaagcagaucccccuagcugugaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagauaucgguguccauauggcccacgacgaucaaucagugaguagcaagauuguugcucauugucccccacaggaccccugcuuggugcacggcugcaucguaugugcccacgggcuaauaaacuaccagugccauacagcacuguccgcguucgucgugguuuucguguuuucuucgauugcuaucaucugucucgccauucuguaucguguccuuaaaugccugaagaucgcaccucgcaaaguguugaauccacucauguggauuaccgccuucauaagauggguauacaagaaaaugguggcuaggguugccgacaacaucaaccaggucaaucgggaaauuggauggauggagggcggucaacugguguuagggaacccggcacccaucccucgacacgcuccaaucccccgcuacagcacguaucugaugcuacuccugauuguguccuacgccucagcguguagugagcuuauacaggccucuagcagaaucaccacaugcuccacugaaggcgucaauaccaaguguagguugucaggaacagcucugauucgggcaggcagcguuggggccgaggcuugccucaugcugaagggagugaaagaagaucagacuaaguuucuuaaaaucaagaccgugucuuccgagcugaguugucgcgagggucagagcuauuggacaggcucuuucuccccuaaaugcuugucaaguagaaggugccaucucguaggggaaugucacgucaaccguugccugagcuggcgggacaaugagaccucggccgaauuuuccuucgugggagagucuacuacgaugcgagaaaacaaguguuuugagcaaugcggcgguuggggguguggcugcuucaauguuaacccaagcuguuuauuugugcacacauaccugcagucagucagaaaggaggcacuaaggguguucaauugcauugauuggguucauaaacucacccuggaaaucacugacuuugauggaaguguguccaccauagaccuuggcgcgucuagcucccgcuucacaaacugggggucaguaucuuugagucuggaugccgagggaaucucuggcuccaauagcuuuucguucauugaaucacccgguaagggguaugcuaucgucgacgagccguucucugaaauuccucggcagggauuucucggcgagaucagauguaacagugaguccagcgugcugucugcccacgaaagcugcuuaagggcaccaaaucugauauccuacaaacccaugauugaucagcuugaguguaccacuaacuugaucgacccuuucgugauuuuugaacgcgguucacucccccaaacacgaaaugauaagacguucgcugccaguaaaggcaaccgugggguccaggcauuuagcaagggaucuguucaggccgaccugacccuaauguucgauaacuuugagguggacuucguaggcgcugcgguguccugcgacgccgcauuucugaaucucacugggugcuauucauguaacgcuggagcccgggucugccugaguaucacaagcaccggcacagguacucuuuccgcccauaauaaggaugggucuuugcacauagugcugccaucggaaaacggaaccaaagaccaaugucagaucuuacauuucacgguuccugagguggaggaagaguuuauguacagcugcgauggcgacgaaagaccccuccuggucaaggguacccuuauugcuaucgauccauucgacgauaggcgcgaggcaggcggggagucaacagugguuaauccgaaauccggaaguuggaacuuuuucgacugguucucuggccugaugagcugguuugggggaccuuugaagacuauucuccugaucugucuauacguggcccuguccauaggccucuucuuucugcuuauuuauuugggucggaccgggcugucaaaaaugugguuagcggcuacaaagaaggccucuuga

SEQ ID NO: 11180 - RNA, 3480 nt, Artificial Sequence
  derived and/or modified CDS sequence (opt3) from RVFV(Sudan 28-2010)__JQ820491.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcaugcagcucguucgaugugcuucuggaaaaaggcaaguuuccauuguuccagucauaugcccaccauaggacccuccuggaggcuguccacgacacaaucauugccaaagcagaucccccuagcugugaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagauaucgguguccauauggcccacgacgaucaaucagugaguagcaagauuguugcucauugucccccacaggaccccugcuuggugcacggcugcaucguaugugcccacgggcuaauaaacuaccagugccauacagcacuguccgcguucgucgugguuuucguguuuucuucgauugcuaucaucugucucgccauucuguaucguguccuuaaaugccugaagaucgcaccucgcaaaguguugaauccacucauguggauuaccgccuucauaagauggguauacaagaaaaugguggcuaggguugccgacaacaucaaccaggucaaucgggaaauuggauggauggagggcggucaacugguguuagggaacccggcacccaucccucgacacgcuccaaucccccgcuacagcacguaucugaugcuacuccugauuguguccuacgccucagcguguagugagcuuauacaggccucuagcagaaucaccacaugcuccacugaaggcgucaauaccaaguguagguugucaggaacagcucugauucgggcaggcagcguuggggccgaggcuugccucaugcugaagggagugaaagaagaucagacuaaguuucuuaaaaucaagaccgugucuuccgagcugaguugucgcgagggucagagcuauuggacaggcucuuucuccccuaaaugcuugucaaguagaaggugccaucucguaggggaaugucacgucaaccguugccugagcuggcgggacaaugagaccucggccgaauuuuccuucgugggagagucuacuacgaugcgagaaaacaaguguuuugagcaaugcggcgguuggggguguggcugcuucaauguuaacccaagcuguuuauuugugcacacauaccugcagucagucagaaaggaggcacuaaggguguucaauugcauugauuggguucauaaacucacccuggaaaucacugacuuugauggaaguguguccaccauagaccuuggcgcgucuagcucccgcuucacaaacugggggucaguaucuuugagucuggaugccgagggaaucucuggcuccaauagcuuuucguucauugaaucacccgguaagggguaugcuaucgucgacgagccguucucugaaauuccucggcagggauuucucggcgagaucagauguaacagugaguccagcgugcugucugcccacgaaagcugcuuaagggcaccaaaucugauauccuacaaacccaugauugaucagcuugaguguaccacuaacuugaucgacccuuucguggucuuugaacgcgguucacucccccaaacacgaaaugauaagacguucgcugccaguaaaggcaaccgugggguucaggcauuuagcaagggaucugugcaggccgaccugacccuaauguucgauaacuuugagguagacuucgugggcgcugcggucuccugcgacgccgcauuucugaaucucacugggugcuauucauguaacgcuggagcccgggugugccugaguauuacaagcaccggcacagguacucuuuccgcccauaauaaggaugggucuuugcacaucguucugccaucggaaaacggaaccaaagaccaaugucagauauuacauuucacggugccugaggucgaggaagaguuuauguacagcugcgauggcgacgaaagaccccuccuggugaaggguacccuuaucgcuauugauccauucgacgauaggcgcgaggcaggcggggagucaacaguugugaauccgaaauccggaaguuggaacuuuuucgacugguucucuggccugaugagcugguuugggggaccuuugaagacuauccuccugauuugucuauacgucguacuguccaucggccucuucuuucugcuuauauauuugggucggaccgggcugucaaaaaugugguuagccgcgacaaagaaggcuucuuga

SEQ ID NO: 11181 - RNA, 3480 nt, Artificial Sequence
  derived and/or modified CDS sequence (opt3) from RVFV(2007004194)__EU574031.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaauaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcauguucuucguucgaugugcuucuggaaaaaggcaaguuuccauuguuccagucauaugcccaccauaggacccuccuggaggcuguccacgacacaaucauugccaaagcagaucccccuagcugcgaccugcagagugcucacgggaauccaugcaugaaggaaaagcucgugaugaaaacccauuguccgaacgauuaccaauccgcccacuauuuaucuaaugacggaaagauggcgagcguaaaaugucccccuaaguacgagcugacugaagauugcaacuuuugccggcagaugacaggugccucccuuaaaaagggcucauauccauugcaggaccuguucugucagaguagcgaggacgaugggucuaaacuaaagaccaagaugaaaggaguuugcgaggugggcguccaagcacucaagaaaugcgacggucagcuguccacggcucaugaaguggugcccuuugccgucuucaagaauagcaaaaagguuuaccuugauaagcuggacuugaaaacugaggaaaaccuccugccugauucauuuguguguuucgagcacaaggggcaguacaaaggaaccauggacaguggccagacaaagcgcgaauuaaaaucuuuugauaucucccaaugcccaaagauaggcgggcacggaagcaagaaauguacuggugacgcugccuucugcucggcauaugaguguaccgcccaguacgcuaaugcguauugcucucaugcaaacggcuccgggauuguacagauccaagugucaggagucuggaagaaaccccugugugugggcuacgagcgaguuguggucaagagagaacucagugccaaaccgauucagaggguggagccuugcacaaccuguaucacgaagugcgaaccccacggucuuguaguucggagcacuggguuuaagaucuccucugcuguggccugugcaagcggcgucugcgugacaggaucacagaguccauccaccgagauuacucugaaauauccuggcauaagccagucuucagggggagauaucgguguccauauggcccacgacgaucaaagugugagcuccaagauuguugcucauugucccccacaggaccccugcuuggugcacggcugcaucguaugugcccacgggcuaauaaauuaccagugccauacagcacugucugcguucgucgugguuuucguguuuucgagcauugcuaucaucugucucgccauucuguaucguguccuuaaaugccugaagaucgcaccucgcaaaguguugaacccacucauguggauuaccgccuucauaagauggguauacaagaaaaugguggcuaggguugccgacaauaucaaccaggucaaccgggaaauuggauggauggagggcggucaacugguguuagggaauccggcacccaucccucgacacgcuccaaucccccgcuacuccacguaucugaugcuacuccugauugugucauacgccagugcguguucugagcuuauacaggccagcuccagaaucaccacaugcucaacugaaggcgucaacaccaaguguagguugagcggaacagcucugauucgggcaggcucuguuggggccgaggcuugccucaugcugaagggagugaaagaagaucagacuaaguuucuuaaaaucaagaccguguccagugagcugagcugucgcgagggucagucuuauuggacaggcuccuucucaccuaaaugcuugaguagcagaaggugccaucucguaggggaaugucacgucaaucguugccugucguggcgggacaacgagaccuccgccgaauuuucuuucgugggagagagcacuacgaugcgagaaaauaaguguuuugagcaaugcggcgguuggggguguggcugcuucaacguuaauccaucauguuuauuugugcacacauaccugcagagugucagaaaggaggcacuaaggguguucaacugcauugauuggguucauaaacucacccuggaaaucacugacuuugauggauccgugucuaccauagaccuuggcgcgagcuccucacgcuucacaaauugggggagcguaaguuugucucuggaugccgagggaaucuccggcagcaacucguuuucauucauugaaucucccgguaagggguaugcuaucgucgacgagccguucagugaaauuccucggcagggauuucucggcgagaucagauguaauuccgagagcucugugcugagcgcccacgaauccugcuuaagggcaccaaaccugauaucauacaaacccaugauugaucagcuugaguguaccacuaauuugaucgacccuuucguggucuuugaacgcgguagucucccccaaacacgaaacgauaagacguucgcugccagcaaaggcaaucgugggguucaggcauuuucuaagggauccgugcaggccgaccugacccuaauguucgauaacuuugagguagacuucgugggcgcugcggucucaugcgacgccgcauuucugaaccucacugggugcuauaguuguaaugcuggagcccgggugugccugagcauuacauccaccggcacagguacucuuucugcccauaacaaggaugggucguugcacaucguucugccaagcgaaaauggaaccaaagaccaaugucagauauuacauuucacggugccugaggucgaggaagaguuuauguacucaugcgauggcgacgaaagaccccuccuggugaaggguacccuuaucgcuauugauccauucgacgauaggcgcgaggcaggcggggaguccacaguugugaacccgaaaaguggaucuuggaacuuuuucgacugguucagcggccugauguccugguuugggggaccuuugaagacuauccuccugauuugucuauacgucgcccugucaaucggccucuucuuucugcuuauauauuugggucggaccgggcugucuaaaaugugguuagcggcuacaaagaaggccagcuga

SEQ ID NO: 11182 - RNA, 3480 nt, Artificial Sequence
  derived and/or modified CDS sequence (opt3) from RVFV(73HB1230)__DQ380221.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaagugggacgggaaacuauggccggcaucgcaaugacgguacugcccgcccuagcuguguucgcacucgccccugucguguuugcugaggauccacaucugcgcaacagacccgguaaagggcacaauuauauugacggaaugacccaggaggaugccacauguaagccuguuacuuacgcgggcgcauguucuucguucgacgugcuucuggaaaaaggcaaguuuccauuguuccagucauaugcccaccauaggacccuccuggaggcuguccacgauacaaucauugccaaagcagaucccccuagcugcgaccugcagagugcucacgggaacccaugcaugaaggaaaagcucgugaugaaaacccauuguccgaaugacuaccaauccgcccacuauuuaaacaaugauggaaagauggcgucuguaaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguuugcgaggugggcguccaagcacucaagaaaugcgauggucagcugucuacggcucaugaaguggugcccuuugccgucuucaagaauagcaaaaagguuuaccuugacaagcuggauuugaaaacugaggaaaaccuccugccugacucauuuguguguuucgagcacaaggggcaguacaaaggaaccauggauagcggccagacaaagaaagaauuaaagaguuuugacaucucucaaugcccaaagauaggcgggcacggauccaaaaaguguacuggugaugcugccuucugcagcgcauaugaguguaccgcccaguacgcuaaugcguauugcucgcaugcaaacggcucugggauuguacagauccaaguguccggagucuggaaaaagccccugugugugggcuacgagcgcguuguggucaaacgagaacucucagccaagccgauucagagaguggagccuugcacaaccuguaucacgaagugcgaaccccacggucuuguaguuaggaguacuggguuuaaaaucagcuccgcuguggccugugcaucuggcgucugcgugacaggaagccagucaccaaguaccgagauuacucugaaguauccuggcauaucccagagcucugggggagacaucgguguccauauggcccacgaugaccaaucagugaguagcaaaauuguugcucauugucccccacaggaccccugcuuggugcacggcugcaucguaugugcccacgggcuaauaaauuaccagugccauacagcacuguccgcguucgucgugguuuucguguuuucuucgauugcuaucaucugucucgccauucuguaucggguccuuaagugccugaaaaucgcaccucguaagguguugaacccacucauguggauuaccgccuucauacgcuggguauacaaaaagaugguggcuagaguugccgauaauaucaaccaggucaacagggaaauuggauggauggagggcggucaacugguguuagggaauccggcacccaucccucggcacgcuccaaucccccgauacagcacguaucugaugcuacuccugauuguguccuacgccucagcguguagugagcuuauacaggccucuagccgcaucaccacaugcuccacugaaggcgucaacaccaaguguagauugucaggaacagcucugauuagggcaggcagcguuggggccgaggcuugccucaugcugaaaggagugaaggaagaccagacuaaauuucuuaagaucaaaaccgugucuuccgagcugaguugucgggagggucagagcuauuggacaggcucuuucuccccuaagugcuugucaagucgcagaugccaucucguaggggaaugucacgucaauaggugccugagcuggcgugauaacgagaccucggccgaauuuuccuucgugggagagucuacuauuaugcgggaaaauaaguguuuugagcaaugcggcgguuggggguguggcugcuucaacguuaauccaagcuguuuauuugugcacacguaccugcagucaguccgaaaagaggcacuaagaguguucaacugcaucgacuggguucauaagcucacacuggaaauaaccgauuuugacggaaguguguccacuaucgaucuuggcgcgucuagcuccagguucaccaauugggggucaguauccuugagucuggacgccgagggaauuucuggcuccaacagcuuuucguucaucgaaucacccgguaaaggguaugcuauugucgaugagccguucucugaaaucccucgccagggauuucucggcgagauacgguguaauagugaguccagcgugcugucugcccacgaaagcugcuuaagagcaccaaaccugauuuccuacaagcccaugaucgaccagcuugaguguacaaccaauuugauugauccuuucguggucuuugaaagggguucacucccccaaacucgcaacgacaaaacauucgcugccaguaagggcaaucgagggguucaggcauuuagcaagggaucugugcaggccgaucugacgcuaauguucgacaacuuugagguagacuucgugggcgcugcggucuccugcgaugccgcauuucugaaccucaccgggugcuauucauguaaugcuggagcccgggugugccugaguaucacuagcacaggcaccgguacacuuuccgcccauaacaaagacgggucuuugcacauaguucugccaucggaaaauggaacuaaggaucaaugucagaucuuacauuucaccgugccugaggucgaggaagaguuuauguacagcugcgacggcgaugaacguccccuccuggugaaagguacgcuuauugcuaucgacccauucgaugacagaagggaggcaggcggggagucaaccguugugaacccgaaguccggaaguuggaacuuuuucgauugguucucuggccugaugagcugguuugggggaccuuugaaaacaauucuccugaucugucuauacgucgcccuguccauaggccucuucuuucugcuuauuuauuugggucgcacugggcugucaaagaugugguuagcggcuaccaagaaagccucuuga

SEQ ID NO: 11183 - RNA, 3480 nt, Artificial Sequence
  derived and/or modified CDS sequence (opt3) from RVFV(1260/78)__DQ380214.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaagaaggucuaccuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcacggauccaagaaauguacuggugaugcugccuucugcagcgcauaugaguguaccgcccaguacgcuaaugcguauugcucgcaugcaaacggcucugggaucgugcagauucaaguauccggaguguggaagaaaccccugugugucggcuacgagcgagugguugugaagagagaacucucagccaaaccgauccagagggucgagccuugcacaaccuguaucacgaagugcgaaccccacggucuugugguacggaguacuggguuuaagauuagcuccgcuguugccugugcaucuggcgugugcgucacaggaagccagucaccaaguaccgagauaacucugaaauauccuggcaucucccagagcucugggggagacauuggugugcauauggcccacgaugaccaaucagucaguagcaagaucguggcucauugucccccacaggaccccugcuugguucacggcugcauagugugugcccacgggcuaauuaauuaccagugccauacagcacuguccgcguucguagucguguucguguuuucuucgaucgcuaucauuugucucgccauccugcaccguguucuuaaaugccugaagauugcaccucgcaaagucuugaacccacucauguggauaaccgccuucaucagauggguguauaagaaaaugguagcuaggguggccgauaauauuaaccagguuaaccgggaaaucggauggauggagggcggucaacuggucuuagggaauccggcacccaucccucgacaugcuccaauuccccgcuacagcacguaccugaugcuacuccugauaguguccuaugccucagcguguagugagcuuauccaggccucuagcagaauuaccacaugcuccacugaaggcgugaacaccaaguguagguugucaggaacagcucugauccgggcaggcagcgucggggccgaggcuugccucaugcugaagggaguuaaagacgaucagacuaaguuucuuaaaauuaagaccgugucuuccgaacugaguugucgcgagggucagagcuacuggacaggcucuuucuccccuaaaugcuugucaaguagaaggugccaccucgugggggagugucacguaaaucguugccugagcuggcgggacaacgaaaccucggccgaguuuuccuucgucggagaaucuacuacgaugcgagagaauaaguguuuugaacaaugcggcgguuggggguguggcugcuucaacgugaauccaagcuguuuauuuguucauacauaucugcagucagugagaaaggaggcacuaagggucuucaacugcaucgauugggugcacaaacucacccuggagauaacugacuuugauggaaguguuuccaccaucgaccuuggcgcgucuagcucccgcuucacaaauugggggucagugagcuugagucuggaugccgaaggaauuucuggcuccaacagcuuuucguucaucgagucacccgguaagggguacgcuauuguagacgaaccguucucugagaucccucggcagggauuucucggcgaaauaagauguaauagugaguccagcguccugucugcccaugagagcugcuuaagggcaccaaaccugauuuccuauaaacccaugaucgaucagcuugaauguaccacuaauuugauugacccuuucgugguguuugagcgcgguucacucccccaaacacgaaacgauaagacguucgcugccaguaaaggcaaucgugggguccaggcauuuagcaagggaucuguucaggccgaccugacccuaauguucgacaacuuugaaguggauuucguaggcgcugcgguguccugcgacgccgcauuucugaaccucacugggugcuacucauguaaugcuggagcccgggucugccugaguaucacaagcaccggcacagguacucuuuccgcccacaacaaggaugggucuuugcauauagugcugccaucggagaauggaaccaaagaccaaugucagaucuuacacuucacgguuccugaaguggaggaggaauuuauguauagcugcgauggcgacgagagaccccuccuggucaaggguacccuuauugcuaucgauccauucgacgauaggcgcgaagcaggcggggagucaacagugguuaacccgaaauccggaaguuggaacuuuuucgacugguucucuggccugaugagcugguuugggggaccuuugaagacuauucuccugaucugucuauacguggcccuguccauaggccucuucuuucugcuuauuuacuugggucggaccgggcugucaaaaaugugguuagcggcuacaaagaaggccucuuga

SEQ ID NO: 11184 - RNA, 3480 nt, Artificial Sequence
  derived and/or modified CDS sequence (opt3) from RVFV(ZC-3349)__DQ380207.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaagaaggucuaccuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcacggauccaagaaauguacuggugaugcugccuucugcagcgcauaugaguguaccgcccaguacgcuaaugcguauugcucgcaugcaaacggcucugggaucgugcagauucaaguauccggaguguggaagaaaccccugugugucggcuacgagcgagugguugugaagagagaacucucagccaaaccgauccagagggucgagccuugcacaaccuguaucacgaagugcgaaccccacggucuugugguacggaguacuggguuuaagauuagcuccgcuguugccugugcaucuggcgugugcgucacaggaagccagucaccaaguaccgagauaacucugaaauauccuggcaucucccagagcucugggggagacauuggugugcauauggcccacgaugaccaagcugucucaaguaagaucguggcccauugucccccacaggaccccugcuugguucacggcugcauagugugugcacacgggcuaauuaauuaccagugccauacagcgcugagcgcuuucguagucguguucguguuuuccucuaucgccaucauuugucucgcaauccuguaucguguucuuaaaugccugaagauugccccucgcaaagucuugaacccacucauguggauaaccgcuuucaucagauggauuuacaagaaaaugguggccaggguagcagauaauaucaaccacgugaaccgggaaaucggauggauggagggcggucagcugguuuuagggaauccggcucccauuccucgacaugccccaauaccccgcuacucgacguaucugaugcuacuccugaucgucagcuacgcguccgccuguucagagcuuauucaagcuaguucuagaaucaccacaugcagcacugaaggcgugaacaccaaguguagguuguccggaacagcacugauucgggccggcucagugggggcugaggccugccucaugcugaagggagucaaagaagaccagacuaaguuucuuaaaaucaagaccguuagcucugagcuguccugucgcgagggucagaguuauuggacaggcagcuucucuccuaaaugcuuguccucaagaaggugccaccucgugggggaaugucacgugaaucguugccugaguuggcgggauaacgagaccagcgcagaauuuucguucguaggagaguccacuacgaugcgagaaaauaaguguuuugagcagugcggcgguuggggguguggcugcuucaacgucaauccaucuuguuuauuugugcauacauaccugcaaagcguuagaaaggaggcgcuaaggguguucaacugcauagacuggguccacaaacucacccuggaaaucacugauuuugacggaucagugaguaccauugaucuuggcgccuccucuagccgcuucacaaauuggggguccguuucauugagccuggacgcugagggaaucaguggcucuaacuccuuuagcuucauugaaucgcccgguaagggguaugccaucguggaugagccguucucagaaauaccucggcagggauuucucggcgagauuagauguaauucugagaguuccguacugagcgcacaugaaucuugcuuaaaagcuccaaaccugaucagcuacaagcccaugauugaccagcuugaguguaccacuaauuugaucgauccuuucgucguguuugaaagggguucccucccccagacacgcaacgacaaaacguucgccgcaucaaagggcaaucgaggggugcaagccuuuaguaagggaagcguccaggcugaucugacccuaauguucgacaacuuugagguugacuucgugggcgcggccguaucuugcgaugcagcuuuucugaaccucacugggugcuauuccuguaaugccggagcccgggugugccugucaauaacaaguaccggcacagguagccuuuccgcucacaacaaagacgggucuuugcauaucguccugccaucggaaaauggaacuaaggaucagugucaaauuuuacacuucaccgugccugagguugaggaagaguuuauguacagcugcgacggcgaugaacguccccuccuggugaaagguacgcuuaucgcaauugacccauucgaugacagaagggaggccggcggggagucaaccgucgugaacccgaaguccggaaguuggaacuuuuucgauugguucucuggccugaugagcugguuugggggaccuuugaaaacaauccuccugauaugucuauacguugcgcuguccauuggccucuucuuucugcuuaucuauuugggucgcacugggcugucaaagaugugguuagcugccaccaagaaagcaucuuga

SEQ ID NO: 11185 - RNA, 3480 nt, Artificial Sequence
  derived and/or modified CDS sequence (opt3) from RVFV(Sudan 85-2010)__JQ820488.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcaugcagcucguucgaugugcuucuggaaaaaggcaaguuuccauuguuccagucauaugcccaccauaggacccuccuggaggcuguccacgacacaaucauugccaaagcagaucccccuagcugugaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagauaucgguguccauauggcccacgacgaucaaucagugaguagcaagauuguugcucauugucccccacaggaccccugcuuggugcacggcugcaucguaugugcccacgggcuaauaaacuaccagugccauacagcacuguccgcguucgucgugguuuucguguuuucuucgauugcuaucaucugucucgccauucuguaucguguccuuaaaugccugaagaucgcaccucgcaaaguguugaauccacucauguggauuaccgccuucauaagauggguauacaagaaaaugguggcuaggguugccgacaacaucaaccaggucaaucgggaaauuggauggauggagggcggucaacugguguuagggaacccggcacccaucccucgacacgcuccaaucccccgcuacagcacguaucugaugcuacuccugauuguguccuacgccucagcguguagugagcuuauacaggccucuagcagaaucaccacaugcuccacugaaggcgucaauaccaaguguagguugucaggaacagcucugauucgggcaggcagcguuggggccgaggcuugccucaugcugaagggagugaaagaagaucagacuaaguuucuuaaaaucaagaccgugucuuccgagcugaguugucgcgagggucagagcuauuggacaggcucuuucuccccuaaaugcuugucaaguagaaggugccaucucguaggggaaugucacgucaaccguugccugagcuggcgggacaaugagaccucggccgaauuuuccuucgugggagagucuacuacgaugcgagaaaacaaguguuuugagcaaugcggcgguuggggguguggcugcuucaauguuaacccaagcuguuuauuugugcacacauaccugcagucagucagaaaggaggcacuaaggguguucaauugcauugauuggguucauaaacucacccuggaaaucacugacuuugauggaaguguguccaccauagaccuuggcgcgucuagcucccgcuucacaaacugggggucaguaucuuugagucuggaugccgagggaaucucuggcuccaauagcuuuucguucauugaaucacccgguaagggguaugcuaucgucgacgagccguucucugaaauuccucggcagggauuucucggcgagaucagauguaacagugaguccagcgugcugucugcccacgaaagcugcuuaagggcaccaaaucugauauccuacaaacccaugauugaucagcuugaguguaccacuaacuugaucgacccuuucguggucuuugaacgcgguucacucccccaaacacgaaaugagaagacguucgcugccaguaaaggcaaccgugggguucaggcauuuagcaagggaucugugcaggccgaucugacccuaauguucgacaacuuugaaguagauuucgugggcgcugcggucuccugcgacgccgcauuucugaaucucacugggugcuauucauguaacgcuggagcccgggugugccugaguauuacaagcaccggcacagguacucuuuccgcccauaauaaggacgggucuuugcacaucguucugccaucggagaacggaaccaaagaucaaugucagauauuacauuucacggugccugaggucgaagaggaauuuauguacagcugcgacggcgaugagagaccccuccuggugaaggguacccuuaucgcuauugacccauucgaugacaggcgcgaggcaggcggggaaucaacaguugugaauccgaaauccggaaguuggaacuuuuucgauugguucucuggccugaugagcugguuugggggaccuuugaagacuauccuccugauuugucuauacgucgcccuguccaucggccucuucuuucugcuuauauauuugggucggaccgggcugucaaaaaugugguuagcggcuacaaagaaggccucuuga

SEQ ID NO: 11186 - RNA, 3480 nt, Artificial Sequence
  derived and/or modified CDS sequence (opt3) from RVFV(2007000324)__JF326195.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcauguucuucguucgaugugcuucuggaaaaaggcaaguuuccauuguuccagucauaugcccaccauaggacccuccuggaggcuguccacgacacaaucauugccaaagcagaucccccuagcugcgaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagauaucgguguccauauggcccacgacgaucaaucagugaguagcaagauuguugcucauugucccccacaggaccccugcuuggugcacggcugcaucguaugugcccacgggcuaauaaacuaccagugccauacagcacuguccgcguucgucgugauuuucguguuuucuucgaccgcuaucaucugucucgccguucuguaucguguccuuaaaugccugaagauugcaccucgcaaaguguugaauccacucauguggaucacggccuucauuagauggguauacaagaaaaugguggcuaggguugccgacaacauaaaccaggucaaucgggaaaucggauggauggagggcggucaacuggcauuagggaacccggcucccauuccucgacacgccccaaucccccgcuacagcaccuaucugaugcuacuccugaucguguccuacgcgucagccuguagugagcuuauucaggcuucuagcagaauaacaacuugcuccaccgaaggcgugaauacaaaguguagguugucaggaacugcacugauccgggccggcagcgucggggcugaggccugccucaugcugaagggaguuaaagaagaucagaccaaguuucuuaaaauuaagacagugucuuccgagcugaguugucgcgagggucagagcuauuggaccggcucuuucuccccuaaaugcuugucaaguagaaggugccaucucgugggggaaugucacguaaaccguugccugagcuggcgggacaaugagacuucggcagaauuuuccuucgucggagagucuacgacaaugcgagaaaacaaguguuuugagcaaugcggcgguuggggguguggcugcuucaaugugaacccaagcuguuuauuuguucacaccuaccugcagucagugagaaaggaggcgcuaagggucuucaauugcaucgauugggugcauaaacucacucuggaaauuaccgacuuugauggaaguguuuccacaaucgaccuuggcgccucuagcucccgcuucaccaacugggggucagugagcuugagucuggaugcugagggaauaucuggcuccaauagcuuuucguucaucgaaucacccgguaagggguaugccauuguagacgagccguucucugaaaucccucggcagggauuucucggcgagauuagauguaacagugaguccagcguccugucugcacacgaaagcugcuuaagggcuccaaaucugguguccuacaaacccaugaucgaucagcuugaguguacuacaaacuugauagacccuuucguggucuuugaacgcgguucacucccccaaacgcgaaaugauaagaccuucgccgcaaguaaaggcaaccgugggguucaggccuuuagcaagggaucugugcaggcugaccugacucuaauguucgauaacuuugagguagacuucgugggcgcggccgucuccugcgacgcagcuuuucugaaucucacagggugcuauucauguaacgccggagcccgggugugccugaguauuaccagcacaggcacugguacccuuuccgcucauaauaaggaugggucuuugcacaucguucugccaucggaaaacggaacgaaagaccaaugucagauuuuacauuucaccgugccugaggucgaggaagaguuuauguacagcugcgauggcgacgaaagaccccuccuggugaaggguacacuuaucgcaauagauccauucgacgauaggcgcgaggccggcggggagucaacuguugugaauccgaaauccggaaguuggaacuuuuucgacugguucucuggccugaugagcugguuugggggaccuuugaagaccauccuccugauuugucuauacgucgcgcuguccaucggccucuucuuucugcuuauuuauuugggucggacagggcugucaaaaaugugguuagcugccacuaagaaggcaucuuga

SEQ ID NO: 11187 - RNA, 3480 nt, Artificial Sequence
  derived and/or modified CDS sequence (opt3) from RVFV(OS-8)__DQ380185.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaagaauagcaaaaaggucuaccuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcacggauccaagaaauguacuggugaugcugccuucugcagcgcauaugaguguaccgcccaguacgcuaaugcguauugcucgcaugcaaacggcucuggggugguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagacaucgguguccauauggcccacgaugaccaaucagugaguagcaagauuguugcucauugucccccacaggaccccugcuuggugcacggcugcaucguaugugcccacgggcuaauaaauuaccagugccauacagcacuguccgcguucgucgugguuuucguguuuucuucggucgcuauuaucugucucgccauccuguauaaagugcuuaagugccugaaaauugcaccucguaagguauugaacccacucauguggaucaccgccuucauucgcuggguguacaaaaagaugguugcuagagucgccgauaauauaaaccaggugaacagggaaaucggauggauggagggcggucaacuggcauuagggaauccggcucccauuccucggcacgccccaaucccccgauacagcacguaucugaugcuacuccugaucguguccuacgcgucagccuguagugagcuuauucaggcuucuagccgcauaaccacaugcuccacugaaggcgucaacaccaaguguagauugucaggaacagcacugaucagggccggcagcguuggggcugaggccugccucaugcugaaaggagugaaggaagaccagacuaaauuucuucggauuaagaccgugucuuccgagcugaguugucgcgagggucagagcuauuggacaggcucuuucuccccuaaaugcuugucaaguagaaggugccaucucguaggggaaugucacgucaaucguugccugagcuggcgggauaacgagaccucggcagaauuuuccuucgugggagagucuacuacgaugcgagaaaauaaguguuuugagcaaugcggcgguuggggguguggcugcuucaacguuaauccaagcuguuuauuugugcacacauaccugcagucagucagaaaggaggcgcuaaggguguucaacugcaucgacuggguucauaaacucacccuggaaauuacugauuuugacggaaguguguccaccaucgaucuuggcgccucuagcucccgcuucacaaauugggggucaguauccuugagucuggacgcugagggaauaucuggcuccaacagcuuuucguucaucgaaucacccgguaagggguaugccauugucgaugagccguucucugaaaucccucggcagggauuucucggcgagauuagauguaauagugaguccagcgugcugucugcacacgaaagcugcuuaagggcuccaaaccugaucuccuacaaacccaugauagaccagcuugaguguaccacuaauuugauugauccuuucguggucuuugaacgcgguucacucccccaaacacgaaacgacaagacguucgccgcaaguaaaggcaaucgugggguucaggccuuuagcaagggaucugugcaggcugaucugacccuaauguucgacaacuuugagguagacuucgugggcgcggccgucuccugcgaugcagcuuuucugaaccucucagggugcuauaguuguaaugccggagcccgggugugccugagcaucacuuccacaggcaccgguacacuuucugcucauaacaaggacgggucguugcacauuguucugccaagcgaaaauggaacuaaagaucaaugucagaucuuacauuucaccgugccugaggucgaggaagaguuuauguacucaugcgacggcgaugaaagaccccuccuggugaaggguacgcuuauagcaaucgacccauucgaugacaggcgcgaggccggcggggaguccaccguugugaacccgaaaaguggaucuuggaacuuuuucgauugguucagcggccugauguccugguuugggggaccuuugaagacaauucuccugaucugucuauacgucgcgcugucaauuggccucuucuuucugcuuaucuauuugggucggacugggcugucuaaaaugugguuagcugccaccaagaaggcaagcuga

SEQ ID NO: 11188 - RNA, 3480 nt, Artificial Sequence
  derived and/or modified CDS sequence (opt3) from RVFV(ZINGA J83 R1)__KU978776.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcuuaugacaggugccagcuugaaaaagggcuccuauccacugcaggaccuauucugucagucaagugaggaugacgggagcaaacucaagaccaagaugaaaggaguaugcgagguuggcgugcaggcacugaagaaaugcgauggucaacuuucuacggcucaugaagucgugcccuuugccguguucaaaaauuccaaaaaggucuaccuggacaaguuggaucucaaaacugaggaaaaccuguuaccugacucauuuguuuguuucgagcacaaggggcaguacaaaggaaccauggauagcggccagacaaagcgcgaacugaaaaguuuugacauaucucagugcccaaagauuggcgggcacggauccaagaaauguacuggugaugcugccuucugcagcgcauaugaguguaccgcccaauacgcuaaugcguauugcucgcaugcaaacggcucugggaucgugcagauucagguauccggaguguggaagaaaccccucugugucggcuacgagcgagugguugugaagagagaacuuucagccaaaccgauccaaagggucgagccuugcacaaccuguaucacgaagugcgaaccccacggucuggugguacggaguacuggguuuaagauuagcuccgcuguugccugugcaucuggcgugugcgucacaggaagccagucaccaaguaccgagauaacuuugaaauauccuggcaucucccagagcucugggggagacauuggugugcauauggcccacgaugaccagucagucaguagcaagaucguggcucauugucccccacaagaccccugccuaguucacggcugcauagugugugcccacgggcugauuaauuaccagugccauacagcacucuccgcguucguagucguguucguguuuucuucgaucgcuaucauuugucuggccauccuuuaucguguucugaaaugcuugaagauugcaccucgcaaaguccucaacccacugauguggauaaccgccuucaucagauggguguacaggaagaugguagcucggguggccgauaauauuaaccagguuaaccgagaaaucggauggauggagggcggucaguuaguccuggggaauccggcacccaucccucgccacgugccaauucccagauacagcacguaucuaaugcuccugcuuauaguguccuacgcuucagccuguagugaguugauccaagcgucuagcaggauuaccacaugcuccacugaaggcgucaacaccaaaugucggcugucaggaacagcccucauccgcgcuggcagcguuggggcagaggccugccugaugcuuaagggagugaaggaagaccagacuaaauuucugaagauuaaaaccgugucuuccgaguugaguuguagagagggucagagcuauuggacaggcucuuucuccccuaagugccucucaaguaggcguugccaucugguaggggaaugucacgucaaucggugcuuaagcuggcgagauaacgagaccucggcugaauuuuccuucgugggagagucuacuacgaugagagaaaauaaauguuuugagcagugcggcgguuggggguguggcugcuucaacguuaauccaagcugucuguuugugcacacauaccuacaaucagucaggaaggaggcccuccgcguguucaacugcaucgacuggguucauaagcugacccuugaaauaacugauuuugacggaaguguguccaccaucgauuugggcgcaucuagcucccgguucacaaauugggggucaguaagccugagucucgacgcggagggaauuucuggcuccaacagcuuuucguucaucgaaucacccgguaaaggguaugccauugucgaugagccguucucugaaaucccuagacagggauuucugggcgagauaagguguaauagugaguccagcguguuaucugcucacgaaagcugccugcgcgccccaaaccuuauuuccuacaagcccaugaucgaccaguuggaguguaccacuaaucucauugauccuuucguggucuuugaacgagguucacugccccagacacggaacgacaaaacguucgcagcuaguaagggcaaucgugggguucaagccuuuagcaaaggaucugugcaggcagaucuaacccugauguucgacaacuuugagguagacuucgugggcgccgcugucuccugcgaugcggccuuucucaaccugacugggugcuauucauguaaugcaggagcuagagugugccuuaguaucacaagcaccggcacagguacuuuguccgcccauaacaaggacgggucucugcacauaguuuuaccaucggaaaauggaaccaaggaucagugucaaauccuccauuucacggugccugaggucgaggaagaguuuauguacagcugcgacggcgaugaaaggccccugcuugugcgcgguacccugauugccaucgacccauucgaugaccggagagaggcuggcggggagucaacaguugugaacccgaaauccggaaguuggaacuuuuucgauugguucucuggcuugaugagcugguuugggggaccucucaagacuauucugcuaaucugucuguacgucgcacucuccauaggccuguucuuucuuuugauuuaucuggguaggaccggguuaucaaaaauguggcucgccgcgacaaagaaggcuucuuga

SEQ ID NO: 11189 - RNA, 3480 nt, Artificial Sequence
  derived and/or modified CDS sequence (opt3) from RVFV(2007000253)__JF326192.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcauguucuucguucgaugugcuucuggaaaaaggcaaguuuccauuguuccagucauaugcccaccauaggacccuccuggaggcuguccacgacacaaucauugccaaagcagaucccccuagcugcgaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagauaucgguguccauauggcccacgacgaucaaucagugaguagcaagauuguugcucauugucccccacaggaccccugcuuggugcacggcugcaucguaugugcccacgggcuaauaaacuaccagugccauacagcacuguccgcguucgucgugauuuucguguuuucuucgaccgcuaucaucugucucgccguucuguaucguguccuuaaaugccugaagauugcaccucgcaaaguguugaauccacucauguggaucacggccuucauuagauggguauacaagaaaaugguggcuaggguugccgacaacauaaaccaggucaaucgggaaaucggauggauggagggcggucaacuggcauuagggaacccggcucccauuccucgacacgccccaaucccccgcuacagcaccuaucugaugcuacuccugaucguguccuacgcgucagccuguagugagcuuauucaggcuucuagcagaauaacaacuugcuccaccgaaggcgugaauacaaaguguagguugucaggaacugcacugauccgggccggcagcgcuggggccgaggcaugccucaugcugaagggagucaaagaagaucagaccaaguuucuuaaaauuaagacaguuucuuccgagcugaguugucgcgagggucagagcuauuggaccggcucuuucuccccuaaaugcuugucaaguagaaggugccaucucgugggggaaugucacgugaaccguugccugagcuggcgggacaaugagacuucggcggaauuuuccuucguaggagagucuacgacaaugcgagaaaacaaguguuuugagcaaugcggcgguuggggguguggcugcuucaaugucaacccaagcuguuuauuugugcacaccuaccugcagucaguuagaaaggaggcccuaaggguguucaauugcaucgauuggguccauaaacucacucuggaaauuaccgacuuugauggaaguguguccacaaucgaccuuggcgcuucuagcucccgcuucaccaacugggggucaguuagcuugagucuggaugccgagggaauaucuggcuccaauagcuuuucguucaucgaaucacccgguaagggguaugcaauuguggacgagccguucucugaaaucccucggcagggauuucucggcgagauuagauguaacagugaguccagcguacugucugcucacgaaagcugcuuaagggccccaaaucuggucuccuacaaacccaugaucgaucagcuugaguguacuacaaacuugauagacccuuucgugguguuugaacgcgguucacucccccaaacgcgaaaugauaagaccuucgcagccaguaaaggcaaccgugggguccaggcuuuuagcaagggaucuguucaggcggaccugacucuaauguucgauaacuuugagguggacuucguaggcgccgcaguguccugcgacgcugccuuucugaaucucacagggugcuauucauguaacgccggagcucgggucugccugaguauuaccagcacaggcacugguacccuuuccgcacauaauaaggaugggucuuugcacaucgugcugccaucggaaaacggaacgaaagaccaaugucagauuuuacauuucaccguuccugagguggaggaagaguuuauguacagcugcgauggcgacgaaagaccccuccuggucaaggguacacuuaucgccauagauccauucgacgauaggcgcgaggcgggcggggagucaacugugguuaauccgaaauccggaaguuggaacuuuuucgacugguucucuggccugaugagcugguuugggggaccuuugaagaccauccuccugauuugucuauacguggcucuguccaucggccucuucuuucugcuuauuuauuugggucggacagggcugucaaaaaugugguuagccgcaacuaagaaggccucuuga

SEQ ID NO: 11190 - RNA, 3480 nt, Artificial Sequence
  derived and/or modified CDS sequence (opt3) from RVFV(MP12)__Z30318.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacggaaaacuauggccggcauugcaaugacggugcugcccgcccuagcuguauucgcacucgccccuguggucuuugcugaagauccacaucugcgcaacagacccgguaaggggcacaauuauaucgacggaaugacccaggaggaugccacauguaaaccugugacuuacgcgggcgcauguucuucguucgacguucuucuggagaagggcaaauuuccauuguuccagucauaugcccaccauaggacccuccuggaagcugugcacgauacaauuaucgccaaggcagaucccccuagcugcgaccugcucagugcucacgggaacccaugcaugaaggagaaauuagucaugaagacccauuguccgaaugacuaccaguccgcccaccaucugaacaaugauggaaaaauggcgucugugaagugucccccuaaauaugaacuuacugaggacugcaacuuuugccggcaaaugacaggugccagcuugaagaaaggcuccuacccacugcaggaccuauucugucagucaagugaagaugacgggagcaagcucaagaccaaaaugaagggaguaugcgagguuggcgugcaggcacugaaaaagugcgauggucaacuuucuacggcucacgaggucgugcccuuugccguguucaaaaauuccaagaaggucuaucuggacaaauuggaucucaagacugaagagaaccuguuaccugacucauuuguuuguuucgaacacaaagggcaguacaagggaaccauggauagcggccagacaaaacgcgagcugaagaguuuugacauaucucagugcccaaagauuggcgggcauggauccaaaaaguguacuggugaugcugccuucugcagcgcauacgaauguaccgcccaauaugcuaaugcguacugcucgcacgcaaacggcucugggaucgugcagauucagguauccggaguguggaaaaagccccucugugucggcuaugagcgagugguugugaaaagagagcuuucagccaagccgauccaaagggucgaaccuugcacaaccuguaucacgaagugcgagccccauggucuggugguacggaguacuggguuuaaaauuagcuccgcuguugccugugcaucuggcgugugcgucacaggaagccagucaccaaguaccgaaauaacuuugaaguacccuggcaucucccagagcucugggggagacauuggugugcacauggcccaugaugaccagucagucaguagcaaaaucguggcucacugucccccacaagaccccugccuaguucacgauugcauagugugugcccauggccugauuaauuaucagugccacacagcacucuccgcguucguagucguguucguguuuucuucgaucgcuaucauuugucuggccauccuuuaccguguucugaagugcuugaaaauugcaccucgcaagguccucaacccacugauguggauaaccgccuucaucagauggauuuauaaaaagaugguggcuaggguagcccauaauaucaaccaggugaaccgggagaucggguggauggaaggaggccaguuaguucuggguaauccggcacccauuccucgacacgcuccaauaccccgcuacagcacguaccuaaugcuccugcuuaucgucuccuaugccucagcguguagugaguugauucaagccucuagcagaaucaccacaugcuccacugagggggugaacaccaaguguaggcugucaggcacagcucucauucgggcaggaagcgugggcgccgaagcaugccugaugcuuaaaggggucaaggaggaccagacuaaauuucugaaguugaaaaccguuucuuccgaacucaguugucgcgagggacagagcuacuggacagguucuuucuccccuaagugccugucaaguagaaggugccacuuagugggcgagugucaugugaaucguugccugagcuggcgggauaacgaaaccucggccgaguuuuccuucguaggggaaucuacuacgaugcgagagaauaaguguuuugaacagugcggaggcugggguugugggugcuucaacgucaauccaagcugucuauuugugcacacauaucuccaaucaguuagaaaagaggcacugaggguguucaacugcaucgacuggguccauaaacuuaccuuggagauaacugauuuugacggcaguguguccaccaucgaucugggagcgucuagcucccgcuucacaaauuggggcucaguuagccucagucuggacgccgaagggauuucuggauccaacagcuuuucguucaucgagucacccggcaaggguuacgcuauuguggaugaaccguucucugagaucccucggcagggguuuuuaggagaaauaagauguaauagugaguccagcguacugucugcccacgagagcugccuuagggcaccaaacuugauuuccuauaagcccaugaucgaccagcucgaauguaccacuaaucugauugauccuuucgucguguuugagcgcggcucacuaccccagacacgaaacgacaaaacguucgcugccaguaaggguaaucggggcgugcaagcauuuagcaaggggucuguccaggccgaucugacccucauguucgacaacuuugaaguugacuucgugggagcugcgguauccugcgaugccgcauuucugaaccuuacuggcugcuacucauguaaugcuggggcccgugugugcuugaguaucacaagcaccggaacaggcucccugucugcccauaacaaagacgguucguuacacauaguccucccaagcgagaaugggacuaaggaucagugucaaauccugcacuucaccgugccugaaguugaggaggaauuuauguauucaugcgacggagaugagagaccccuucuggugaaaggcacguugauugcuaucgacccauucgaugacaggcgcgaagcugguggcgaguccaccgucgugaacccgaagagugggucuuggaacuuuuucgauugguucagcggacucauguccugguuuggcgggccucugaaaacaauucuacugaucugucucuacguugcccugucaauaggacuuuucuuuuugcugauuuacuuaggcgguacugggcucucuaagauguggcuggcggcuaccaagaaagccagcuga

SEQ ID NO: 11191 - RNA, 3480 nt, Artificial Sequence
  derived and/or modified CDS sequence (opt3) from RVFV(BIME-01)__KX609032.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaagaaggucuaccuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcacggauccaagaaauguacuggugaugcugccuucugcagcgcauaugaguguaccgcccaguacgcuaaugcguauugcucgcaugcaaacggcucugggaucgugcagauucaaguauccggaguguggaagaaaccccugugugucggcuacgagcgagugguugugaagagagaacucucagccaaaccgauccagagggucgagccuugcacaaccuguaucacgaagugcgaaccccacggucuugugguacggaguacuggguuuaagauuagcuccgcuguugccugugcaucuggcgugugcgucacaggaagccagucaccaaguaccgagauaacucugaaauauccuggcaucucccagagcucugggggagacauuggugugcauauggcccacgaugaccaaucagucaguagcaagaucguggcucauugucccccacaggaccccugcuugguucacggcugcauagugugugcccacgggcuaauuaauuaccagugccauacagcacuguccgcguucguagucguguucguguuuucuucgguugcuaucaucugucucgccauucuguauaaaguccuucguugccugaagaucgcaccuaaaaagguguugaacccacucauguggauuaccgccuucauacgcuggguauacaaaaagaugguggcuagaguugccgauaauaucaaccaggucaacagggaaauuggauggauggagggcggucaacuggcauuagggaauccggcucccaucccucggcacgccccaaucccccgauacagcacguaucugaugcuacuccugauuauauccuacgcgucagccuguagugagcuuauccaggcuucuagccgcauuaccacaugcuccacugaaggcgugaacaccaaguguagauugucaggaacagcacugaucagggccggcagcgugggggcugaggccugccucaugcugaaaggagucaaggaagaccagacuaaauuucuuaagauuaaaaccguuucuuccgagcugaguugucgggagggucagagcuauuggacaggcucuuucuccccuaagugcuugucaagucgcagaugccaucucgugggggaaugucacgugaauaggugccugagcuggcgugauaacgagaccucggcagaauuuuccuucguaggagagucuacuacgaugcgggaaaauaaguguuuugagcaaugcggcgguuggggguguggcugcuucaacgucaauccaagcuguuuauuugugcacacauaccugcagucaguucgaaaagaggcgcuaagaguguucaacugcaucgacuggguccauaagcucacccuggaaauaacugauuuugacggaaguguguccaccaucgaucuuggcgccucuagcuccagguucacaaauugggggucaguuagcuugagucuggacgcugagggaauuucuggcuccaacagcuuuucguucaucgaaucacccgguaaaggguaugccauuguggaugagccguucucugaaaucccucgccagggauuucucggcgagauacgguguaauagugaguccagcguacugucugcacacgaaagcugcuuaagagcuccaaaccugauuuccuacaagcccaugaucgaccagcuugaguguaccacuaauuugauugauccuuucgucguguuugaaagggguucacucccccaaacacgcaacgacaaaacguucgccgcaaguaagggcaaucgaggggugcaggccuuuagcaagggaucuguccaggcugaucugacccuaauguucgacaacuuugagguugacuucgugggcgcggccguauccugcgaugcagcuuuucugaaccucacugggugcuauucauguaaugccggagcccgggugugccugaguaucacaagcaccggcacagguacucuuuccgcucauaacaaagacgggucuuugcacauaguccugccaucggaaaauggaaccaaggaucaaugucagaucuuacauuucacggugccugagguugaggaagaguuuauguacagcugcgacggcgaugaacguccccuccuggugaaagguacccuuauugcaaucgacccauucgaugacagaagggaggccggcggggagucaacagucgugaacccgaaguccggaaguuggaacuuuuucgauugguucucuggccugaugagcugguuugggggaccuuugaaaacuauucuccugaucugucuauacguugcgcuguccauaggccucuucuuucugcuuauuuauuugggucgcaccgggcugucaaagaugugguuagcugccacaaagaaagcaucuuga

SEQ ID NO: 11192 - RNA, 3480 nt, Artificial Sequence
  derived and/or modified CDS sequence (opt3) from RVFV(200803166)__JF311381.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcauguucuucguucgaugugcuucugaaaaagggcaaauuuccauuguuccagucauaugcccaccauaggacccuccuggaagcuguccacgacacaaucauugccaaggcagaucccccuagcugcgaccugcagagugcucacgggaauccaugcaugaaggagaaacucgugaugaagacccauuguccgaacgauuaccaauccgcccacuauuuaaauaacgacggaaaaauggcgucuguaaagugucccccuaaauacgaacugacugaggauugcaauuuuugccggcagaugacaggugccagccuuaagaaaggcuccuauccauugcaggaccuguucugucagucaagugaagacgaugggagcaagcuaaagaccaaaaugaagggaguuugcgaggugggcguccaagcacucaaaaagugcgacggucagcugucuacggcucaugagguggugcccuuugccgucuucaaaaacuccaagaagguuuaccuugauaaacuggacuugaagacugaagagaaucuccugccugauucauuuguguguuucgaacacaaagggcaguacaagggaaccauggacagcggccagacaaaacgcgaguuaaagaguuuugauaucucucaaugcccaaagauaggcgggcacggauccaaaaaguguacuggugacgcugccuucugcagcgcauaugaauguaccgcccaguacgcuaacgcguauugcucgcaugcaaauggcucugggauuguacagauccaaguguccggagucuggaaaaagccccugugugugggcuacgagcgaguuguggucaaaagagagcucucagccaagccgauucagaggguggaaccuugcacaaccuguaucacgaagugcgagccccacggucuuguaguucggaguacuggguuuaaaaucagcuccgcuguggccugugcaucuggcgucugcgugacaggaagccagucaccaaguaccgaaauuacucugaaguauccuggcauaucccagagcucugggggagauaucgguguccauauggcccacgacgaucaaucagugaguagcaaaauuguugcucauugucccccacaggaccccugcuuggugcacggcugcaucguaugugcccacgggcuaauaaacuaccagugccauacagcacuguccgcguucgucgugguuuucguguuuucuucgauugcuaucaucugucucgccauucuguaucguguccuuaagugccugaaaaucgcaccucgcaagguguugaauccacucauguggauuaccgccuucauaagauggguauacaaaaagaugguggcuaggguugccgacaacaucaaccaggucaaucgggagauuggauggauggaaggcggucaacugguguuagggaacccggcacccaucccucgacacgcuccaaucccccgcuacagcacguaucugaugcuacuccugauuguguccuacgccaccgcguguucagagcuuauacaggccaguucuagaaucacaacuugcagcaccgagggcgucaauacaaaguguagguuguccggaacugcucugauucgggcaggcucaguuggggccgaggcuugccucaugcugaaaggagugaaggaagaucagaccaaauuucuuaagaucaaaacagugagcucugaacuguccugucgcgagggucagaguuauuggaccggcagcuucucuccuaagugcuuguccucaagaaggugccaucucguaggggagugucacgucaaccguugccugaguuggcgggacaaugaaacuagcgccgaguuuucguucgugggagaauccacgacaaugcgagagaacaaguguuuugaacaaugcggcgguuggggguguggcugcuucaauguuaacccaucuuguuuauuugugcacaccuaccugcagagcgucagaaaagaggcacuaaggguguucaauugcauugauuggguucauaagcucacucuggagaucaccgacuuugauggaucagugaguacaauagaccuuggcgcguccucuagccgcuucaccaacuggggguccguaucauugagccuggaugccgaaggaaucaguggcucuaauuccuuuagcuucauugagucgcccgguaaaggguaugcuaucgucgacgaaccguucucagagauuccucggcagggauuucucggcgaaaucagauguaacucugagaguuccgugcugagcgcccacgagucuugcuuaagggcaccaaaucugauaagcuacaagcccaugauugaucagcuugaauguacuacaaacuugaucgacccuuucguggucuuugagcgcgguucccucccccaaacgcgaaaugauaaaaccuucgcugccucaaagggcaaccgugggguucaggcauuuaguaagggaagcgugcaggccgaccugacucuaauguucgauaacuuugaaguagacuucgugggcgcugcggucucuugcgacgccgcauuucugaaucucacagggugcuauuccuguaacgcuggagcccgggugugccugucaauuaccaguacaggcacugguacccuuagcgcccauaauaaagauggguccuugcacguugugcugccaucugagaacggaacgaaggaccaaugucagaucuuacauuucaccgucccugaaguggaggaggaauuuauguacucgugcgauggcgacgagagaccccuccugguuaaagguacacuuauagcuaucgauccauucgacgauaggcgcgaagcaggcggggagagcacuguggucaauccgaagucaggauccuggaacuuuuucgacugguucaguggccugaugucuugguuugggggaccuuugaaaaccauucuccugaucugucuauacguagcccugagcauuggccucuucuuucugcuuaucuauuugggucggacagggcuguccaagaugugguuagcggcuacuaagaaagccucauga

SEQ ID NO: 11193 - RNA, 3480 nt, Artificial Sequence
  derived and/or modified CDS sequence (opt3) from RVFV(Kenya 83 (21445))__DQ380198.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaagaacccugaaaauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaucuguucugucagucaagugaggacgacgggagcaaacuaaagaccaagaugaaaggaguaugcgagguuggcgugcaagcacucaagaaaugcgauggucagcugucuacggcucaugaagucgugcccuuugccguguucaaaaauuccaagaaggucuaccuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcacggauccaagaaauguacuggugaugcugccuucugcagcgcauaugaguguaccgcccaguacgcuaaugcguauugcucgcaugcaaacggcucugggaucgugcagauucaaguauccggaguguggaagaaaccccugugugucggcuacgagcgagugguugugaagagagaacucucagccaaaccgauccagagggucgagccuugcacaaccuguaucacgaagugcgaaccccacggucuugugguacggaguacuggguuuaagauuagcuccgcuguugccugugcaucuggcgugugcgucacaggaagccagucaccaaguaccgagauaacucugaaauauccuggcaucucccagagcucugggggagacauuggugugcauauggcccacgaugaccaaucagucaguagcaagaucguggcucauugucccccacaggaucccugcuugguucacggcugcauagugugugcccacgggcuaauuaauuaccagugccauacagcacuguccgcguucguagucguguucguguuuucuucgaucgcuaucauuugucucgccauccuguaucguguucuuaaaugccugaagauugcaccucgcaaagucuugaacccacucauguggauaaccgccuucaucagauggguguacaagaaaaugguagcuaggguggccgacaacauuaaucagguuaaccgggaaaucggauggauggagggcggucaacuggcauuagggaauccggcucccaucccucgacacgccccaauuccccgcuacagcacguaucugaugcuacuccugauagucuccuacgcgucagccuguagugagcuuauccaggcuucuagcagaauuaccacaugcuccacugaaggcgugaacaccaaguguagguugucaggaacagcacugauccgggccggcagcgugggggcugaggccugccucaugcugaagggagucaaagaagaccagacuaaguuucuuaaaauuaagaccguuucuuccgagcugaguugucgcgagggucagagcuauuggacaggcucuuucuccccuaaaugcuugucaaguagaaggugccaucucgugggggaaugucacgugaaucguugccugagcuggcgggauaacgagaccucggcagaauuuuccuucguaggagagucuacuacgaugcgagaaaauaaguguuuugagcaaugcggcgguuggggguguggcugcuucaacgucaauccaagcuguuuauuugugcacacauaccugcagucaguuagaaaggaggcgcuaaggguguucaacugcaucgacuggguccauaaacucacccuggaaauaacugauuuugacggaaguguguccaccaucgaucuuggcgccucuagcucccgcuucacaaauugggggucaguuagcuugagucuggacgcugagggaauuucuggcuccaacagcuuuucguucaucgaaucacccgguaagggguaugccauuguggaugagccguucucugaaaucccucggcagggauuucucggcgagauaagauguaauagugaguccagcguacugucugcacacgaaagcugcuuaagggcuccaaaccugauuuccuacaaacccaugaucgaccagcuugaguguaccacuaauuugauugauccuuucgucguguuugaacgcgguucacucccccaaacacgaaacgacaagacguucgccgcaaguaaaggcaaccguggggugcaggccuuuagcaagggaucuguccaggcugaucugacccuaauguucgacaauuuugagguugauuucgugggcgcggccguauccugcgacgcagcuuuucugaaccucacugggugcuauucauguaaugccggagcccgggugugccugaguaucacaagcaccggcacagguacucuuuccgcucauaacaaggacgggucuuugcacauaguccugccaucggaaaauggaaccaaagaucaaugucagaucuuacauuucacggugccugagguugaggaagaguuuauguacagcugcgacggcgaugaaagaccccuccuggugaaggguacccuuauugcaaucgacccauucgaugacaggcgcgaggccggcggggagucaacagucgugaacccgaaauccggaaguuggaacuuuuucgauugguucucuggccugaugagcugguuugggggaccuuugaagacuauucuccugaucugucuauacguugcgcuguccauaggccucuucuuucugcuuauuuauuugggucggaccgggcugucaaaaaugugguuagcugccacaaagaaggcaucuuga

SEQ ID NO: 11194 - RNA, 3480 nt, Artificial Sequence
  derived and/or modified CDS sequence (opt3) from RVFV(Entebbe)__DQ380191.1__NSm-Gn-Gc
augaucgagggcgccugggacagccugagagaagaggaaaugcccgaggaacucuccugcucuauuucagggauaagggaggugaagaccaguagccaggagcuucaccgggcucugaaagcaaucauugccgcggauggauugaauaauaucacaugucaugguaaggacccugaagauaaaauuuccuuaaucaagggcccaccgcacaaaaagcgcgucgggguugugcgaugcgagcguagaagggacgcuaagcaaauaggacgggaaacuauggccggcaucgcaaugacgguacugcccgcccuagcuguguucgcacucgccccugucguguuugcugaggauccacaucugcgcaacagacccgguaaagggcacaauuacauugacggaaugacccaggaggaugccacauguaagccuguuacuuaugcgggcgcauguucuucguucgacgugcuucuggaaaaaggcaaguuuccauuguuccagucauacgcccaucacaggacccuccuggaggcuguccacgauacaaucauugccaaagcagaucccccuagcugcgaccugcagagugcucaugggaacccaugcaugaaggaaaagcucgugaugaaaacccacuguccgaaugacuaucaauccgcccauuacuuaaacaaugauggaaagauggcgucuguaaaaugucccccuaaguaugagcugacugaagacugcaacuuuugccggcagaugacaggugccagccuuaaaaagggcuccuacccauugcaggaccuguucugucagucaagugaggaugacgggagcaaacuaaagaccaagaugaaaggaguuugcgaggugggcguccaagcacucaagaaaugcgauggucagcugucuacggcucacgaaguggugcccuuugccgucuucaaaaauuccaagaagguuuaucuugacaagcuggauuugaaaacugaggaaaaccuccugccugacucauuuguguguuucgagcacaaggggcaguacaaaggaaccauggauagcggccagaucaagcgcgaauuaaaaaguuuugacauaucucaaugcccaaagauuggcgggcauggauccaagaaauguacaggugaugcugccuucugcagcgcauacgaguguacugcccaguaugcuaaugcguacugcucgcacgcaaacggcucugggaucguacagauucaaguguccggagucuggaagaaaccccugugugugggcuaugagcgaguuguggucaagagagaacucucagccaaaccgauccagaggguggagccuugcaccacauguaucaccaagugcgaaccccauggucuuguaguucggaguacgggguuuaagauuagcuccgcuguggccugugcaucuggcgucugcgugacuggaagccagucaccaaguacagagauaacccugaaauacccuggcaucucccagagcucugggggagacauugguguccacauggcccaugaugaccaaucagugaguagcaagaucguugcucacugucccccacaggaccccugcuuggugcacggcugcauaguaugugcccaugggcuaauuaauuaucagugccacacugcacuguccgcguucgucgugguuuucguguuuucuucggucgcuaucaucugucucgccauucuguacaaagugcuuaagugccugaaaaucgcaccucguaagguauugaacccacucauguggauuacagccuucauacgcuggguguauaaaaagaugguugcuagagucgccgauaauaucaaccaggugaacagggaaauuggauggauggagggcggucaacugguguuagggaauccggcacccaucccucggcaugcuccaaucccccgauacagcaccuaccugaugcuacuccugauugucuccuaugccucagcguguagugagcuuauacaggccucuagccgcaucacgaccugcuccacagaaggcguuaacacuaaguguagauugucaggaaccgcucugauuagggcaggcagcgugggggccgaggcuugccucaugcugaaaggagugaaggaagaccagacaaaauuucuuaagaucaaaacuguaucuuccgagcugaguugucgggagggucagagcuacuggaccggcucuuucuccccuaagugcuugucaagucgcagaugccaccucgucggggaaugucacgugaauaggugccugagcuggcgugauaacgagacaucggccgaauuuuccuucguuggagagucuaccacuaugcgggaaaauaaguguuuugagcaaugcggcgguuggggguguggcugcuucaacgugaauccaagcuguuuauuuguccauacguaucugcagucagugcgaaaagaggcacuaagaguuuucaacugcauugacugggugcacaagcucacacuggaaaucaccgauuuugacggaaguguauccacugucgaucuuggcgcgucuagcuccagguucaccaauugggggucagugagcuugagucuggacgccgagggaauaucuggcuccaacagcuuuucguucaucgaaucacccgguaaaggguacgcuauuguggaugagccguucucugaaaucccucgccagggauuucucggcgagauucgguguaauagugaguccagcguccugucugcccaugaaagcugcuuaagagcaccaaaccugaucuccuauaagcccaugauagaccagcuugaguguacaaccaauuugauugauccuuucguuguguuugaaagggguucacucccccaaacucgcaacgacaaaacauucgcugccaguaagggcaaucgagggguacaggcauuuagcaagggaucugugcaggccgaucugacgcuaauguucgacaacuuugaggucgacuucgugggcgcugcgguuuccugcgaugccgcauuucugaaccucaccgggugcuacucauguaaugcuggagcccgggugugccugaguaucacuagcacaggcaccgguacacuuuccgcccacaacaaagacgggucuuugcauauuguccugccaucggaaaauggaacuaaggaucaaugucagaucuuacacuucaccgugccugagguugaggaagaguuuauguauagcugcgacggcgaugaacguccccuccuggugaaagguacgcuuauagcuaucgacccauucgaugacagaagggaggcaggcggggagucaaccgucguaaacccgaaguccggaaguuggaacuuuuucgauugguucucuggccugaugagcugguuugggggaccuuugaaaacaauucuccugaucugucuauacguggcccuguccauuggccucuucuuucugcuuaucuacuugggucgcacugggcugucaaagaugugguuagcggcuaccaagaaagccucuuga

SEQ ID NO: 11195 - RNA, 3480 nt, Artificial Sequence
  derived and/or modified CDS sequence (opt3) from RVFV(763/70)__DQ380188.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuagucaagggcccaccgcauaaaaagcgcguugggaucgugcgaugcgagcguagaagggacgcuaagcaaauaggacgggaaacuauggccggcaucgcaaugacgguacugcccgcccuagcuguguucgcacucgccccugucguguuugcugaggauccacaucugcgcaacagacccgguaaagggcacaauuauauugacggaaugacccaggaggaugccacauguaagccuguuacuuacgcgggcgcauguucuucguucgacgugcuucuggaaaaaggcaaguuuccauuguuccagucauaugcccaccauaggacccuccuggaggcuguccacgauacaaucauugccaaagcagaucccccuagcugcgaccugcagagugcucacgggaacccaugcaugaaggaaaagcucgugaugaaaacccauuguccgaaugacuaccaauccgcccacuauuuaaacaaugauggaaagauggcgucuguaaaaugucccccuaaguacggucugacugaggacugcaacuuuugccggcagaugacaggcgccagccuuaaaaagggguccuauccauugcaggaccuguucugucagucaagugaagaugacggaagcaaacuaaagaccaagaugaaaggcguuugcgagguggguguccaagcacucaagaaaugcgaugggcagcugucuacggcucaugagguggugcccuuugccgucuucaagaauagcaaaaagguuuaccuugacaagcuggauuugaaaacugaagagaaccuccugccugacucauuuguguguuucgaacacaagggacaguacaaaggcaccauggauagcggccagacaaagcgcgaguuaaaaaguuuugacaucucucaaugcccaaagauagggggacacgguuccaagaaauguacuggcgaugcugccuucugcagcgcauaugaauguaccgcccaguacgcuaaugcguauugcucgcaugcaaacgggucuggaauuguacagauccaaguguccggcgucuggaagaaaccccuguguguggguuacgagcgaguuguggucaagagagagcucucagccaaaccgauucagaggguggaaccuugcacaaccuguaucacgaagugcgagccccacgggcuuguaguucggaguacuggcuuuaagaucagcuccgcuguggccugugcaucuggagucugcgugacaggcagccagucaccaaguaccgaaauuacucugaaauauccugggauaucccagagcucuggaggugacaucggcguccauauggcccacgaugaccaaucagugaguagcaagauuguugcucauugucccccacaggaccccugcuuggugcacgggugcaucguaugugcccacggacuaauaaauuaccagugccauacagcacuguccgcguucgucgugguuuucguguuuucuucggucgcuauuaucugucucgccauccuguauaaagugcuuaagugccugaaaauugcaccucguaagguauugaacccacucauguggaucaccgccuucauucgcuggguguacaaaaagaugguugcuagagucgccgauaauauaaaccaggugaacagggagaucggcuggauggaaggugggcaacuggcauuaggcaauccggcucccauuccucggcacgccccaaucccccgauacagcacguaucugaugcuacuccugaucguguccuacgcgucagccuguagugagcuuauucaggcuucuagccgcauaaccacaugcuccacugagggagucaacaccaaguguagauugucaggcacagcacugaucagggccgggagcguuggagcugaagccugccucaugcugaaaggugugaaggaggaccagacuaaauuucuuaagauuaaaaccgugucuuccgaacugaguugucgggagggccagagcuauuggacagggucuuucuccccuaagugcuugucaagucgcagaugccaucucguaggagagugucacgucaauaggugccugagcuggcgugauaacgaaaccucggcagaguuuuccuucgugggcgaaucuacuacgaugcgggagaauaaguguuuugaacaaugcgguggguggggcuguggaugcuucaacguuaauccaagcuguuuauuugugcacacauaccugcagucaguccgaaaagaggcgcuaagaguguucaacugcaucgacuggguucauaagcucacccuggagauuacugauuuugacggcaguguguccaccaucgaucuuggggccucuagcuccagguucacaaauuggggaucaguauccuugagucuggacgcugaaggcauaucugguuccaacagcuuuucguucaucgagucacccgggaaaggauaugccauugucgaugaaccguucucugagaucccucgccagggcuuucucggugaaauucgguguaauagugaguccagcgugcugucugcacacgagagcugcuuaagagcuccaaaccugaucuccuacaagcccaugauagaccagcuugaauguaccacuaauuugauugauccuuucguggucuuugagaggggcucacucccccaaacacgcaacgacaaaacguucgccgcaaguaaggggaaucgaggaguucaggccuuuagcaagggcucugugcaggcugaucugacccuaauguucgacaacuuugaaguagacuucgugggggcggccgucuccugcgaugcagcuuuucugaaccucacuggaugcuauucauguaaugccggcgcccgggugugccugaguaucacaagcaccgguacagggacucuuuccgcucauaacaaagacggaucuuugcacauuguucugccaucggagaauggcaccaaggaucaaugucagaucuuacauuucacggugccugaagucgaggaggaauuuauguacagcugcgacggugaugagcguccccuccuggugaaaggcacccuuauagcaaucgacccauucgaugacagaagggaagccgggggagagucaacaguugugaacccgaaguccggcaguuggaacuuuuucgauugguucucugggcugaugagcugguuuggaggcccuuugaaaacuauucuccugaucugucuauacgucgcgcuguccauuggucucuucuuucugcuuaucuauuuggggcgcaccggacugucaaagaugugguuagcugccacaaagaaagcaucuuga

SEQ ID NO: 11196 - RNA, 3480 nt, Artificial Sequence
  derived and/or modified CDS sequence (opt3) from RVFV(OS-1)__DQ380186.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcgucaaagagacgcuaagcagaucggaagggaaacuauggccggcauugcaaugacggugcugcccgcccuagcuguauucgcacucgccccuguggucuuugcugaggauccacaucugcggaaccgccccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauagaacccuccuggaggcugugcacgauacaauuaucgccaaagcagaucccccuagcugcgaccugcaaagugcucacgggaacccaugcaugaaggaaaagcucgucaugaaaacccauuguccgaaugacuaccaguccgcccacuauuuaaacaaugauggaaagauggcgucugugaaaugucccccuaaguacgagcugacugaagacugcaacuuuugcaggcagaugacaggugccagccuuaaaaagggcuccuauccauugcaggaccuguucugucaaucaagugaggaugacgggagcaaacuaaagaccaagaugaaaggaguaugcgagguuggcgugcaggcacucaagaaaugcgauggucagcugucuacggcucaugaagucgugcccuuugccguguucaaaaauuccaaaaaggucuaccuugacaagcuggauuugaaaacugaggaaaaccuccugccugacucauuuguuuguuucgagcacaaggggcaguacaaaggaaccauggauagcggccaaacaaagcgggaauuaaaaaguuuugacauaucucagugcccaaagauuggcgggcacggauccaagaaauguacuggugaugcugccuucugcagcgcauaugaguguaccgcccaguacgcuaaugcguauugcucgcaugcaaacggcucuggggugguacaaauccagguguccggagucuggaagaaaccccugugugugggcuacgagcgcguuguggucaagcgagaacucucagccaaaccgauucagagaguggagccuugcacaaccuguaucacgaagugcgaaccccacggucuuguaguuaggaguacuggguuuaagaucagcuccgcuguggccugugcaucuggcgucugcgugacaggaagccagucaccaaguaccgagauuacucugaaauauccuggcauaucccaaagcucugggggagacaucgguguccauauggcccacgaugaccagucagugaguagcaagauuguugcucauugucccccacaggaccccugcuuggugcacggcugcaucguaugugcccacgggcuaauaaauuaccagugccauacagcacuguccgcguucgucgugguuuucguguuuucuucggucgcuauuaucugucucgccauccuguauaaagugcuuaagugccugaaaauugcaccucggaagguauugaacccacucauguggaucaccgccuucauucguuggguguacaaaaagaugguugcucgcgucgccgauaauauaaaccaagugaacagagaaaucggauggauggagggcggucagcuggcauuagggaauccggcucccauuccuaggcacgccccaaucccccgguacagcacguaucugaugcuacuccugaucguguccuacgcgucagccuguagugagcuuauucaggcuucuagccgaauaaccacaugcuccacugaaggcgucaacaccaagugucgcuugucaggaacagcacugaucagagccggcagcguuggggcugaggccugccucaugcugaaaggagugaaggaagaccagacuaaauuucuuaagauuaaaaccgugucuuccgagcugaguuguagggagggucaaagcuauuggacaggcucuuucuccccuaagugcuugucaagucggcgcugccaucucguaggggaaugucacgucaauagaugccugagcuggagggauaacgagaccucggcagaauuuuccuucgugggagagucuacuacgaugcgugaaaauaaguguuuugagcagugcggcgguuggggguguggcugcuucaacguuaauccaagcuguuuauuugugcacacauaccugcagucaguccggaaagaggcgcuaaagguguucaacugcaucgacuggguucauaaacucacccuggaaauuacugauuuugacggaaguguguccaccaucgaucuuggcgccucuagcucccgauucacaaauugggggucagucagcuugagucuggacgcugagggaauaucuggcuccaacagcuuuucguucaucgaaucacccgguaagggguaugccauuguagaugagccguucucugaaaucccuagacagggauuucucggcgagauuagguguaauagugaguccagcgugcugucugcacacgaaagcugcuuacgcgcuccaaaccugaucuccuacaaacccaugauagaccaacuugaguguaccacuaauuugauugauccuuucguggucuuugaacgggguucacucccccagacaagaaacgacaagacguucgccgcaaguaagggcaaucgcgggguucaggccuuuagcaaaggaucugugcaagcugaucugacccuaauguucgacaacuuugagguagacuucgugggcgcggccgucuccugcgaugcagcuuuucugaaccucacugggugcuauucauguaaugccggagccagggugugccugaguaucacaagcaccggcacagguacucuuuccgcucauaacaaggacgggucuuugcacauuguucugccaucggaaaauggaaccaaagaucagugucagaucuuacauuucacggugccugaggucgaggaagaguuuauguacagcugcgacggcgaugaacgaccccuccuggugaaggguacccuuauagcaaucgacccauucgaugaccggcgugaggccggcggggagucaacaguugugaacccgaaauccggaaguuggaacuuuuucgauugguucucuggccugaugagcugguuugggggaccuuugaagacuauucuccugaucugucuauacgucgcgcuguccauuggccucuucuuucugcuuaucuauuuggguagaaccgggcugucaaagaugugguuagcugccacaaagaaggcaucuuga

SEQ ID NO: 11197 - RNA, 3480 nt, Artificial Sequence
  derived and/or modified CDS sequence (opt3) from RVFV(2008/00101)__HE687306.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcauguucuucguucgaugugcuucuggaaaaaggcaaguuuccauuguuccagucauaugcccaccauaggacccuccuggaggcuguccacgacacaaucauugccaaagcagaucccccuagcugcgaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagauaucgguguccauauggcccacgacgaucaaucagugaguagcaagauuguugcucauugucccccacaggaccccugcuuggugcacggcugcaucguaugugcccacgggcuaauaaacuaccagugccauacagcacuguccgcguucgucgugauuuucguguuuucuucgaccgcuaucaucugucucgccguucuguaucguguccuuaaaugccugaagauugcaccucgcaaaguguugaauccacucauguggaucacggccuucauuagauggguauacaagaaaaugguggcuaggguugccgacaacauaaaccaggucaaucgggaaaucggauggauggagggcggucaacuggcauuagggaacccggcucccauuccucgacacgccccaaucccccgcuacagcaccuaucugaugcuacuccugaucguguccuacgcgucagccuguagugagcuuauucaggcuucuagcagaauaacaacuugcuccaccgaaggcgugaauacaaaguguagguugucaggaacugcacugauccgggccggcagcgucggggcugaggccugccucaugcugaagggaguuaaagaagaucagaccaaguuucuuaaaauuaagacagugucuuccgagcugaguugucgcgagggucagagcuauuggaccggcucuuucuccccuaaaugcuugucaaguagaaggugccaucucgugggggaaugucacguaaaccguugccugagcuggcgggacaaugagacuucggcagaauuuuccuucgucggagagucuacgacaaugcgagaaaacaaguguuuugagcaaugcggcgguuggggguguggcugcuucaaugugaacccaagcuguuuauuuguucacaccuaccugcagucagugagaaaggaggcgcuaagggucuucaauugcaucgauugggugcauaaacucacucuggaaauuaccgacuuugauggaaguguuuccacaaucgaccuuggcgccucuagcucccgcuucaccaacugggggucagugagcuugagucuggaugcugagggaauaucuggcuccaauagcuuuucguucaucgaaucacccgguaagggguaugccauuguagacgagccguucucugaaaucccucggcagggauuucucggcgagauuagauguaacagugaguccagcguccugucugcacacgaaagcugcuuaagggcuccaaaucugguguccuacaaacccaugaucgaucagcuugaguguacuacaaacuugauagacccuuucguggucuuugaacgcgguucacucccccaaacgcgaaaugauaagaccuucgccgcaaguaaaggcaaccgugggguucaggccuuuagcaagggaucugugcaggcugaccugacucuaauguucgauaacuuugagguagacuucgugggcgcggccgucuccugcgacgcagcuuuucugaaucucacagggugcuauucauguaacgccggagcccgggugugccugaguauuaccagcacaggcacugguacccuuuccgcucauaauaaggaugggucuuugcacaucguucugccaucggaaaacggaacgaaagaccaaugucagauuuuacauuucaccgugccugaggucgaggaagaguuuauguacagcugcgauggcgacgaaagaccccuccuggugaaggguacacuuaucgcaauagauccauucgacgauaggcgcgaggccggcggggagucaacuguugugaauccgaaauccggaaguuggaacuuuuucgacugguucucuggccugaugagcugguuugggggaccuuugaagaccacacuccugaucugucuauacgucgcgcuguccauuggccucuucuuucugcuuaucuauuugggucggacugggcugucaaaaaugugguuagcugccaccaagaaggcaucuuga

SEQ ID NO: 11198 - RNA, 3480 nt, Artificial Sequence
  derived and/or modified CDS sequence (opt3) from RVFV(200803162)__JF311377.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaccuccgcaauagacccgguaaagggcauaacuauauugauggaaugacccaggaggacgccacauguaagccuguuacuuacgcgggcgcauguucuucguucgaugugcuucuggaaaaaggcaaguuuccauuguuccagucauaugcccaccauaggacccuccuggaggcuguccacgacacaaucauugccaaagcagaucccccuagcugcgaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccccugugugugggcuacgagcgaguuguggucaagagagaacucucagccaaaccgauucagaggguggagccuugcacaaccuguaucgcuaagugcgaaccccacggucuuguaguucggaguacgggguuuaagaucagcuccgccguggcaugugccucuggcgucugcgugacuggaagccagucaccaaguacagagauuacccugaaauauccuggcauaucccagagcucugggggagauaucgguguccauauggcucacgacgaucaaucagugaguagcaagauuguugcccauugucccccacaggaccccugcuuggugcacgacugcaucguaugugcacacggccuaauaaacuaccagugccauacugcgcuguccgcuuucgucgugauuuucguguuuucuucgacagccaucaucugucucgcaguucuguaucguguccuuaaaugccugaagauugccccucgcaaaguguugaauccacucauguggaucaccgcuuucauuagauggguauacaagaaaaugguggccaggguugcagauaacauaaaccaggucaaucgggaaaucggguggauggagggaggccaacuggcuuuacgaaacccggcccccauuccucgccacgcgccaauccccagauacagcacguaucugaugcuacuccugaucguguccuacgccucagcuuguagugagcuuauucaggcaucuagcaggauaaccacaugcuccacugaaggugugaauaccaagugucgguugucagggacagcccugauccgcgcuggcagcgucggagccgaggcaugccucaugcugaagggcguuaaagaagaccagacuaaguuucuuaaaauuaagaccgugucuuccgagcugaguuguagagaggggcagagcuauuggacaggaucuuucuccccuaaaugcuugucaaguaggcguugccaucucgugggugaaugucacguaaaccggugccugagcuggcgagauaaugagaccucggcggaauuuuccuucgucggcgagucuacuacgaugagagaaaacaaguguuuugagcaaugcgggggauggggcugugguugcuucaaugugaacccaagcuguuuauuuguucacacauaccugcagucagugaggaaggaggcccuacgcgucuucaauugcaucgacugggugcauaaacucacccuggaaauuacugauuuugacgggaguguuuccaccaucgaucuuggcgcuucuagcucccgguucacaaacuggggaucagugagcuugagucuggacgccgagggcauaucuggguccaauagcuuuucguucaucgaaucacccggaaagggcuaugcaauuguagaugagccguucucugaaaucccuagacaggguuuucucggggagauuagguguaacagugaguccagcguccugucugcucacgaaagcugcuuacgcgccccaaaucugguguccuacaaacccaugaucgaccagcuugaguguaccacuaacuugauagauccuuucguggucuuugaacgaggaucacucccccaaacacggaaugacaagacguucgcagccaguaaaggcaaccgugguguucaggcuuuuagcaagggcucugugcaggcggaucugacccuaauguucgacaacuuugagguagacuucgugggggccgcagucuccugcgaugcugccuuucugaaucucacuggaugcuauucauguaacgccggcgcuagagugugccugaguauuacaagcaccgggacaggaacucuuuccgcacauaauaaggacggcucuuugcacaucguucugccaucggaaaacgguaccaaagaucaaugucagauuuuacauuucacggugccugaggucgaggaagaguuuauguacagcugcgacggggaugaaaggccccuccuggugaagggaacccuuaucgccauagacccauucgaugaccgccgggaggcgggcggugagucaacaguugugaauccgaaauccggcaguuggaacuuuuucgauugguucucugggcugaugagcugguuuggaggcccuuugaagacuauccuccugauuugucuauacgucgcucuguccaucgggcuguucuuucugcuuauuuauuugggaagaaccggccugucaaaaaugugguuagccgcaacaaagaaggccucuuga

SEQ ID NO: 11199 - RNA, 3480 nt, Artificial Sequence
  derived and/or modified CDS sequence (opt3) from RVFV(2007002060)__EU574039.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaaaggaugcuaaacaaauaggaagggaaacuauggccggcaucgcaaugacgguacugcccgcccuagcuguguucgcacucgccccugucguguuugcugaggacccacaucugcggaaucgccccgguaaggggcacaacuauauugauggaaugacccaggaggacgccacauguaaaccuguuacuuacgcgggcgcauguucuucguucgaugugcuucuggaaaagggcaaauuuccauuguuccagucauaugcccaccauagaacccuccuggaggcuguccacgacacaaucauugccaaggcagaucccccuagcugcgaccugcagagugcucacgggaauccaugcaugaaggaaaaacucgugaugaagacccauuguccgaacgauuaccaauccgcccacuauuuaaauaacgacggaaaaauggcgucuguaaagugucccccuaaauacgagcugacugaagauugcaauuuuugcaggcagaugacaggugccagccuuaagaaaggcuccuauccauugcaggaccuguucugucagucaagugaggacgaugggagcaagcuaaagaccaaaaugaagggaguuugcgaggugggcguccaagcacucaaaaagugcgacggucagcugucuacggcucaugaaguggugcccuuugccgucuucaaaaacuccaagaagguuuaccuugauaaacuggacuugaagacugaggaaaaucuccugccugauucauuuguguguuucgagcacaaagggcaguacaagggaaccauggacagcggccagacaaaacgggaauuaaagaguuuugauaucucucaaugcccaaagauaggcgggcacggauccaaaaaguguacuggugacgcugccuucugcagcgcauaugaguguaccgcccaguacgcuaacgcguauugcucgcaugcaaauggcucugggauuguacagauccaaguguccggagucuggaaaaagccccugugugugggcuacgagcgcguuguggucaaacgagaacucucagccaagccgauucagagaguggagccuugcacaaccuguaucacgaagugcgaaccccacggucuuguaguuaggaguacuggguuuaaaaucagcuccgcuguggccugugcaucuggcgucugcgugacaggaagccagucaccaaguaccgagauuacucugaaguauccuggcauaucccagagcucugggggagauaucgguguccauauggcccacgacgaucaaucagugaguagcaaaauuguugcucauugucccccacaggaccccugcuuggugcacggcugcaucguaugugcccacgggcuaauaaacuaccagugccauacagcacuguccgcguucgucgugauuuucguguuuucuucgaccgcuaucaucugucucgccguucuguaucggguccuuaagugccugaaaauugcaccucguaagguguugaauccacucauguggaucacggccuucauucgcuggguauacaaaaagaugguggcuagaguugccgacaacauaaaccaggucaauagggaaaucggauggauggagggcggucaacuggcauuagggaacccggcucccauuccucggcacgccccaaucccccgauacagcaccuaucugaugcuacuccugaucguguccuacgcgucagccuguagugagcuuauucaggcuucuagccgcauaacaacuugcuccaccgaaggcgugaauacaaaguguagauugucaggaacugcacugaucagggccggcagcgucggggcugaggccugccucaugcugaaaggaguuaaggaagaucagaccaaauuucuuaagauuaaaacagugucuuccgagcugaguugucgggagggucagagcuauuggaccggcucuuucuccccuaagugcuugucaagucgcagaugccaucucgugggggaaugucacguaaacaggugccugagcuggcgugacaaugagacuucggcagaauuuuccuucgucggagagucuacgacaaugcgggaaaacaaguguuuugagcaaugcggcgguuggggguguggcugcuucaaugugaacccaagcuguuuauuuguucacaccuaccugcagucagugcgaaaagaggcgcuaagagucuucaauugcaucgauugggugcauaagcucacucuggaaauuaccgacuuugauggaaguguuuccacaaucgaccuuggcgccucuagcuccagguucaccaacugggggucagugagcuugagucuggaugcugagggaauaucuggcuccaauagcuuuucguucaucgaaucacccgguaaaggguaugccauuguagacgagccguucucugaaaucccucgccagggauuucucggcgagauucgguguaacagugaguccagcguccugucugcacacgaaagcugcuuaagagcuccaaaucugguguccuacaagcccaugaucgaucagcuugaguguacuacaaacuugauagacccuuucguggucuuugaaagggguucacucccccaaacgcgcaaugauaaaaccuucgccgcaaguaagggcaaccgagggguucaggccuuuagcaagggaucugugcaggcugaccugacucuaauguucgauaacuuugagguagacuucgugggcgcggccgucuccugcgacgcagcuuuucugaaucucacagggugcuauucauguaacgccggagcccgggugugccugaguauuaccagcacaggcacugguacccuuuccgcucauaauaaagaugggucuuugcacaucguucugccaucggaaaacggaacgaaggaccaaugucagauuuuacauuucaccgugccugaggucgaggaagaguuuauguacagcugcgauggcgacgaacguccccuccuggugaaagguacacuuaucgcaauagauccauucgacgauagaagggaggccggcggggagucaacuguugugaauccgaaguccggaaguuggaacuuuuucgacugguucucuggccugaugagcugguuugggggaccuuugaaaaccauccuccugauuugucuauacgucgcgcuguccaucggccucuucuuucugcuuauuuauuugggucgcacagggcugucaaagaugugguuagcugccacuaagaaagcaucuuga

SEQ ID NO: 11200 - RNA, 3480 nt, Artificial Sequence
  derived and/or modified CDS sequence (opt3) from RVFV(2007002476)__EU574036.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcauguucuucguucgaugugcuucuggaaaaaggcaaguuuccauuguuccagucauaugcccaccauaggacccuccuggaggcuguccacgacacaaucauugccaaagcagaucccccuagcugcgaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagauaucgguguccauauggcccacgacgaucaaucagugaguagcaagauuguugcucauugucccccacaggaccccugcuuggugcacggcugcaucguaugugcccacgggcuaauaaacuaccagugccauacagcacuguccgcguucgucgugauuuucguguuuucuucgaccgcuaucaucugucucgccguucuguaucguguccuuaaaugccugaagauugcaccucgcaaaguguugaauccacucauguggaucacggccuucauuaaguggguauacaaaaagaugguggcuagaguugccgacaacauaaaccaggucaauagggaaaucggauggauggagggcggucaacuggcauuagggaacccggcucccauuccucggcacgccccaaucccccgauacagcaccuaucugaugcuacuccugaucguguccuacgcgucagccuguagugagcuuauucaggcuucuagccgcauaacaacuugcuccaccgaaggcgugaauacaaaguguagauugucaggaacugcacugaucagggccggcagcgucggggcugaggccugccucaugcugaaaggaguuaaggaagaucagaccaaauuucuuaagauuaaaacagugucuuccgagcugaguugucgggagggucagagcuauuggaccggcucuuucuccccuaagugcuugucaagucgcagaugccaucucgugggggaaugucacguaaacaggugccugagcuggcgugacaaugagacuucggcagaauuuuccuucgucggagagucuacgacaaugcgggaaaacaaguguuuugagcaaugcggcgguuggggguguggcugcuucaaugugaacccaagcuguuuauuuguucacaccuaccugcagucagugcgaaaagaggcgcuaagagucuucaauugcaucgauugggugcauaagcucacucuggaaauuaccgacuuugauggaaguguuuccacaaucgaccuuggcgccucuagcuccagguucaccaacugggggucagugagcuugagucuggaugcugagggaauaucuggcuccaauagcuuuucguucaucgaaucacccgguaaaggguaugccauuguagacgagccguucucugaaaucccucgccagggauuucucggcgagauucgguguaacagugaguccagcguccugucugcacacgaaagcugcuuaagagcuccaaaucugguguccuacaagcccaugaucgaucagcuugaguguacuacaaacuugauagacccuuucguggucuuugaaagggguucacucccccaaacgcgcaaugauaaaaccuucgccgcaaguaagggcaaccgagggguucaggccuuuagcaagggaucugugcaggcugaccugacucuaauguucgauaacuuugagguagacuucgugggcgcggccgucuccugcgacgcagcuuuucugaaucucacagggugcuauucauguaacgccggagcccgggugugccugaguauuaccagcacaggcacugguacccuuuccgcucauaauaaagaugggucuuugcacaucguucugccaucggaaaacggaacgaaggaccaaugucagauuuuacauuucaccgugccugaggucgaggaagaguuuauguacagcugcgauggcgacgaacguccccuccuggugaaagguacacuuaucgcaauagauccauucgacgauagaagggaggccggcggggagucaacuguugugaauccgaaguccggaaguuggaacuuuuucgacugguucucuggccugaugagcugguuugggggaccuuugaaaaccauccuccugauuugucuauacgucgcgcuguccaucggccucuucuuucugcuuauuuauuugggucgcacagggcugucaaagaugugguuagcugccacuaagaaagcaucuuga

SEQ ID NO: 11201 - RNA, 3480 nt, Artificial Sequence
  derived and/or modified CDS sequence (opt3) from RVFV(2269/74)__DQ380222.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaaaaaggucuaccuugacaagcuggauuugaaaacugaggaaaaccuccugccugacucauuuguuuguuucgagcacaaggggcagcacaaaggaaccauggauagcggccagacaaagcgcgaauuaaaaaguuuugacauaucucaaugcccaaagauuggcgggcauggauccaagaaauguacuggugaugcugccuucugcagcgcauacgaguguaccgcccaguaugcuaaugcguacugcucgcacgcaaacggcucugggaucgugcagauucaaguauccggaguguggaagaaaccccugugugucggcuaugagcgagugguugugaagagagaacucucagccaaaccgauccagagggucgagccuugcacaaccuguaucacgaagugcgaaccccauggucuugugguacggaguacuggguuuaagauuagcuccgcuguugccugugcaucuggcgugugcgucacaggaagccagucaccaaguaccgagauaacucugaaauacccuggcaucucccagagcucugggggagacauuggugugcacauggcccaugaugaccaaucagucaguagcaagaucguggcucacugucccccacaggaccccugcuugguucacggcugcauagugugugcccaugggcuaauuaauuaucagugccacacagcacuguccgcguucguagucguguucguguuuucuucgguugcuaucaucugucucgccauucuguacaaaguccuuaagugccugaaaaucgcaccuaagaaaguguugaacccacucauguggauuaccgccuucauacguuggguauauaagaagaugguggcucgcguugccgauaauaucaaccaggucaacagagaaauuggauggauggagggcggucaacuggcauuagggaauccggcucccaucccuaggcaugccccaaucccccgguacagcacguaccugaugcuacuccugauuguguccuaugcgucagccuguagugagcuuauacaggcuucuagccgaaucaccacaugcuccacugaaggcgugaacaccaaaugucgcuugucaggaacagcacugauuagagccggcagcgucggggcugaggccugccucaugcugaagggaguuaaagaagaccagacuaaguuucuuaaaaucaagaccgugucuuccgagcugaguuguagggagggucagagcuacuggacaggcucuuucuccccuaagugcuugucaagucggcgcugccaccucgugggggaaugucacguaaauagaugccugagcuggagggauaacgagaccucggcagaauuuuccuucgucggagagucuacuacgaugcgugaaaauaaauguuuugagcaaugcggcgguuggggguguggcugcuucaacgugaauccaagcuguuuauuuguucauacauaucugcagucagugcggaaggaggcgcuacgagucuucaacugcauugacugggugcacaaacucacccuggaaaucacugauuuugacggaaguguuuccaccauagaucuuggcgccucuagcuccagauucacaaauugggggucagugagcuugagucuggacgcugagggaaucucuggcuccaacagcuuuucguucauugaaucacccgguaagggguacgccaucguagaugagccguucucugaaauuccuaggcagggauuucucggcgagauccgcuguaauagugaguccagcguccugucugcacaugaaagcugcuuacgggcuccaaaccugauauccuauaaacccaugauugaccagcuugaguguaccacuaauuugaucgauccuuucgugguguuugaaagagguucacucccccaaacaaggaacgacaagacguucgccgcaaguaagggcaaucgcgggguccaggccuuuagcaaaggaucuguucaggcugaucugacccuaauguucgacaacuuugagguggacuucguaggcgcggccguguccugcgaugcagcuuuucugaaccucacugggugcuacucauguaaugccggagcccgagucugccugaguauuacaagcaccggcacagguacucuuuccgcucacaacaaggacgggucuuugcauaucgugcugccaucggaaaauggaaccaaagaucaaugucagauauuacacuucacgguuccugagguggaggaagaguuuauguauagcugcgacggcgaugaacggccccuccuggucaaggguacccuuaucgcaauugacccauucgaugaccguagagaggccggcggggagucaacagugguuaacccgaaauccggaaguuggaacuuuuucgauugguucucuggccugaugagcugguuugggggaccuuugaagacuauccuccugauuugucuauacguggcgcuguccaucggccucuucuuucugcuuauauacuuggguaggaccgggcugucaaagaugugguuagcugccacaaagaaggcaucuuga

SEQ ID NO: 11202 - RNA, 3480 nt, Artificial Sequence
  derived and/or modified CDS sequence (opt3) from RVFV(73HB1449)__DQ380211.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaacaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaagaaggucuaccuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcacggauccaagaaauguacuggugaugcugccuucugcagcgcauaugaguguaccgcccaguacgcuaaugcguauugcucgcaugcaaacggcucugggaucgugcagauucaaguauccggaguguggaagaaaccccugugugucggcuacgagcgagugguugugaagagagaacucucagccaaaccgauccagagggucgagccuugcacaaccuguaucacgaagugcgaaccccacggucuugugguacggaguacuggguuuaagauuagcuccgcuguugccugugcaucuggcgugugcgucacaggaagccagaauccaucaaccgagauaacucugaaauauccuggcaucagucaguccagcgggggagacauuggugugcauauggcccacgaugaccaaucugucucaaguaagaucguggcucauugucccccacaggaccccugcuugguucacggcugcauagugugugcccacgggcuaauuaacuaccagugccauacagcacugagcgcguucguagucguguucguguuuuccucuaucgcuaucauuugucucgccauccuguaucguguucuuaaaugccugaagauugcaccucgcaaagucuugaauccacucauguggauaaccgccuucaucagauggguguacaagaaaaugguagcuaggguggccgauaacauuaaccagguuaaucgggaaaucggauggauggagggcggucaacuggucuuagggaacccggcacccaucccucgacacgcuccaauuccccgcuacucgacguaucugaugcuacuccugauagugagcuacgccuccgcguguucagagcuuauccaggccaguucuagaauuaccacaugcagcacugaaggcgugaauaccaaguguagguuguccggaacagcucugauccgggcaggcucagucggggccgaggcuugccucaugcugaagggaguuaaagacgaucagacuaaguuucuuaaaauuaagaccgugagcucugaacuguccugucgcgagggucagaguuauuggacaggcagcuucucuccuaaaugcuuguccucaagaaggugccaucucgugggggagugucacguaaaccguugccugaguuggcgggacaaugaaaccagcgccgaguuuucguucgucggagaauccacuacgaugcgagagaacaaguguuuugaacaaugcggcgguuggggguguggcugcuucaaugugaacccaucuuguuuauuuguucacacauaccugcagagcgugagaaaggaggcacuaagggucuucaauugcaucgauugggugcauaaacucacccuggagauaacugacuuugauggaucaguuaguaccaucgaccuuggcgcguccucuagccgcuucacaaacuggggguccgugucauugagccuggaugccgaaggaauuaguggcucuaauuccuuuagcuucaucgagucgcccgguaagggguaugcuauuguagacgaaccguucucagagaucccucggcagggauuucucggcgaaauaagauguaacucugagaguuccguccugagcgcccacgagucuugcuuaagggcaccaaaucugauuagcuacaaacccaugaucgaucagcuugaauguaccacuaacuugauugacccuuucgugguguuugagcgcgguucccucccccaaacacgaaaugaaaagacguucgcugccucaaaaggcaaccgugggguccaggcauuuaguaagggaagcguucaggccgaucugacccuaauguucgacaacuuugagguggacuucguaggcgcugcggugucuugcgaugccgcauuucugaaucucacugggugcuauuccuguaacgcuggagcccgggucugccugucaaucacaaguaccggcacagguacucuuagcgcccauaauaaggacggguccuugcacauagugcugccaucugaaaacggaaccaaagaucaaugucagaucuuacauuucacgguuccugagguggaggaagaguuuauguacucgugcgacggcgaugaaagaccccuccuggucaaggguacccuuauugcuaucgacccauucgaugacaggcgcgaggcaggcggggagagcacagugguuaauccgaaaucaggauccuggaacuuuuucgauugguucaguggccugaugucuugguuugggggaccuuugaagacuauucuccugaucugucuauacguggcccugagcauaggccucuucuuucugcuuauuuauuugggucggaccgggcuguccaaaaugugguuagcggcuacaaagaaggccucauga

SEQ ID NO: 11203 - RNA, 3480 nt, Artificial Sequence
  derived and/or modified CDS sequence (opt3) from RVFV(SA-51 (Van Wyck))__DQ380195.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaagaaggucuaccuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcgaggauccaagaaauguacuggugaugcugccuucugcagcgcauaugaguguaccgcccaguacgcuaaugcguauugcucgcacgcaaacggcucugggaucgugcagauucaaguauccggaguguggaagaaaccccugugugucggcuacgagagagugguugugaagagggaacucucagccaaaccgauccagcgggucgagccuugcacaaccuguaucacgaagugcgaaccccauggucuugugguacguaguacuggguuuaagauuagcuccgcuguugccugugcaucuggcgugugcgucacaggaagccagucaccaaguaccgagauaacucugaaauauccuggcaucucccagagcucugggggagacauuggugugcacauggcccaugaugaccaaucagucaguagcaagaucguggcucacugucccccacaggaccccugcuugguucauggcugcauagugugugcccacgggcuaauuaauuaccagugccacacagcacuguccgcguucguagucguguucguauuuucuucgguggcuaucaucugucucgccauucuguauaaaguccuuaagugccugaaaaucgcaccucgcaagguguugaacccacucauguggauuaccgccuucauaagauggguauacaaaaagaugguggcuaggguugccgauaauaucaaccaggucaaccgggaaauuggauggauggagggcggucaacuggcauuagggaauccggcucccaucccucgacaugccccaaucccccgcuacagcacguaucugaugcuacuccugauuguguccuacgcgucagccuguagugagcuuauacaggcuucuagcagaaucaccacaugcuccacugaaggcgugaacaccaaguguagguugucaggaacagcacugauucgggccggcagcgucggggcugaggccugccucaugcugaaaggaguuaaggaagaccagacuaaauuucuuaagaucaaaaccgugucuuccgagcugaguugucgcgagggucagagcuauuggacaggcucuuucuccccuaagugcuugucaaguagaaggugccaccucgugggggaaugucauguaaaucguugccugagcuggcgggauaacgagaccucggcagaauuuuccuucgucggagagucuacuacgaugcgagaaaauaaguguuuugagcaaugcggcgguuggggguguggcugcuucaacgugaauccaagcuguuuauuuguucacacauaccugcagucagugagaaaagaggcgcuaagggucuucaacugcauugacugggugcacaagcucacccuggaaguuacugauuuugacggaaguguguccaccaucgaucuuggcgccucuagcucccgcuucacaaauugggggucaguuagcuugagucuggacgcugagggaauaucuggcuccaacagcuuuucguucaucgaaucacccgguaaaggguaugccauugucgaugagccguucucugaaaucccucggcagggauuucucggcgagauuagauguaauagugaguccagcgugcugucugcacaugaaagcugcuuaagggcuccaaaccugaucuccuacaagcccaugauagaccagcuugaguguaccacuaauuugauugauccuuucguggucuuugaacgcgguucacucccccaaacacgaaacgacaaaacguucgccgcaaguaagggcaaucgugggguucaggccuuuagcaagggaucugugcaggcugaucugacccuaauguucgacaacuuugagguagacuucgugggcgcggccgucuccugcgaugcagcuuuucugaaccucacugggugcuauucauguaaugccggagcccgggugugccugaguaucacaagcaccggcacagguacucuuuccgcucacaacaaagacgggucuuugcauauuguucugccaucggaaaauggaaccaaggaucaaugucagaucuuacacuucacggugccugaggucgaggaagaguuuauguacagcugcgacggcgaugaaagaccccuccuggugaaagguacccuuauagcaaucgacccauucgaugacaggcgcgaggccggcggggagucaacaguugugaacccgaaguccggaaguuggaacuuuuucgauugguucucuggccugaugagcugguuugggggaccuuugaaaacuauucuccugaucugucuauacgucgcgcuguccauuggccucuucuuucugcuuaucuauuugggucggaccgggcugucaaagaugugguuagcugccacaaagaaagcaucuuga

SEQ ID NO: 11204 - RNA, 3480 nt, Artificial Sequence
  derived and/or modified CDS sequence (opt3) from RVFV(KEN/Gar-Msq/131B-04/06)__HM586972.1__NSm-Gn-Gc
augaucgagggcgccugggacagcuucagagaagaggaaaugcccgaggaacuguccugcucugugucagggauuagggaggucaagaccaguagccaggagcucuaccgggcucuuaaagcaauaaucgccgcggauggacugaacaauauuacaugucacgguaagaacccugaagacaaaaucuccuugauuaagggcccaccgcauaaaaagcgcguugggaucgugcgaugcgagcguagaagggaugcuaagcaaauaggacgggaaacuauggccggcaucgcaaugacgguauuacccgcccuggcuguguuugcacuagccccugucguguucgcugaggacccacaccuccgcaauagacccgguaaagggcauaacuauauugauggaaugacccaggaggacgccacauguaagccuguuacuuacgcgggcgcauguucuucguuugaugugcugcuugaaaaaggcaaguucccacuguuucagucauaugcccaccauaggaccuugcucgaggcuguccacgacacaaucauugccaaagcagaucccccuagcugcgaccugcagagugcucacgggaauccaugcaugaaggaaaagcuggugaugaaaacccauuguccgaacgauuaccaauccgcccacuaucucaauaacgacggaaagauggcgucuguaaaaugucccccuaaguacgaguuaacugaagauugcaauuucugccggcagaugacaggugccagccugaaaaagggcuccuauccacuucaggacuuguuuugucagucaagugaggacgaugggagcaaacugaagaccaagaugaaaggaguuugcgaggugggcguccaagcacuaaagaaaugcgacggucagcucucuacggcucaugaaguggugcccuucgccgucuuuaagaacuccaaaaagguuuaccuggauaaacuugaccugaagacugaggaaaauuugcucccugauucauucguguguuuugagcacaaggggcaguacaaaggaaccauggacagcggccagacaaagcgcgaacugaaaaguuucgauaucucucaaugcccaaagauaggcgggcacggauccaagaaauguacuggugacgcugccuuuugcagcgcauaugaguguaccgcccaguacgcuaacgcguauugcucgcaugcaaauggcucugggauuguacagauccaaguguccggagucuggaagaaacccuuaugugugggcuacgagcgaguuguggucaagagagaacugucagccaaaccgauucagaggguggagccuugcacaaccuguaucacgaagugcgaaccccacggucucguaguucggaguacuggguucaagaucagcuccgcuguggccugugcaucuggcgucugcgugacaggaagccagucaccaaguaccgagauuacucuuaaauauccuggcauaucccagagcucugggggagauaucgguguccauauggcccacgacgaucaaucagugaguagcaagauuguugcucauugucccccacaggaccccugccuggugcacggcugcaucguaugugcccacggguugauaaacuaccagugccauacagcacuauccgcguucgucgugauuuuuguuuucucuucgaccgcuaucaucugucuggccgugcucuaucguguccugaaaugccuuaagauugcaccucgcaaagugcugaauccauugauguggaucacggccuuuauuagauggguauacaagaaaaugguggcuaggguugccgacaacauaaaccaggucaaucgggaaaucggauggauggagggcggucaacucgcacuggggaacccggcucccauuccucgacacgccccaaucccccgcuacagcaccuauuuaaugcugcuacucaucguguccuacgcgucagccuguagugagcugauucaggcuucuagcagaauaacaacuugcuccaccgaaggcgugaauacaaaguguaggcuuucaggaacugcauugauccgggccggcagcgucggggcugaggccugccugaugcucaagggaguuaaagaagaucagaccaaguuccugaaaauuaagacagugucuuccgagcuuaguugucgcgagggucagagcuauuggaccggcucuuuuuccccuaaaugccugucaaguagaaggugccauuuggugggggaaugucacguaaaccguugccucagcuggcgggacaaugagacuucggcagaguucuccuuugucggagaaucuacgacaaugcgagaaaacaaguguuucgagcaaugcggcgguuggggguguggcugcuuuaaugugaacccaagcugucuguucguucacaccuacuuacagucagugagaaaggaggcgcugagggucuuuaauugcaucgauugggugcauaaacuaacucucgaaauuaccgacuucgauggaaguguuuccacaaucgaccugggcgccucuagcucccgcuuuaccaacugggggucagugagccuuaguuuggaugcugagggaauaucuggcuccaauagcuucucguucaucgaaucacccgguaagggguaugccauuguagacgagccguuuucugaaaucccucggcagggauuccugggcgagauuagauguaacagugaguccagcguccucucugcacacgaaagcugccugagggcuccaaauuuaguguccuacaaacccaugaucgaucagcuggaguguacuacaaaccuuauagacccuuuuguggucuucgaacgcgguucauugccccaaacgcgaaaugauaagaccuuugccgcaaguaaaggcaaccgugggguucaggccuucagcaagggaucugugcaggcugaccucacucugauguuugauaacuucgagguagacuuugugggcgcggccgucuccugcgacgcagcuuuccuaaaucugacagggugcuauucauguaacgccggagcccgggugugccucaguauuaccagcacaggcacugguacccuguccgcucauaauaaggaugggucucuucacaucguuuugccaucggaaaacggaacgaaagaccaaugucagauucugcauuuuaccgugccugaggucgaggaagaguucauguacagcugcgauggcgacgaaagacccuuacucgugaaggguacacugaucgcaauagauccauuugacgauaggcgcgaggccggcggggagucaacuguugugaauccgaaauccggaaguuggaacuucuucgacugguuuucuggccuuaugagcugguucgggggaccucugaagaccaucuugcucauuugucuguacgucgcgcuauccaucggccuguuuuuccuccugauuuaucuuggucggacaggguugucaaaaauguggcuggcugccacuaagaaggcaucuuga

SEQ ID NO: 11205 - RNA, 3480 nt, Artificial Sequence
  derived and/or modified CDS sequence (opt3) from RVFV(2007001107)__EU574047.1__NSm-Gn-Gc
augaucgagggcgccugggacagccugagagaagaggaaaugcccgaggaacucuccugcucugugucagggauuagggaggucaagaccaguaaucaggagcuuuaccgggcucugaaagcaauaaucgccgcggauggauugaauaacauuacaugucacgguaagaauccugaagacaaaaucagcuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaacagacccgguaaagggcacaauuauauugauggaaugacccaggaggacgccacauguaagccuguuacuuacgcgggcgcaugcuccucuuucgaugugcuucuggaaaaaggcaaguuuccauuguuccagucguaugcccaccauaggacccuccuggaggcuguccacgacacaaucauugccaaagcagaucccccuucaugugaccugcagagcgcucacgggaacccaugcaugaaggaaaagcucgugaugaaaacccauuguccgaaugauuaccaaagugcccacuauuuaaacaaugacggaaagauggcguccguaaaaugucccccuaaguacgagcugacugaagauugcaacuuuugccggcagaugacaggugccucucuuaaaaagggcagcuauccauugcaggaccuguucugucaguccucagaggacgaugggaguaaacuaaagaccaagaugaaaggaguuugcgaggugggcguccaagcacucaagaaaugcgacggucagcugagcacggcucaugaaguggugcccuuugccgucuucaaaaauucuaaaaagguuuaccuugauaagcuggacuugaaaacugaggaaaaccuccugccugauuccuuuguguguuucgagcacaaggggcaguacaaaggaaccauggacucaggccagacaaagcgcgaauuaaagagcuuugauaucagucaaugcccaaagauaggcgggcacggaucuaagaaauguacuggugacgcugccuucugcuccgcauaugaguguaccgcccaguacgcuaaugcguauugcagccaugcaaacggcucggggauuguacagauccaagugucuggagucuggaagaaaccccugugugugggcuacgagcgaguuguggucaagagagaacucuccgccaaaccgauucagaggguggagccuugcacaaccuguaucacgaagugcgaaccccacggucuuguaguucggucaacuggguuuaagaucaguagcgcuguggccugugcauccggcgucugcgugacaggaucucagagcccaucaaccgagauuacucugaaauauccuggcauaagucaguccagcgggggagauaucgguguccauauggcccacgacgaucaaucugugucaaguaagauuguugcucauugucccccacaggaccccugcuuggugcacggcugcaucguaugugcccacgggcuaauaaauuaccagugccauacagcacugagcgcguucgucgugauuuucguguuuuccucuaccgcuaucaucugucucgccguucuguaucguguccuuaaaugccugaagauugcaccucgcaaaguguugaacccacucauguggaucacggccuucauuagauggguauacaagaaaaugguggcuaggguugccgacaacauaaaucaggucaaccgggaaaucggauggauggagggcggucaacuggcauuagggaauccggcucccauuccucgacacgccccaaucccccgcuacucgaccuaucugaugcuacuccugaucgugagcuacgcguccgccuguucagagcuuauucaggcuaguucuagaauaacaacuugcagcaccgaaggcgugaacacaaaguguagguuguccggaacugcacugauccgggccggcucagucggggcugaggccugccucaugcugaagggaguuaaagaagaucagaccaaguuucuuaaaauuaagacagugagcucugagcuguccugucgcgagggucagaguuauuggaccggcagcuucucuccuaaaugcuuguccucaagaaggugccaucucgugggggaaugucacguaaaucguugccugaguuggcgggacaacgagacuagcgcagaauuuucguucgucggagaguccacgacaaugcgagaaaauaaguguuuugagcaaugcggcgguuggggguguggcugcuucaacgugaauccaucuuguuuauuuguucacaccuaccugcagagcgugagaaaggaggcgcuaagggucuucaacugcaucgauugggugcauaaacucacucuggaaauuaccgacuuugauggaucaguuaguacaaucgaccuuggcgccuccucuagccgcuucaccaauuggggguccgugucauugagccuggaugcugagggaauaaguggcucuaacuccuuuagcuucaucgaaucgcccgguaagggguaugccauuguagacgagccguucucagaaaucccucggcagggauuucucggcgagauuagauguaauucugagaguuccguccugagcgcacacgaaucuugcuuaagggcuccaaaccuggugagcuacaaacccaugaucgaucagcuugaguguacuacaaauuugauagacccuuucguggucuuugaacgcgguucccucccccaaacgcgaaacgauaagaccuucgccgcaucaaaaggcaaccgugggguucaggccuuuaguaagggaagcgugcaggcugaccugacucuaauguucgauaauuuugagguagacuucgugggcgcggccgucucuugcgacgcagcuuuucugaaccucacagggugcuauuccuguaaugccggagcccgggugugccugucaauuaccaguacaggcacugguacccuuagcgcucauaacaaggauggguccuugcacaucguucugccaucugaaaauggaacgaaagaccaaugucagauuuuacauuucaccgugccugaggucgaggaagaguuuauguacucgugcgauggcgacgaaagaccccuccuggugaaggguacacuuaucgcaauagauccauucgacgauaggcgcgaggccggcggggagagcacuguugugaacccgaaaucaggauccuggaacuuuuucgacugguucaguggccugaugucuugguuugggggaccuuugaagaccauccuccugauuugucuauacgucgcgcugagcaucggccucuucuuucugcuuauuuauuugggucggacagggcuguccaaaaugugguuagcugccacuaagaaggcaucauga

SEQ ID NO: 11206 - RNA, 3480 nt, Artificial Sequence
  derived and/or modified CDS sequence (opt3) from RVFV(ANK-3837)__DQ380215.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaagaaggucuaccuugacaagcuggauuugaaaacugaggaaaaccuccugccugacucauuuguuuguuucgagcacaaggggcaguacaaaggaaaguuagauagcggccagaccaaacgcgaacugaagaguuuugacauaucucaaugcccaaagauuggcgggcacggauccaaaaaguguacaggugaugcugccuucugcagcgcauaugaguguacugcccaguacgcuaaugcguauugcucgcaugcaaacggcucugggaucgugcagauucaaguauccggaguguggaaaaagccccucugugucggcuacgagcgagugguugugaaaagagaacuuucagccaagccgauccagagggucgagccuugcaccacauguaucaccaagugcgaaccccacggucuggugguacggaguacgggguuuaaaauuagcuccgcuguugccugugcaucuggcgugugcgucacuggaagccagucaccaaguacagagauaaccuugaaguauccuggcaucucccagagcucugggggagacauuggugugcauauggcccacgaugaccaaucagucaguagcaaaaucguggcucauugucccccacaggaccccugccuaguucacggcugcauagugugugcccacgggcugauuaauuaccagugccauacugcacucuccgcguucguagucguguucguguuuucuucgaucgcuaucauuugucuggccauccuuuaucguguucugaagugcuugaaaauugcaccucgcaagguccucaacccacugauguggauaacagccuucaucagauggguguacaggaaaaugguagcucggguggccgauaauauuaaccagguuaaccgagaaaucggauggauggagggcggucaauuaguccuggggaauccggcacccaucccucgccacgugccaauucccagauacagcaccuaucuaaugcuccugcuuauaguguccuacgcuucagccuguagugaguugauccaggcgucuagcaggauuacgaccugcuccacagaaggcgucaacacuaagugucggcugucaggaaccgcccucauccgcgcuggcagcguuggggcagaggccugccugaugcuuaagggagugaaagaagaccagacaaaguuucugaaaauuaagacugugucuuccgaguugaguuguagagagggucagagcuauuggaccggcucuuucuccccuaaaugccucucaaguaggcguugccaucugguaggggaaugucacgucaaucggugcuuaagcuggcgagauaacgagacaucggcugaauuuuccuucgugggagagucuaccacuaugagagaaaauaaguguuuugagcaaugcggcgguuggggguguggcugcuucaacguuaauccaagcugucuguuugugcacacguaccuacagucagucaggaaggaggcccuccgcguguucaacugcaucgacuggguucauaaacugacacuugaaauaaccgauuuugacggaaguguguccacuaucgauuugggcgcaucuagcucccgguucaccaauugggggucaguaagccugagucucgacgcggagggaauuucuggcuccaacagcuuuucguucaucgaaucacccgguaagggguaugccauugucgaugagccguucucugaaaucccuagacagggauuucugggcgagauaagguguaauagugaguccagcguguuaucugcucacgaaagcugccugcgcgccccaaaccuuauuuccuacaaacccaugaucgaccaguuggaguguacaaccaaucucauugauccuuucguggucuuugaacgagguucacugccccaaacucggaacgacaagacauucgcagcuaguaaaggcaaucgugggguucaggccuuuagcaagggaucugugcaggcagaucuaacgcugauguucgacaacuuugagguagacuucgugggcgccgcugucuccugcgaugcggccuuucucaaccugaccgggugcuauucauguaaugcaggagcuagagugugccuuaguaucacuagcacaggcaccgguacauuguccgcccauaacaaggacgggucucugcacauaguuuuaccaucggaaaauggaacuaaagaucaaugucagauccuccauuucaccgugccugaggucgaggaagaguuuauguacagcugcgacggcgaugaaaggccccugcuugugcgcgguacgcugauugccaucgacccauucgaugaccggagagaggcuggcggggagucaaccguugugaacccgaaguccggaaguuggaacuuuuucgauugguucucuggcuugaugagcugguuugggggaccucucaaaacaauucugcuaaucugucuguacgucgcacucuccauaggccuguucuuucuuuugauuuaucuggguaggacuggguuaucaaagauguggcucgccgcgaccaaaaaggcuucuuga

SEQ ID NO: 11207 - RNA, 3480 nt, Artificial Sequence
  derived and/or modified CDS sequence (opt3) from RVFV(Lunyo)__KU167026.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaagaauagcaaaaaggucuaccuugacaagcuggauuugaaaacugaggaaaaccuccugccugacucauuuguuuguuucgagcacaaggggcaguacaaaggaaccauggugagcggccagacaaagcgcgaauuaaaaaguuuugauauaucucaaugcccaaagauuggcgggcacggauccaagaaauguacuggugacgcugccuucugcagcgcauaugaguguaccgcccaguacgcuaaugcguauugcucgcaugcaaacggcucugggaucguacagauucaaguguccggagucuggaagaaaccccugugugugggcuacgagcgaguuguggucaagagagaacucucagccaaaccgauccagaggguggagccuugcacaaccuguaucacgaagugcgaaccccacggucuuguaguucggaguacuggguuuaagauuagcuccgcuguggccugugcaucuggcgucugcgugacaggaagccagucaccaaguaccgagauaacucugaaauauccuggcaucucccagagcucugggggagauauugguguccauauggcccacgacgaucaaucagugaguagcaagaucguugcucauugucccccacaggaccccugcuuggugcacggcugcauaguaugugcccacgggcuaauuaauuaccagugccauacagcacuguccgcguucgucgugguuuucguguuuucuucggucgcuaucaucugucucgccauucuguauaaagugcuuaagugccugaaaaucgcaccucguaagguauugaacccacucauguggauuaccgccuucauacgcuggguguacaaaaagaugguugcuagagucgccgacaauaucaaccaggugaacagggaaauuggauggauggagggcggucaacuggcauuagggaauccggcucccaucccucggcacgccccaaucccccgauacagcacguaucugaugcuacuccugauuguguccuacgcgucagccuguagugagcuuauacaggcuucuagccgcaucaccacaugcuccacugaaggcgucaacaccagauguagguugucaggaacagcacugauucgggccggcagcguuggggcugaggccugccucaugcugaagggagugaaagaagaucagacuaaguuucuuaaaaucaagaccgugucuuccgagcugaguugucgcgagggucagagcuauuggacaggcucuuucuccccuaaaugcuugucaaguagaaggugccaucucguaggggaaugucacgucaaucguugccugagcuggcgggacaacgagaccucggcagaauuuuccuucgugggagagucuacuacgaugcgagaaaauaaguguuuugagcaaugcggcgguuggggguguggcugcuucaacguuaauccaagcuguuuauuugugcacacauaccugcagucagucagaaaggaggcgcuaaggguguucaacugcauugauuggguucauaaacucacccuggaaaucacugacuuugauggaaguguguccaccauagaccuuggcgccucuagcucccgcuucacaaauugggggucaguauccuugagucuggaugcugagggaaucucuggcuccaacagcuuuucguucauugaaucacccgguaagggguaugccaucgucgacgagccguucucugaaauuccucggcagggauuucucggcgagaucagauguaauagugaguccagcgugcugucugcacacgaaagcugcuuaagggcuccaaaccugauauccuacaaacccaugauugaucagcuugaguguaccacuaauuugaucgacccuuucguggucuuugaacgcgguucacucccccaaacacgaaacgauaagacguucgccgcaaguaaaggcaaucgugggguucaggccuuuagcaagggaucugugcaggcugaccugacccuaauguucgauaacuuugagguagacuucgugggcgcggccgucuccugcgacgcagcuuuucugaaccucacugggugcuauucauguaaugccggagcccgggugugccugaguauuacaagcaccggcacagguacucuuuccgcucauaacaaggaugggucuuugcacaucguucugccaucggaaaauggaaccaaagaccaaugucagauauuacauuucacggugccugaggucgaggaagaguuuauguacagcugcgauggcgacgaaagaccccuccuggugaaggguacccuuaucgcaauugauccauucgacgauaggcgcgaggccggcggggagucaacaguugugaacccgaaauccggaaguuggaacuuuuucgacugguucucuggccugaugagcugguuugggggaccuuugaagacuauccuccugauuugucuauacgucgcgcuguccaucggccucuucuuucugcuuauauauuugggucggaccgggcugucaaaaaugugguuagcugccacaaagaaggcaucuuga

SEQ ID NO: 11208 - RNA, 3480 nt, Artificial Sequence
  derived and/or modified CDS sequence (opt3) from RVFV(RVFBJ01/2016)__KX785331.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaagcaugagcugacugaagacugcaacuuuugccggcagaugacaggugccagccuuaaaaagggcuccuacccauugcaggaccuguucugucagucaagugaggaugacgggagcaaacuaaagaccaagaugaaaggaguaugcgagguuggcgugcaagcacucaagaaaugcgauggucagcugucuacggcucacgaagucgugcccuuugccguguucaaaaauuccaagaaggucuaucuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcauggauccaagaaauguacuggugaugcugccuucugcagcgcauacgaguguaccgcccaguaugcuaaugcguacugcucgcacgcaaacggcucugggaucgugcagauucaaguauccggaguguggaagaaaccccugugugucggcuaugagcgagugguugugaagagagaacucucagccaaaccgauccagagggucgagccuugcacaaccuguaucacgaagugcgaaccccauggucuugugguacggaguacuggguuuaagauuagcuccgcuguugccugugcaucuggcgugugcgucacaggaagccagucaccaaguaccgagauaacucugaaauacccuggcaucucccagagcucugggggagacauuggugugcacauggcccaugaugaccaaucagucaguagcaagaucguggcucacugucccccacaggaccccugcuugguucacggcugcauagugugugcccaugggcuaauuaauuaucagugccacacagcacuguccgcguucguagucguguucguguuuucuucgguugcuaucaucugucucgccauucuguacaaaguccuucguugccugaagaucgcaccuaaaaagguguugaacccacucauguggauuaccgccuucauacgcuggguauauaaaaagaugguggcuagaguugccgauaauaucaaccaggucaacagggaaauuggauggauggagggcggucaacuggcauuagggaauccggcucccaucccucggcaugccccaaucccccgauacagcacguaccugaugcuacuccugauuauauccuaugcgucagccuguagugagcuuauccaggcuucuagccgcauuaccacaugcuccacugaaggcgugaacaccaaguguagauugucaggaacagcacugaucagggccggcagcgugggggcugaggccugccucaugcugaaaggagucaaggaagaccagacuaaauuucuuaagauuaaaaccguuucuuccgagcugaguugucgggagggucagagcuacuggacaggcucuuucuccccuaagugcuugucaagucgcagaugccaccucgugggggaaugucacgugaauaggugccugagcuggcgugauaacgagaccucggcagaauuuuccuucguaggagagucuacuacgaugcgggaaaauaaguguuuugagcaaugcggcgguuggggguguggcugcuucaacgucaauccaagcuguuuauuugugcauacauaucugcagucaguucgaaaagaggcgcuaagaguguucaacugcaucgacuggguccacaagcucacccuggaaauaacugauuuugacggaaguguguccaccaucgaucuuggcgccucuagcuccagguucacaaauugggggucaguuagcuugagucuggacgcugagggaauuucuggcuccaacagcuuuucguucaucgaaucacccgguaaaggguacgccauuguggaugagccguucucugaaaucccucgccagggauuucucggcgagauacgguguaauagugaguccagcguacugucugcacaugaaagcugcuuaagagcuccaaaccugauuuccuauaagcccaugaucgaccagcuugaguguaccacuaauuugauugauccuuucgucguguuugaaagggguucacucccccaaacacgcaacgacaaaacguucgccgcaaguaagggcaaucgaggggugcaggccuuuagcaagggaucuguccaggcugaucugacccuaauguucgacaacuuugagguugacuucgugggcgcggccguauccugcgaugcagcuuuucugaaccucacugggugcuacucauguaaugccggagcccgggugugccugaguaucacaagcaccggcacagguacucuuuccgcucacaacaaagacgggucuuugcauauaguccugccaucggaaaauggaaccaaggaucaaugucagaucuuacacuucacggugccugagguugaggaagaguuuauguauagcugcgacggcgaugaacguccccuccuggugaaagguacccuuauugcaaucgacccauucgaugacagaagggaggccggcggggagucaacagucgugaacccgaaguccggaaguuggaacuuuuucgauugguucucuggccugaugagcugguuugggggaccuuugaaaacuauucuccugaucugucuauacguugcgcuguccauaggccucuucuuucugcuuauuuacuugggucgcaccgggcugucaaagaugugguuagcugccacaaagaaagcaucuuga

SEQ ID NO: 11209 - RNA, 3480 nt, Artificial Sequence
  derived and/or modified CDS sequence (opt3) from RVFV(Ken 199800523)__KU978777.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggauacuaagcaaauaggacgggaaacgauggcuggcaucgccaugaccguacugcccgcacuagccguguucgcucucgcaccugucguguuugccgaggacccacaucugcgcaauagacccgguaaagggcacaacuauauugauggaaugacacaggaggacgcuacuuguaagccuguuaccuacgccggcgcgugcagcucguucgaugugcuucuggaaaaaggcaaguuuccauuguuccagucauaugcacaccauaggacacuccuggaggccguccacgacaccaucauugcuaaagccgaucccccuagcugugaccugcagagugcacacgggaauccaugcaugaaggaaaagcucgugaugaaaacucauuguccgaacgauuaccaauccgcucacuauuuaaauaacgacggaaagauggccucuguaaaaugucccccuaaguacgagcugacagaagauugcaauuuuugccggcagaugaccggugcgagccuuaaaaagggcuccuauccauugcaggaccuguucugucagucaagugaggacgaugggagcaaacuaaagacgaagaugaaaggaguuugcgaggugggcguccaagcccucaagaaaugcgacggucagcugucuacugcacaugaaguggugcccuuugcugucuucaagaacuccaaaaagguuuaccuugauaagcuggacuugaaaaccgaggaaaaucuccugccugauucauuuguguguuucgagcacaaggggcaguacaaaggaacaauggacagcggccagacuaagcgcgaauuaaaaaguuuugauaucucucaaugcccaaagauaggcgggcacggauccaagaaauguaccggugacgccgcuuucugcagcgccuaugaguguacagcacaguacgccaacgcuuuuugcucgcaugcgaauggcucugggauuguacagauccaaguguccggagucuggaagaaaccccugugugugggcuaugagcgaguuguggucaagagagaacucucagcaaaaccgauucagaggguggagccuugcaccacguguaucacuaagugcgaaccccacggucuuguaguucggaguacaggguucaagaucagcuccgccguggcuugugccucuggcgucugcgugaccggaagccagucaccaaguacugagauuacacugaaauacccuggcauaucccagagcucugggggagauaucgguguccauauggcacacgacgaucaaucagugaguagcaagauuguugcccauugucccccacaggaccccugcuuggugcacggcugcaucguaugugcucacgggcuaauaaacuaucagugccauaccgcccuguccgcauucgucgugguuuuuguguucucuucgauugcgaucaucugucucgcuauucuguaccguguccuuaaaugccugaagaucgccccucgcaaaguguugaauccacucauguggauuacggcauuuauaagauggguauauaagaaaaugguggccaggguugcugacaacaucaaccaggucaaucgggaaauuggauggauggagggcggucaacugguguuagggaacccggcccccaucccucgacacgcaccaaucccccgcuacagcaccuaccugaugcuacuccugauuguguccuaugcuucagccuguagugagcuuauacaggcgucuagcagaaucacaacuugcuccaccgaaggcgucaauacaaaguguagguugucaggaacugcccugauucgggcuggcagcguuggggcagaggccugccucaugcugaagggagugaaagaagaucagaccaaguuccuuaaaaucaagacagugucuuccgagcugaguugucgcgagggucagagcuacuggaccggcucuuuuuccccuaaaugcuugucaaguagaaggugccaucucguaggggaaugucacgucaaccguugccugagcuggcgggacaaugagacuucggcugaguucuccuuugugggagaaucuacgacaaugcgagaaaacaaguguuucgagcaaugcggcgguuggggguguggcugcuuuaauguuaacccaagcuguuuauucgugcacaccuaucugcagucagucagaaaggaggcccuaaggguguuuaauugcauugauuggguucauaaacucacucuggaaaucaccgacuucgauggaaguguguccacaauagaccuuggcgcaucuagcucccgcuuuaccaacugggggucaguaucuuugagucuggaugcggagggaaucucuggcuccaauagcuucucguucauugaaucacccgguaagggguacgccaucgucgacgagccguuuucugaaauuccucggcagggauuccucggcgagaucagauguaacagugaguccagcgugcugaaugcucacgaaucuugcuuaagggccccaaaccugauaagcuauaaacccaugauugaucagcuugaguguacuacaaauuugaucgacccuuuuguggucuucgaacgcgguucccucccccaaacgcgaaacgauaagaccuuugcagcuucaaaaggcaaccgugggguucaggccuucaguaagggaagcgugcaggcagaccugacucuaauguuugauaauuucgagguagacuuugugggcgccgcugucucuugcgacgcggccuuccugaaccucacagggugcuacuccuguaaugcaggagcucgggugugccugucaauuaccaguacaggcacugguacccuuagcgcccauaacaaggaaggguccuugcacaucguucugccaucugagaauggaacgaaagaucaaugucagauauuacauuuuaccgugccugaggucgaagaggaguucauguauucgugcgacggcgaugaaagaccccuccuggugaaggguacacuuaucgccauugacccauuugaugacaggcgcgaggcuggcggggaaagcacuguugugaacccgaaaucaggauccuggaauuucuucgauugguuuaguggccugaugucuugguucgggggaccuuugaagaccauccuccugauuugucuauacgucgcacugagcaucggccucuuuuuccugcuuauauacuugggucggacagggcuguccaaaaugugguuagccgcgacuaagaaggcuucauga

SEQ ID NO: 11210 - RNA, 3480 nt, Artificial Sequence
  derived and/or modified CDS sequence (opt3) from RVFV__JQ068143.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaagaaggucuaccuugacaagcuggauuugaaaacugaggaaaaccuccugccugacucauuuguuuguuucgagcacaaggggcaguacaaaggaaccauagauagcggccagacaaagcgcgaauuaaaaaguuuugacauuucucaaugcccaaagaucggcgggcacggauccaagaaauguacuggugaugcugccuucugcagcgcauaugaguguaccgcccaguacgcuaaugcguauugcucgcaugcaaacggcucugggauugugcagauccaaguauccggaguguggaagaaaccccugugugucggcuacgagcgagugguugugaagagagaacucucagccaaaccgauccagagggucgagccuugcacaaccuguauuacgaagugcgaaccccacggucuugugguacggaguacuggguuuaagauaagcuccgcuguugccugugcaucuggcgugugcgucacaggaagccagucaccaaguaccgagaucacucugaaauauccuggcauuucccagagcucugggggagacaucggugugcauauggcccacgaugaccaaucagucaguagcaagauaguggcucauugucccccacaggaccccugcuugguucacggcugcauugugugugcccacgggcuaaucaauuaccagugccauacagcacuguccgcguucguagucguguucguguuuucuucgguugcuaucauuugucucgccauccuguauaaaguccuucguugccugaagauugcaccuaaaaagguguugaacccacucauguggauaaccgccuucauccgcuggguauacaaaaagaugguggcuagaguugccgauaauauuaaccaggucaacagggaaaucggauggauggagggcggucaacuggcauuagggaauccggcucccaucccucggcacgccccaauuccccgauacagcacguaucugaugcuacuccugauaaucuccuacgcgucagccuguagugagcuuauucaggcuucuagccgcaucaccacaugcuccacugaaggcgugaacaccaaguguagauugucaggaacagcacugauuagggccggcagcgugggggcugaggccugccucaugcugaaaggagucaaggaagaccagacuaaauuucuuaagaucaaaaccguuucuuccgagcugaguugucgggagggucagagcuauuggacaggcucuuucuccccuaagugcuugucaagucgcagaugccaucucgugggggaaugucacgugaauaggugccugagcuggcgugauaacgagaccucggcagaauuuuccuucguaggagagucuacuacgaugcgggaaaauaaguguuuugagcaaugcggcgguuggggguguggcugcuucaacgucaauccaagcuguuuauuugugcacacauaccugcagucaguucgaaaagaggcgcuaagaguguucaacugcauagacuggguccauaagcucacccuggaaaucacugauuuugacggaaguguguccaccauugaucuuggcgccucuagcuccagguucacaaauugggggucaguuagcuugagucuggacgcugagggaaucucuggcuccaacagcuuuucguucauugaaucacccgguaaaggguaugccaucguggaugagccguucucugaaauaccucgccagggauuucucggcgagauucgguguaauagugaguccagcguacugucugcacacgaaagcugcuuaagagcuccaaaccugaucuccuacaagcccaugauugaccagcuugaguguaccacuaauuugaucgauccuuucgucguguuugaaagggguucacucccccaaacacgcaacgacaaaacguucgccgcaaguaagggcaaucgaggggugcaggccuuuagcaagggaucuguccaggcugaucugacccuaauguucgacaacuuugagguugacuucgugggcgcggccguauccugcgaugcagcuuuucugaaccucacugggugcuauucauguaaugccggagcccgggugugccugaguauaacaagcaccggcacagguacucuuuccgcucauaacaaagacgggucuuugcacaucguccugccaucggaaaauggaaccaaggaucaaugucagauuuuacauuucacggugccugagguugaggaagaguuuauguacagcugcgacggcgaugaacguccccuccuggugaaagguacccuuaucgcaauugacccauucgaugacagaagggaggccggcggggagucaacagucgugaacccgaaguccggaaguuggaacuuuuucgauugguucucuggccugaugagcugguuugggggaccuuugaaaacuauccuccugauaugucuauacguugcgcuguccauuggccucuucuuucugcuuaucuauuugggucgcaccgggcugucaaagaugugguuagcugccacaaagaaagcaucuuga

SEQ ID NO: 11211 - RNA, 3480 nt, Artificial Sequence
  derived and/or modified CDS sequence (opt3) from RVFV(200803169)__JF311384.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcauguucuucguucgaugugcuucuggaaaaaggcaaguuuccauuguuccagucauaugcccaccauaggacccuccuggaggcuguccacgacacaaucauugccaaagcagaucccccuagcugcgaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagauaucgguguccauauggcccacgacgaucaaucagugaguagcaagauuguugcucauugucccccacaggaccccugcuuggugcacggcugcaucguaugugcccacgggcuaauaaacuaccagugccauacagcacuguccgcguucgucgugauuuucguauuuucuucgaccgcuaucaucugucucgccgugcuguaucguguccuuaaaugccugaagauugcaccucgcaaaguguugaauccacucauguggaucacggccuucauuagauggguauacaagaaaaugguggcuaggguugccgacaacauaaaccaggucaaucgggaaaucggauggauggagggcggucaacuggcauuagggaacccggcucccauuccucgacacgccccaaucccccgcuacagcaccuaucugaugcuacuccugaucguguccuacgcgucagccuguagugagcuuauucaggcuucuagcagaauaacaacuugcuccaccgaaggcgugaauacaaaguguagguugucaggaacugcacugauccgggccggcagcgucggggcugaggccugccucaugcugaagggaguuaaaguggaucagaccaaguuucuuaaaauuaagacagugucuuccgaacugaguugucgcgagggucagagcuauuggaccggcucuuucuccccuaaaugcuugucaaguagaaggugccaucucguaggggagugucacgucaaccguugccugagcuggcgggacaaugaaacuucggcagaguuuuccuucgugggagaaucuacgacaaugcgagagaacaaguguuuugaacaaugcggcgguuggggguguggcugcuucaauguuaacccaagcuguuuauuugugcacaccuaccugcagucagucagaaaggaggcgcuaaggguguucaauugcaucgauuggguucauaaacucacucuggagauuaccgacuuugauggaaguguguccacaaucgaccuuggcgccucuagcucccgcuucaccaacugggggucaguuagcuugagucuggaugcugaaggaauaucuggcuccaauagcuuuucguucaucgagucacccgguaagggguaugccauugucgacgaaccguucucugagaucccucggcagggauuucucggcgaagugagauguaacagugaguccagcgugcugucugcacacgagagcugcuuaagggcuccaaaucuggucuccuacaaacccaugauugaucagcuugaauguacuacaaacuugaucgacccuuucguuguguuugagcgcgguucacucccccaaacgcgaaaugauaagaccuucgccgcaaguaaaggcaaccgugggguacaggccuuuagcaagggaucugugcaggcugaccugacucuaauguucgauaacuuugaagucgacuucgugggcgcggccguuuccugcgacgcagcuuuucugaaucucacagggugcuauucauguaacgccggagcccgggugugccugaguauaaccagcacaggcacugguacccuuuccgcucauaauaaggaugggucuuugcacauuguccugccaucggagaacggaacgaaagaccaaugucagaucuuacauuucaccgugccugaaguugaggaggaauuuauguacagcugcgauggcgacgagagaccccuccuggugaaggguacacuuauugcaaucgauccauucgacgauaggcgcgaagccggcggggagucaacugucguaaauccgaaauccggaaguuggaacuuuuucgacugguucucuggccugaugagcugguuugggggaccuuugaagaccauacuccugaucugucuauacguggcgcuguccauuggccucuucuuucugcuuaucuauuugggucggacagggcugucaaaaaugugguuagcugccacuaagaaggcaucuuga

SEQ ID NO: 11212 - RNA, 3480 nt, Artificial Sequence
  derived and/or modified CDS sequence (opt3) from RVFV(2007002445)__EU574037.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcauguucuucguucgaugugcuucuggaaaaaggcaaguuuccauuguuccagucauaugcccaccauaggacccuccuggaggcuguccacgacacaaucauugccaaagcagaucccccuagcugcgaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagauaucgguguccauauggcccacgacgaucaaucagugaguagcaagauuguugcucauugucccccacaggaccccugcuuggugcacggcugcaucguaugugcccacgggcuaauaaacuaccagugccauacagcacuguccgcguucgucgugauuuucguguuuucuucgaccgcuaucaucugucucgccguucuguaucguguccuuaaaugccugaagauugcaccucgcaaaguguugaauccacucauguggaucacggccuucauuagauggguauacaagaaaaugguggcuaggguugccgacaacauaaaccaggucaaucgggaaaucggauggauggagggcggucaacuggcauuagggaacccggcucccauuccucgacacgccccaaucccccgcuacagcaccuaucugaugcuacuccugaucguguccuacgcgucagccuguagugagcuuauucaggcuucuagcagaauaacaacuugcuccaccgaaggcgugaauacaaaguguagguugucaggaacugcacugauccgggccggcagcgucggggcugaggccugccucaugcugaagggaguuaaagaagaucagaccaaguuucuuaaaauuaagacagugucuuccgagcugaguugucgcgagggucagagcuauuggaccggcucuuucuccccuaaaugcuugucaaguagaaggugccaucucgugggggaaugucacguaaaccguugccugagcuggcgggacaaugagacuucggcagaauuuuccuucgucggagagucuacgacaaugcgagaaaacaaguguuuugagcaaugcggcgguuggggguguggcugcuucaaugugaacccaagcuguuuauuuguucacaccuaccugcagucagugagaaaggaggcgcuaagggucuucaauugcaucgauugggugcauaaacucacucuggaaauuaccgacuuugauggaaguguuuccacaaucgaccuuggcgccucuagcucccgcuucaccaacugggggucagugagcuugagucuggaugcugagggaauaucuggcuccaauagcuuuucguucaucgaaucacccgguaagggguaugccauuguagacgagccguucucugaaaucccucggcagggauuucucggcgagauuagauguaacagugaguccagcguccugucugcacacgaaagcugcuuaagggcuccaaaucugguguccuacaaacccaugaucgaucagcuugaguguacuacaaacuugauagacccuuucguggucuuugaacgcgguucacucccccaaacgcgaaaugagaagaccuucgccgcaaguaaaggcaaccgugggguucaggccuuuagcaagggaucuauucaggcugaucugacucuaauguucgacaacuuugaaguggauuucguaggcgcggccguguccugcgacgcagcuuuucugaaucucacagggugcuauucauguaacgccggagcccgggucugccugaguaucaccagcacaggcacugguacccuuuccgcucauaauaaggacgggucuuugcacauugugcugccaucggagaacggaacgaaagaucaaugucagaucuuacauuucaccguuccugagguggaagaggaauuuauguacagcugcgacggcgaugagagaccccuccuggucaaggguacacuuauagcaaucgacccauucgaugacaggcgcgaggccggcggggaaucaacugugguuaauccgaaauccggaaguuggaacuuuuucgauugguucucuggccugaugagcugguuugggggaccuuugaagaccauucuccugaucugucuauacguggcgcuguccauuggccucuucuuucugcuuaucuauuugggucggacagggcugucaaaaaugugguuagcugccacuaagaaggcaucuuga

SEQ ID NO: 11213 - RNA, 3480 nt, Artificial Sequence
  derived and/or modified CDS sequence (opt3) from RVFV(Hv-B375)__DQ380218.1__NSm-Gn-Gc
augaucgagggcgccugggacagccugagagaaggggagaugcccgaagaacucuccugcucuauuucaggaauaagggaagugaagaccaguagccaggagcuuuaccgggcucugaaagcaaucauugccgcggaugguuugaacaauaucacaugucacggcaaggacccugaggauaaaauuuccuuaaucaaggggccaccgcauaaaaagcgcgucggaauaguucgaugcgaacguagaagggacgcuaagcaaaucggccgggagacuauggccgguauugcaaugacggugcugcccgcccuagcuguauucgcacucgccccuguggucuuugcugaagauccacaucugcgcaacagacccgggaaaggacacaauuauaucgacggcaugacccaggaggaugccacauguaagccugugacuuacgcgggcgcauguucuucguucgacguucuucuggagaaagggaaguuuccauuguuccagucauaugcccaccauaggacccuccuggaagcugugcacgauacaauuaucgccaaagcagaucccccuagcugcgaccugcagagugcucacggaaacccaugcaugaaggagaagcucgucaugaaaacccauuguccgaaugacuaccaauccgcccacuauuuaaacaaugaugguaagauggcgucugugaaaugucccccuaagaacgaacugacugaggacugcaauuuuugccggcagaugacaggcgccagccuuaaaaagggguccuacccauugcaggaccuguucugucagucaagugaagaugacggaagcaaacuaaagaccaagaugaaaggcguaugcgagguuggugugcaagcacucaagaaaugcgaugggcagcugucuacggcucaugaggucgugcccuuugccguguucaagaacuccaaaaaggucuaucuugacaagcuggauuugaaaacugaagagaaucuccugccugacucauuuguuuguuucgaacacaagggacaguacaaaggcaccauggauagcggccagacaaagcgcgaguuaaaaaguuuugacauaucucaaugcccaaagauugggggacacgguuccaagaaauguacuggcgaugcugccuucugcagcgcauacgaauguaccgcccaguaugcuaacgcguacugcucgcaugcaaaugggucuggaaucgugcagauucaaguauccggcguguggaagaaaccccugugugucgguuaugagcgagugguugugaagagagagcucucagccaaaccgauccagagggucgaaccuugcacaaccuguaucacgaagugcgagccccacgggcuugugguacggaguacuggcuuuaagauuagcuccgcuguugccugugcaucuggagugugcgucacaggcagccagucaccaaguaccgaaauaacucugaaauacccugggaucucccagagcucuggaggugacauuggcgugcauauggcccacgaugaccaaucagucaguagcaagaucguggcucauugucccccacaggaccccugcuugguucacgggugcauagugugugcccacggacuaauuaacuaucagugccauacagcacuguccgcguucguagucguguucguguuuucuucgaucgcuaucauuugucucgccauccuguaccguguucuuaaaugccugaagauugcaccucgcaaagucuugaauccacucauguggauaaccgccuucaucagauggguguauaagaaaaugguagcuaggguggccgauaacauuaaccagguuaaucgggagaucggcuggauggaaggugggcaacuggucuuaggcaacccggcacccaucccucgacacgcuccaauuccccgcuacagcacguaccugaugcuacuccugauaguguccuaugccucagcguguagugagcuuauccaggccucuagcagaauuaccacaugcuccacugagggagugaauaccaaguguagguugucaggcacagcucugauccgggcagggagcgucggagccgaggcuugccucaugcugaaggguguuaaagaggaccagacuaaguuucuuaaaauuaagaccgugucuuccgaacugaguugucgcgagggccagagcuacuggacagggucuuucuccccuaaaugcuugucaaguagaaggugccaucucgugggagagugucacguaaaccguugccugagcuggcgggauaaugaaaccucggccgaguuuuccuucgucggcgaaucuacuacgaugcgagagaacaaguguuuugaacaaugcgguggguggggcuguggaugcuucaaugugaacccaagcuguuuauuuguucacacauaucugcagucagugagaaaggaggcacuaagggucuucaauugcaucgacugggugcauaaacucacccuggagauaacugauuuugacggcaguguuuccaccaucgaucuuggggcgucuagcucccgcuucacaaacuggggaucagugagcuugagucuggacgccgaaggcauuucugguuccaauagcuuuucguucaucgagucacccgggaagggauacgcuauuguagaugaaccguucucugagaucccucggcagggcuuucucggugaaauaagauguaacagugaguccagcguccugucugcccacgagagcugcuuaagggcaccaaaucugauuuccuauaaacccaugaucgaccagcuugaauguaccacuaacuugauugauccuuucgugguguuugagcgcggcucacucccccaaacacgaaaugacaagacguucgcugccaguaaagggaaccggggaguccaggcauuuagcaagggcucuguucaggccgaucugacccuaauguucgacaacuuugaaguggacuucguaggggcugcgguguccugcgaugccgcauuucugaaucucacuggaugcuacucauguaacgcuggcgcccgugucugccugaguaucacaagcaccgguacagggacucuuuccgcccauaauaaggacggaucuuugcacauagugcugccaucggagaacggcaccaaagaucaaugucagaucuuacauuucacgguuccugaaguggaggaggaauuuauguauagcugcgacggugaugagagaccccuccuggucaagggcacccuuauugcuaucgacccauucgaugacaggcgcgaagcagggggagagucaacagugguuaauccgaaauccggcaguuggaacuuuuucgauugguucucugggcugaugagcugguuuggaggcccuuugaagacuauucuccugaucugucuauacguggcccuguccauaggucucuucuuucugcuuauuuacuuggggcggaccggacugucaaaaaugugguuagcggcuacaaagaaggccucuuga

SEQ ID NO: 11214 - RNA, 3480 nt, Artificial Sequence
  derived and/or modified CDS sequence (opt3) from RVFV(clone 13)__DQ380213.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaacaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaagcaugagcugacugaagacugcaacuuuugccggcagaugacaggugccagccuuaaaaagggcuccuacccauugcaggaccuguucugucagucaagugaggaugacgggagcaaacuaaagaccaagaugaaaggaguaugcgagguuggcgugcaagcacucaagaaaugcgauggucagcugucuacggcucacgaagucgugcccuuugccguguucaaaaauuccaagaaggucuaucuugacaagcuggauuugaaaacugaggaaaaccuccugccugacucauuuguuuguuucgagcacaaggggcaguacaaaggaaccauggauagcggccagacaaagcgcgaauuaaaaaguuuugacauaucucaaugcccaaagauuggcgggcauggauccaagaaauguacuggugaugcugccuucugcagcgcauacgaguguaccgcccaguaugcuaaugcguacugcucgcacgcaaacggcucugggaucgugcagauucaaguauccggaguguggaagaaaccccugugugucggcuaugagcgagugguugugaagagagaacucucagccaaaccgauccagagggucgagccuugcacaaccuguaucacgaagugcgaaccccauggucuugugguacggaguacuggguuuaagauuagcuccgcuguugccugugcaucuggcgugugcgucacaggaagccagaauccaucaaccgagauaacucugaaauacccuggcaucagucaguccagcgggggagacauuggugugcacauggcccaugaugaccaaucugucucaaguaagaucguggcucacugucccccacaggaccccugcuugguucacggcugcauagugugugcccaugggcuaauuaacuaucagugccacacagcacugagcgcguucguagucguguucguguuuuccucuaucgcuaucauuugucucgccauccuguaccguguucuuaaaugccugaagauugcaccucgcaaagucuugaauccacucauguggauaaccgccuucaucagauggguguauaagaaaaugguagcuaggguggccgauaacauuaaccagguuaaucgggaaaucggauggauggagggcggucaacuggucuuagggaacccggcacccaucccucgacaugcuccaauuccccgcuacucgacguaccugaugcuacuccugauagugagcuaugccuccgcguguucagagcuuauccaggccaguucuagaauuaccacaugcagcacugaaggcgugaauaccaaguguagguuguccggaacagcucugauccgggcaggcucagucggggccgaggcuugccucaugcugaagggaguuaaagacgaucagacuaaguuucuuaaaauuaagaccgugagcucugaacuguccugucgcgagggucagaguuacuggacaggcagcuucucuccuaaaugcuuguccucaagaaggugccaccucgugggggagugucacguaaaccguugccugaguuggcgggacaaugaaaccagcgccgaguuuucguucgucggagaauccacuacgaugcgagagaacaaguguuuugaacaaugcggcgguuggggguguggcugcuucaaugugaacccaucuuguuuauuuguucauacauaucugcagagcgugagaaaggaggcacuaagggucuucaauugcaucgauugggugcacaaacucacccuggagauaacugacuuugauggaucaguuaguaccaucgaccuuggcgcguccucuagccgcuucacaaacuggggguccgugucauugagccuggaugccgaaggaauuaguggcucuaauuccuuuagcuucaucgagucgcccgguaagggguacgcuauuguagacgaaccguucucagagaucccucggcagggauuucucggcgaaauaagauguaacucugagaguuccguccugagcgcccaugagucuugcuuaagggcaccaaaucugauuagcuauaaacccaugaucgaucagcuugaauguaccacuaacuugauugacccuuucgugguguuugagcgcgguucccucccccaaacacgaaaugaaaagacguucgcugccucaaaaggcaaccgugggguccaggcauuuaguaagggaagcguucaggccgaucugacccuaauguucgacaacuuugagguggacuucguaggcgcugcggugucuugcgaugccgcauuucugaaucucacugggugcuacuccuguaacgcuggagcccgggucugccugucaaucacaaguaccggcacagguacucuuagcgcccacaauaaggacggguccuugcauauagugcugccaucugaaaacggaaccaaagaucaaugucagaucuuacacuucacgguuccugagguggaggaagaguuuauguauucgugcgacggcgaugaaagaccccuccuggucaaggguacccuuauugcuaucgacccauucgaugacaggcgcgaggcaggcggggagagcacagugguuaauccgaaaucaggauccuggaacuuuuucgauugguucaguggccugaugucuugguuugggggaccuuugaagacuauucuccugaucugucuauacguggcccugagcauaggccucuucuuucugcuuauuuacuugggucggaccgggcuguccaaaaugugguuagcggcuacaaagaaggccucauga

SEQ ID NO: 11215 - RNA, 3480 nt, Artificial Sequence
  derived and/or modified CDS sequence (opt3) from RVFV(Kenya 57 (Rintoul))__DQ380192.1__NSm-Gn-Gc
augaucgagggcgccugggacagccugagagaagaggaaaugcccgaggaacucuccugcucuauuucagggauaagggaggugaagaccaguagccaggagcuucaccgggcucugaaagcaaucauugccgcggauggauugaauaauaucacaugucaugguaaggacccugaagauaaaauuuccuuaaucaagggcccaccgcacaaaaagcgcgucgggguugugcgaugcgagcguagaagggacgcuaagcaaauaggacgggaaacuauggccggcaucgcaaugacgguacugcccgcccuagcuguguucgcacucgccccugucguguuugcugaggauccacaucugcgcaacagacccgguaaagggcacaauuacauugacggaaugacccaggaggaugccacauguaagccuguuacuuaugcgggcgcauguucuucguucgacgugcuucuggaaaaaggcaaguuuccauuguuccagucauacgcccaucacaggacccuccuggaggcuguccacgauacaaucauugccaaagcagaucccccuagcugcgaccugcagagugcucaugggaacccaugcaugaaggaaaagcucgugaugaaaacccacuguccgaaugacuaucaauccgcccauuacuuaaacaaugauggaaagauggcgucuguaaaaugucccccuaaguaugagcugacugaagacugcaacuuuugccggcagaugacaggugccagccuuaaaaagggcuccuacccauugcaggaccuguucugucagucaagugaggaugacgggagcaaacuaaagaccaagaugaaaggaguuugcgaggugggcguccaagcacucaagaaaugcgauggucagcugucuacggcucacgaaguggugcccuuugccgucuucaaaaauuccaagaagguuuaucuugacaagcuggauuugaaaacugaggaaaaccuccugccugacucauuuguguguuucgagcacaaggggcaguacaaaggaaccauggauagcggccagaucaagcgcgaauuaaaaaguuuugacauaucucaaugcccaaagauuggcgggcauggauccaagaaauguacaggugaugcugccuucugcagcgcauacgaguguacugcccaguaugcuaaugcguacugcucgcacgcaaacggcucugggaucguacagauucaaguguccggagucuggaagaaaccccugugugugggcuaugagcgaguuguggucaagagagaacucucagccaaaccgauccagaggguggagccuugcaccacauguaucaccaagugcgaaccccauggucuuguaguucggaguacgggguuuaagauuagcuccgcuguggccugugcaucuggcgucugcgugacuggaagccagucaccaaguacagagauaacccugaaauacccuggcaucucccagagcucugggggagacauugguguccacauggcccaugaugaccaaucagugaguagcaagaucguugcucacugucccccacaggaccccugcuuggugcacggcugcauaguaugugcccaugggcuaauuaauuaucagugccacacugcacuguccgcguucgucgugguuuucguguuuucuucggucgcuaucaucugucucgccauucuguacaaagugcuuaagugccugaaaaucgcaccucguaagguauugaacccacucauguggauuacagccuucauacgcuggguguauaaaaagaugguugcuagagucgccgauaauaucaaccaggugaacagggaaauuggauggauggagggcggucaacugguguuagggaauccggcacccaucccucggcaugcuccaaucccccgauacagcaccuaccugaugcuacuccugauugucuccuaugccucagcguguagugagcuuauacaggccucuagccgcaucacgaccugcuccacagaaggcguuaacacuaaguguagauugucaggaaccgcucugauuagggcaggcagcgugggggccgaggcuugccucaugcugaaaggagugaaggaagaccagacaaaauuucuuaagaucaaaacuguaucuuccgagcugaguugucgggagggucagagcuacuggaccggcucuuucuccccuaagugcuugucaagucgcagaugccaccucgucggggaaugucacgugaauaggugccugagcuggcgugauaacgagacaucggccgaauuuuccuucguuggagagucuaccacuaugcgggaaaauaaguguuuugagcaaugcggcgguuggggguguggcugcuucaacgugaauccaagcuguuuauuuguccauacguaucugcagucagugcgaaaagaggcacuaagaguuuucaacugcauugacugggugcacaagcucacacuggaaaucaccgauuuugacggaaguguauccacugucgaucuuggcgcgucuagcuccagguucaccaauugggggucagugagcuugagucuggacgccgagggaauaucuggcuccaacagcuuuucguucaucgaaucacccgguaaaggguacgcuauuguggaugagccguucucugaaaucagucgccagggauuucucggcgagauucgguguaauuccgagagcucuguccugagcgcccaugaauccugcuuaagagcaccuaaccugaucucauauaagccaaugauagaccagcuugaguguacaaccaauuugauugaucccuucguuguguuugaaagggguagucucccucaaacucgcaacgacaaaacauucgcugccagcaagggcaaucgagggguacaggcauuuucuaagggauccgugcaggccgaucugacgcuaauguucgacaacuuugaggucgacuucgugggcgcugcgguuucaugcgaugccgcauuucugaaccucaccgggugcuacaguuguaaugcuggagcccgggugugccugagcaucacuuccacaggcaccgguacacuuucugcccacaacaaagacgggucguugcauauuguccugcccagcgaaaauggaacuaaggaucaaugucagaucuuacacuucaccgugccagagguugaggaagaguuuauguauucaugcgacggcgaugaacguccucuccuggugaaagguacgcuuauagcuaucgaccccuucgaugacagaagggaggcaggcggggaguccaccgucguaaacccaaagaguggaucuuggaacuuuuucgauugguucagcggccugauguccugguuugggggaccguugaaaacaauucuccugaucugucuauacguggcccugucaauuggccucuucuuucugcuuaucuacuugggucgcacugggcugucuaagaugugguuagcggcuaccaagaaagccagcuga

SEQ ID NO: 11216 - RNA, 3480 nt, Artificial Sequence
  derived and/or modified CDS sequence (opt3) from RVFV(2007001292)__EU574046.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcauguucuucguucgaugugcuucuggaaaaaggcaaguuuccauuguuccagucauaugcccaccauaggacccuccuggaggcuguccacgacacaaucauugccaaagcagaucccccuagcugcgaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagauaucgguguccauauggcccacgacgaucaaucagugaguagcaagauuguugcucauugucccccacaggaccccugcuuggugcacggcugcaucguaugugcccacgggcuaauaaacuaccagugccauacagcacuguccgcguucgucgugauuuucguguuuucuucgaccgcuaucaucugucucgccguucuguaucguguccuuaaaugccugaagauugcaccucgcaaaguguugaauccacucauguggaucacggccuucauuagauggguauacaagaaaaugguggcuaggguugccgacaacauaaaccaggucaaucgggaaaucggauggauggagggcggucaacuggcauuagggaacccggcucccauuccucgacacgccccaaucccccgcuacagcaccuaucugaugcuacuccugaucguguccuacgcgucagccuguagugagcuuauucaggcuucuagcagaauaacaacuugcuccaccgaaggcgugaauacaaaguguagguugucaggaacugcacugauccgggccggcagcgucggggcugaggccugccucaugcugaagggaguuaaagaagaucagaccaaguuucuuaaaauuaagacagugucuuccgagcugaguugucgcgagggucagagcuauuggaccggcucuuucuccccuaaaugcuugucaaguagaaggugccaucucgugggggaaugucacguaaaccguugccugagcuggcgggacaaugagacuucggcagaauuuuccuucgucggagagucuacgacaaugcgagaaaacaaguguuuugagcaaugcggcgguuggggguguggcugcuucaaugugaacccaagcuguuuauuuguucacaccuaccugcagucagugagaaaggaggcgcuaagggucuucaauugcaucgauugggugcauaaacucacucuggaaauuaccgacuuugauggaaguguuuccacaaucgaccuuggcgccucuagcucccgcuucaccaacugggggucagugagcuugagucuggaugcugagggaauaucuggcuccaauagcuuuucguucaucgaaucacccgguaagggguaugccauuguagacgagccguucucugaaaucccucggcagggauuucucggcgagauuagauguaacagugaguccagcguccugucugcacacgaaagcugcuuaagggcuccaaaucugguguccuacaaacccaugaucgaucagcuugaguguacuacaaacuugauagacccuuucguggucuuugaacgcgguucacucccccaaacgcgaaaugauaagaccuucgccgcaaguaaaggcaaccgugggguucaggccuuuagcaagggaucugugcaggcugaccugacucuaauguucgauaacuuugagguagacuucgugggcgcggccgucuccugcgacgcagcuuuucugaaucucacagggugcuauucauguaacgccggagcccgggugugccugaguauuaccagcacaggcacugguacccuuuccgcucauaauaaggaugggucuuugcacaucguucugccaucggaaaacggaacgaaagaccaaugucagauuuuacauuucaccgugccugaggucgaggaagaguuuauguacagcugcgauggcgacgaaagaccccuccuggugaaggguacacuuaucgcaauagauccauucgacgauaggcgcgaggccggcggggagucaacuguugugaauccgaaauccggaaguuggaaccuguuugacugguucucuggcuugaugagcugguucgggggaccucucaagaccauccugcuaauuugucuguacgucgcgcucuccaucggccuguuuuuccuuuugauuuaucugggucggacaggguuaucaaaaauguggcucgcugccacuaagaaggcaucuuga

SEQ ID NO: 11217 - RNA, 3480 nt, Artificial Sequence
  derived and/or modified CDS sequence (opt3) from RVFV(2007001811)__EU574040.1__NSm-Gn-Gc
augaucgagggcgccugggacagccugagagaagaggaaaugcccgaggaacucuccugcucugugucagggauuagggaggucaagacaaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcaugcagcucguucgaugugcuucuggaaaaaggcaaguuuccauuguuccagucauaugcccaccauaggacccuccuggaggcuguccacgacacaaucauugccaaagcagaucccccuagcugugaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagauaucgguguccauauggcccacgacgaucaaucagugaguagcaagauuguugcucauugucccccacaggaccccugcuuggugcacggcugcaucguaugugcccacgggcuaauaaacuaccagugccauacagcacuguccgcguucgucgugguuuucguguuuucuucgauugcuaucaucugucucgccauucuguaucguguccuuaaaugccugaagaucgcaccucgcaaaguguugaauccacucauguggauuaccgccuucauaagauggguauacaagaaaaugguggcuaggguugccgacaacaucaaccaggucaaucgggaaauuggauggauggagggcggucaacugguguuagggaacccggcacccaucccucgacacgcuccaaucccccgcuacagcacguaucugaugcuacuccugauuguguccuacgccucagcguguagugagcuuauacaggccucuagcagaaucaccacaugcuccacugaaggcgucaauaccaaguguagguugucaggaacagcucugauucgggcaggcagcguuggggccgaggcuugccucaugcugaagggagugaaagaagaucagacuaaguuucuuaugaucaaaaccgugucuuccgagcugaguugucgcgagggucagagcuauuggacaggcucuuucuccccuaagugcuugucaaguagaaggugccaucucguaggggaaugucacgucaaccguugccugagcuggcgggacaaugagaccucggccgaauuuuccuucgugggagagucuacuacgaugcgagaaaacaaauguuuugagcaaugcggcgguuggggguguggcugcuucaauguuaacccaagcuguuuauuugugcacacauaccugcagucagucagaaaggaggcacuaaggguguucaauugcauugauuggguucauaagcucacccuggaaaucacugacuuugauggaaguguguccaccauagaccuuggcgcgucuagcucccgcuucacaaacugggggucaguaucuuugagucuggaugccgagggaaucucuggcuccaauagcuuuucguucauugaaucacccgguaaaggguaugcuaucgucgacgagccguucucugaaauuccucggcagggauuucucggcgagaucagauguaacagugaguccagcgugcugucugcccacgaaagcugcuuaagggcaccaaaucugauauccuacaagcccaugauugaucagcuugaguguaccacuaacuugaucgacccuuucguggucuuugaacgcgguucacucccccaaacacgaaaugagaaaacguucgcugccaguaagggcaaccgugggguucaggcauuuagcaaaggaucugugcaggccgaucugacccuaauguucgacaacuuugaaguagauuucgugggcgcugcggucuccugcgacgccgcauuucugaaucucacugggugcuauucauguaacgcuggagcccgggugugccugaguauuacaagcaccggcacagguacucuuuccgcccauaauaaggacgggucuuugcacaucguucugccaucggagaacggaaccaaggaucaaugucagauauuacauuucacggugccugaggucgaagaggaauuuauguacagcugcgacggcgaugagagaccccuccuggugaaagguacccuuaucgcuauugacccauucgaugacaggcgcgaggcaggcggggaaucaacaguugugaauccgaaguccggaaguuggaacuuuuucgauugguucucuggccugaugagcugguuugggggaccuuugaaaacuauccuccugauuugucuauacgucgcccuguccaucggccucuucuuucugcuuauauauuugggucggaccgggcugucaaagaugugguuagcggcuaccaaaaaggccucuuga

SEQ ID NO: 11218 - RNA, 3480 nt, Artificial Sequence
  derived and/or modified CDS sequence (opt3) from RVFV(ANK-6087)__DQ380216.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggaaugacccaggaggaugccacauguaagccugugacuuacgcgggcgcauguucuucguucgacguucuucuggaaaaaggcaaguuuccauuguuccagucauaugcccaccauaggacccuccuggaggcugugcacgauacaauuaucgccaaagcagaucccccuagcugcgaccugcagagugcucacgggaacccaugcaugaaggaaaagcucgucaugaaaacccauuguccgaaugacuaccaauccgcccacuauuuaaacaaugauggaaagauggcgucugugaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguaugcgagguuggcgugcaagcacucaagaaaugcgauggucagcugucuacggcucaugaagucgugcccuuugccguguucaaaaauuccaagaaggucuaccuugacaagcuggauuugaaaacugaggaaaaccuccugccugacucauuuguuuguuucgagcacaaggggcaguacaaaggaaaguuagauagcggccagaccaaacgcgaacugaagaguuuugacauaucucaaugcccaaagauuggcgggcacggauccaaaaaguguacaggugaugcugccuucugcagcgcauaugaguguacugcccaguacgcuaaugcguauugcucgcaugcaaacggcucugggaucgugcagauucaaguauccggaguguggaaaaagccccucugugucggcuacgagcgagugguugugaaaagagaacuuucagccaagccgauccagagggucgagccuugcaccacauguaucaccaagugcgaaccccacggucuggugguacggaguacgggguuuaaaauuagcuccgcuguugccugugcaucuggcgugugcgucacuggaagccagucaccaaguacagagauaaccuugaaguauccuggcaucucccagagcucugggggagacauuggugugcauauggcccacgaugaccaaucagucaguagcaaaaucguggcucauugucccccacaggaccccugccuaguucacggcugcauagugugugcccacgggcugauuaauuaccagugccauacugcacucuccgcguucguagucguguucguguuuucuucgaucgcuaucauuugucuggccauccuuuaucguguucugaagugcuugaaaauugcaccucgcaagguccucaacccacugauguggauaacagccuucaucagauggguguacaggaaaaugguagcucggguggccgauaauauuaaccagguuaaccgagaaaucggauggauggagggcggucaauuaguccuggggaauccggcacccaucccucgccacgugccaauucccagauacagcaccuaucuaaugcuccugcuuauaguguccuacgcuucagccuguagugaguugauccaggcgucuagcaggauuacgaccugcuccacagaaggcgucaacacuaagugucggcugucaggaaccgcccucauccgcgcuggcagcguuggggcagaggccugccugaugcuuaagggagugaaagaagaccagacaaaguuucugaaaauuaagacugugucuuccgaguugaguuguagagagggucagagcuauuggaccggcucuuucuccccuaaaugccucucaaguaggcguugccaucugguaggggaaugucacgucaaucggugcuuaagcuggcgagauaacgagacaucggcugaauuuuccuucgugggagagucuaccacuaugagagaaaauaaguguuuugagcaaugcggcgguuggggguguggcugcuucaacguuaauccaagcugucuguuugugcacacguaccuacagucagucaggaaggaggcccuccgcguguucaacugcaucgacuggguucauaaacugacacuugaaauaaccgauuuugacggaaguguguccacuaucgauuugggcgcaucuagcucccgguucaccaauugggggucaguaagccugagucucgacgcggagggaauuucuggcuccaacagcuuuucguucaucgaaucacccgguaagggguaugccauugucgaugagccguucucugaaaucccuagacagggauuucugggcgagauaagguguaauagugaguccagcguguuaucugcucacgaaagcugccugcgcgccccaaaccuuauuuccuacaaacccaugaucgaccaguuggaguguucaacaaaucucauugauccuuucguggucuuuaagcgagguagucugccccaaacccggaacgacaaaacuuucgcagcuagcaagggcaaucgugggguucaggccuuuucuaagggauccgugcaggcagaucuaacacugauguucgacaacuuugaaguagacuucgugggcgccgcugucucaugcgaugcggccuuucucaaccugacggggugcuauaguuguaaugcaggagcuagagugugccuuagcaucaccuccacuggcacagguaccuugucugcccauaacaaagacgggucgcugcacauaguuuuaccaagcgagaauggaacaaaggaucaaugucagauccuccauuucacugugccugaagucgaggaggaauuuauguacucaugcgacggcgaugagaggccccugcuugugcgcgguacccugauugccaucgacccauucgaugaccggagagaagcuggcggggaguccacgguugugaacccgaaaaguggaucuuggaacuuuuucgauugguucagcggcuugauguccugguuugggggaccucucaagaccauucugcuaaucugucuguacgucgcacucucaauaggccuguucuuucuuuugauuuaucuggguaggacaggguuaucuaaaauguggcucgccgcgacuaagaaggcuagcuga

SEQ ID NO: 11219 - RNA, 3480 nt, Artificial Sequence
  derived and/or modified CDS sequence (opt3) from RVFV(2007000234)__JF326191.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauacggcgcgaaacuauggccggaaucgcaaugacgguacugcccgcccuagcuguguucgcacucgccccugucguguuugcugaggacccacaccugagaaauaggcccggcaaaggucauaacuauauugaugggaugacccaggaggacgccacauguaagccuguuacuuacgcgggagcauguucuucguucgaugugcuucuggaaaaaggcaaguuuccauuguuccagucauaugcccaccaucggacccuccuggaggcuguccacgacacaaucauugccaaagcagaucccccuagcugcgaccugcagagugcucacggcaauccaugcaugaaggaaaagcucgugaugaaaacccauuguccgaacgauuaccaauccgcccacuauuuaaauaacgacgggaagauggcgucuguaaaaugucccccuaaguacgagcugacugaagauugcaauuuuugccgccagaugacaggagccagccuuaaaaaggguuccuauccauugcaggaccuguucugucagucaagugaggacgauggcagcaaacuaaagaccaagaugaaagggguuugcgaggugggaguccaagcacucaagaaaugcgacggccagcugucuacggcucaugaaguggugcccuuugccgucuucaagaacuccaaaaagguuuaccuugauaagcuggacuugaaaacugaggaaaaucuccugccugauucauuuguguguuucgagcacaagggucaguacaaagggaccauggacagcggacagacaaagcgagaauuaaaaaguuuugauaucucucaaugcccaaagauaggcggccacggguccaagaaauguacuggagacgcugccuucugcagcgcauaugaguguaccgcccaguacgcuaacgcguauugcucgcaugcaaaugguucuggcauuguacagauccaaguguccggggucuggaagaaaccccugugugugggauacgagagaguuguggucaagagggaacucucagccaaaccgauucagcggguggagccuugcacaaccuguaucacgaagugcgaaccccacggccuuguaguucguaguacugguuuuaagaucagcuccgcuguggccugugcaucuggggucugcgugacaggcagccagucaccaaguaccgagauuacucugaaauauccuggaauaucccagagcucuggcggggauaucggaguccauauggcccacgacgaucaaucagugaguagcaagauuguugcucauugucccccacaggaccccugcuuggugcacgguugcaucguaugugcccacggccuaauaaacuaccagugccauacagcacuguccgcguucgucgugauuuucguguuuucuucgaccgcuaucaucugucucgccguucuguaucgcguccuuaaaugccugaagauugcaccuagaaaaguguugaauccacucauguggaucacggccuucauuagguggguauacaagaaaaugguggcucggguugccgacaacauaaaccaggucaaucgagaaaucggguggauggagggaggccaacuggcauuagguaacccggcucccauuccucgccacgccccaauccccagauacagcaccuaucugaugcuacuccugaucguguccuacgcgucagccuguagugagcuuauucaggcuucuagcaggauaacaacuugcuccaccgaaggggugaauacaaagugucgguugucaggcacugcacugauccgcgccggaagcgucggcgcugaggccugccucaugcugaaggggguuaaagaagaucagaccaaguuucuuaaaauuaagacagugucuuccgagcugaguuguagagagggacagagcuauuggaccgguucuuucuccccuaaaugcuugucaaguaggcguugccaucucgugggcgaaugucacguaaaccggugccugagcuggcgagacaaugagacuucggcagaauuuuccuucgucggggagucuacgacaaugagagaaaacaaguguuuugagcaaugcggaggcugggguugugggugcuucaaugugaacccaagcuguuuauuuguucacaccuaccugcagucagugaggaaggaggcgcuacgcgucuucaauugcaucgauugggugcauaaacucacucuggaaauuaccgacuuugauggcaguguuuccacaaucgaccuuggagccucuagcucccgguucaccaacuggggcucagugagcuugagucuggaugcugaggggauaucuggauccaauagcuuuucguucaucgaaucacccggcaaggguuaugccauuguagacgagccguucucugaaaucccuagacagggguuucucggagagauuagguguaacagugaguccagcguccugucugcacacgaaagcugcuuacgcgcuccaaaucugguguccuacaaacccaugaucgaucagcuugaguguacuacaaacuugauagacccuuucguggucuuugaacgaggcucacucccccaaacgcggaaugauaagaccuucgccgcaaguaaagguaaccguggcguucaggccuuuagcaaggggucugugcaggcugaccugacucuaauguucgauaacuuugagguagacuucgugggagcggccgucuccugcgacgcagcuuuucugaaucucacaggcugcuauucauguaacgccggggccagagugugccugaguauuaccagcacaggaacuggcacccuuuccgcucauaauaaggaugguucuuugcacaucguucugccaucggaaaacgggacgaaagaccaaugucagauuuuacauuucaccgugccugaggucgaggaagaguuuauguacagcugcgauggagacgaaaggccccuccuggugaagggcacacuuaucgcaauagauccauucgacgaucgccgggaggccgguggcgagucaacuguugugaauccgaaauccgggaguuggaacuuuuucgacugguucucuggacugaugagcugguuuggcgggccuuugaagaccauccuccugauuugucuauacgucgcgcuguccaucggacucuucuuucugcuuauuuauuugggcagaacaggucugucaaaaaugugguuagcugccacuaagaaggcaucuuga

SEQ ID NO: 11220 - RNA, 3480 nt, Artificial Sequence
  derived and/or modified CDS sequence (opt3) from RVFV(SA-75)__DQ380189.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacaugucacgguaaggacccugaagauaaaauuuccuuagucaagggcccaccgcauaaaaagcgcguugggaucgugcgaugcgagcguagaagggacgcuaagcaaauaggacgggaaacuauggcccgcaucgcaaugacgguacugcccgcccuagcuguguucgcacucgccccugucguguuugcugaggauccacaccugagaaacaggcccggcaaaggucauaauuauauugacgggaugacccaggaggaugccacauguaagccuguuacuuacgcgggagcauguucuucguucgacgugcuucuggaaaaaggcaaguuuccauuguuccagucauaugcccaccaucggacccuccuggaggcuguccacgauacaaucauugccaaagcagaucccccuagcugcgaccugcagagugcucacggcaacccaugcaugaaggaaaagcucgugaugaaaacccauuguccgaaugacuaccaauccgcccacuauuuaaacaaugaugggaagauggcgucuguaaaaugucccccuaaguacgagcugacugaagacugcaacuuuugccgccagaugacaggagccagccuuaaaaaggguuccuauccauugcaggaccuguucugucagucaagugaggaugacggcagcaaacuaaagaccaagaugaaagggguuugcgaggugggaguccaagcacucaagaaaugcgauggccagcugucuacggcucaugaaguggugcccuuugccgucuucaaaaauuccaagaagguuuaccuugacaagcuggauuugaaaacugaggaaaaccuccugccugacucauuuguguguuucgagcacaagggucaguacaaagggaccauggauagcggacagacaaagcgagaauuaaaaaguuuugacaucucucaaugcccaaagauaggcggccacggguccaagaaauguacuggagaugcugccuucugcagcgcauaugaguguaccgcccaguacgcuaaugcguauugcucgcaugcaaacgguucuggcguagugcagauucaagucuccgggguguggaagaaaccccuguguguuggauacgagagaguggucgugaagagggaacucucagccaaaccgauccagcggguagagccuugcacaaccuguauuacgaagugcgaaccccacggccuuguugugcguaguacugguuuuaagaucagcuccgcugucgccugugcaucuggggugugcgucacaggcagccagucaccaaguaccgagaucacucugaaauauccuggaauuucccagagcucuggcggggacauaggagugcauauggcccacgaugaccaaucaguuaguagcaagaucguggcucauugucccccacaggaccccugcuugguacacgguugcauugucugugcccacggccuaaucaauuaccagugccauacagcacuguccgcguucgugguuguguucgucuuuucuucgguggcuauaauuugucucgccauccuguauaaaguacuuaagugccugaaaaucgcaccucgcaagguguugaacccacucauguggauuaccguuuucaucagaugggucuacaaaaagaugguggccaggguggcugauaauauuaaccaggucaaccgggaaauaggguggauggagggaggccaacuggccuuagguaauccggcacccaucccucgacacgcuccaauuccccgcuacagcacguaucugaugcuacuccugaucguuuccuacgccucagcguguagugagcuuauccaggccucuagcagaauuaccacaugcuccacugaaggggugaacaccaaguguagguugucaggcacagcucugauacgggcaggaagcgugggcgccgaggcuugccucaugcugaaagggguaaaggaagaccagacuaaauuucuuaagaucaaaaccgucucuuccgagcugaguugucgcgagggacagagcuauuggacagguucuuucuccccuaagugcuugucaaguagaaggugccaucucgugggcgaaugucacguuaaucguugccugagcuggcgggauaacgagaccucggccgaauuuuccuucgugggggagucuacuacgaugcgagaaaauaaguguuuugagcaaugcggaggcugggguugugggugcuucaacgucaauccaagcuguuuauuugugcacacauaccugcagucaguuagaaaagaggcacuaaggguguucaacugcauugacuggguacauaagcucacccuggaaaucacugauuuugacggcagugucuccaccauugaucuuggagcgucuagcucccgcuucacaaauuggggcucagugagcuugagucuggacgccgaggggaucucuggauccaacagcuuuucguucauagaaucacccggcaaagguuaugcuaucguggaugagccguucucugaaauuccucggcagggguuucucggagagaucagauguaauagugaguccagcguccugucugcccacgaaagcugcuuaagggcaccaaaccugauuuccuacaagcccaugaucgaccagcuugaguguaccacuaauuugauagauccuuucguuguguuugaacgcggcucacucccccaaacacgaaacgacaaaacguucgcugccaguaaggguaaucggggcguacaggcauuuagcaaggggucugugcaggccgaucugacccuaauguucgacaacuuugaggucgacuucgugggagcugcgguuuccugcgaugccgcauuucugaaccucacuggcugcuauucauguaaugcuggggcccgugugugccugaguauuacaagcaccggaacaggcacucuuuccgcccauaacaaagacgguucuuugcacaucguccugccaucggaaaaugggaccaaggaucaaugucagauuuuacauuucacggugccugagguugaggaagaguuuauguacagcugcgacggagaugaaagaccccuccuggugaaaggcacccuuaucgcuauagacccauucgaugacaggcgcgaggccgguggcgagucaacagucguaaacccgaaguccgggaguuggaacuuuuucgauugguucucuggacugaugagcugguuuggcgggccuuugaaaacuauccuccugauuugucuauacguggcacuguccaucggacucuucuuucugcuuauuuauuugggccggaccggucugucaaagaugugguuagcggcuacaaagaaagccucuuga

SEQ ID NO: 11221 - RNA, 3480 nt, Artificial Sequence
  derived and/or modified CDS sequence (opt3) from RVFV(KEN07-KUR340)__EF460404.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcauguucuucguucgaugugcuucuggaaaaaggcaaguuuccauuguuccagucauaugcccaccauaggacccuccuggaggcuguccacgacacaaucauugccaaagcagaucccccuagcugcgaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagauaucgguguccauauggcccacgacgaucaaucagugaguagcaagauuguugcucauugucccccacaggaccccugcuuggugcacggcugcaucguaugugcccacgggcuaauaaacuaccagugccauacagcacuguccgcguucgucgugauuuucguguuuucuucgaccgcuaucaucugucucgccguucuguaucguaugcuuaaaugccugaagauugcaccucgcaucgucuugaauccacucauguggauuacggccuucauaagauggguguacaaaaagaugguagcuaggguggccgacaacaucaaccagguuaaucgggaaauuggauggauggagggcggucaacuggcauuagggaacccggcucccaucccucgacacgccccaaucccccgcuacagcaccuaucugaugcuacuccugauugucuccuacgcgucagccuguagugagcuuauacaggcuucuagcagaaucacaacuugcuccaccgaaggcgugaauacaaaauguagguugucaggaacugcacugauucgggccggcagcgugggggcugaggccugccucaugcugaagggagucaaggaagaucagaccaaauuucuuaagaucaaaacaguuucuuccgagcugaguugucgcgagggucagagcuauuggaccggcucuuucuccccuaagugcuugucaaguagaaggugccaucucgugggggaaugucacgugaaccguugccugagcuggcgggacaaugagacuucggcagaauuuuccuucguaggagagucuacgacaaugcgagaaaacaaauguuuugagcaaugcggcgguuggggguguggcugcuucaaugucaacccaagcuguuuauuugugcacaccuaccugcagucaguuagaaaggaggcgcuaaggguguucaauugcauugauuggguccauaagcucacucuggaaaucaccgacuuugauggaaguguguccacaauagaccuuggcgccucuagcucccgcuucaccaacugggggucaguuagcuugagucuggaugcugagggaaucucuggcuccaauagcuuuucguucauugaaucacccgguaaaggguaugccaucguggacgagccguucucugaaauuccucggcagggauuucucggcgagaucagauguaacagugaguccagcguacugucugcacacgaaagcugcuuaagggcuccaaaucuggucuccuacaagcccaugauagaucagcuugaguguacuacaaacuugauugacccuuucgugguguuugaacgcgguucacucccccaaacgcgaaaugauaaaaccuucgccgcaaguaagggcaaccgugggguccaggccuuuagcaaaggaucuguucaggcugaccugacucuaauguucgauaacuuugagguggacuucguaggcgcggccguguccugcgacgcagcuuuucugaaucucacagggugcuauucauguaacgccggagcccgggucugccugaguaucaccagcacaggcacugguacccuuuccgcucauaauaaggaugggucuuugcacauugugcugccaucggaaaacggaacgaaggaccaaugucagaucuuacauuucaccguuccugagguggaggaagaguuuauguacagcugcgauggcgacgaaagaccccuccuggucaaagguacacuuauagcaaucgauccauucgacgauaggcgcgaggccggcggggagucaacugugguuaauccgaaguccggaaguuggaacuuuuucgacugguucucuggccugaugagcugguuugggggaccuuugaaaaccauucuccugaucugucuauacguggcgcuguccauuggccucuucuuucugcuuaucuauuugggucggacagggcugucaaagaugugguuagcugccacuaaaaaggcaucuuga

SEQ ID NO: 11222 - RNA, 3480 nt, Artificial Sequence
  derived and/or modified CDS sequence (opt3) from RVFV(35/74)__JF784387.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaacaauaucacaugucacgguaaggacccugaagauaaaauuuccuuagucaagggcccaccgcauaaaaagcgcguugggaucgugcgaugcgagcguagaagggacgcuaagcaaauaggacgggaaacuauggccggcaucgcaaugacgguacugcccgcccuagcuguguucgcacucgccccugucguguuugcugaggauccacaucugcgcaacagacccgguaaagggcacaauuauauugacggaaugacccaggaggaugccacauguaagccuguuacuuacgcgggcgcauguucuucguucgacgugcuucuggaaaaaggcaaguuuccauuguuccagucauaugcccaccauaggacccuccuggaggcuguccacgauacaaucauugccaaagcagaucccccuagcugcgaccugcagagugcucacgggaacccaugcaugaaggaaaagcucgugaugaaaacccauuguccgaaugacuaccaauccgcccacuauuuaaacaaugauggaaagauggcgucuguaaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguuugcgaggugggcguccaagcacucaagaaaugcgauggucagcugucuacggcucaugaaguggugcccuuugccgucuucaaaaauuccaagaagguuuaccuugacaagcuggauuugaaaacugaggaaaaccuccugccugacucauuuguguguuucgagcacaaggggcaguacaaaggaaccauggauagcggccagacaaagcgcgaauuaaaaaguuuugacaucucucaaugcccaaagauaggcgggcacggauccaagaaauguacuggugaugcugccuucugcagcgcauaugaguguaccgcccaguacgcuaaugcguauugcucgcaugcaaacggcucugggguagugcagauucaagucuccggaguguggaagaaaccccuguguguuggcuacgagcgaguggucgugaagagagaacucucagccaaaccgauccagaggguagagccuugcacaaccuguauuacgaagugcgaaccccacggucuuguugugcggaguacuggguuuaagaucagcuccgcugucgccugugcaucuggcgugugcgucacaggaagccagucaccaaguaccgagaucacucugaaauauccuggcauuucccagagcucugggggagacauaggugugcauauggcccacgaugaccaaucaguuaguagcaagaucguggcucauugucccccacaggaccccugcuugguacacggcugcauugucugugcccacgggcuaaucaauuaccagugccauacagcacuguccgcguucgugguuguguucgucuuuucuucgguggcuauaauuugucucgccauccuguauaaaguacuuaagugccugaaaaucgcaccucguaagguguuggauccacucauguggauuaccguuuucauccgcugggucuacaaaaagaugguggccagaguggcugacaacauuaaucaggucaacagggaaauaggauggauggagggcggucaacuggccuuagggaacccggcacccaucccucggcacgcuccaauuccccgauacagcacguaucugaugcuacuccugaucguuuccuacgccucagcguguagugagcuuauccaggccucuagccgcauuaccacaugcuccacugaaggcgugaauaccaaguguagauugucaggaacagcucugauaagggcaggcagcgugggggccgaggcuugccucaugcugaaaggaguaaaggaagaucagacuaaauuucuuaagaucaaaaccgucucuuccgagcugaguugucgggagggucagagcuauuggacaggcucuuucuccccuaagugcuugucaagucgcagaugccaucucgugggggaaugucacguuaacaggugccugagcuggcgugacaaugagaccucggccgaauuuuccuucgugggagagucuacuacgaugcgggaaaacaaguguuuugagcaaugcggcgguuggggguguggcugcuucaaugucaacccaagcuguuuauuugugcacacauaccugcagucaguucgaaaagaggcacuaagaguguucaauugcauugauuggguacauaagcucacccuggaaaucacugacuuugauggaagugucuccaccauugaccuuggcgcgucuagcuccagguucacaaacugggggucagugagcuugagucuggaugccgagggaaucucuggcuccaauagcuuuucguucauagaaucacccgguaaaggguaugcuaucguggacgagccguucucugaaauuccucgccagggauuucucggcgagauccgguguaacagugaguccagcguccugucugcccacgaaagcugcuuaagagcaccaaaucugauuuccuacaagcccaugaucgaucagcuugaguguaccacuaacuugauagacccuuucguuguguuugaaagggguucacucccccaaacacgcaaugauaaaacguucgcugccaguaagggcaaccgagggguacaggcauuuagcaagggaucugugcaggccgaccugacccuaauguucgacaauuuugaggucgauuucgugggcgcugcgguuuccugcgacgccgcauuucugaaccucacugggugcuauucauguaacgcuggagcccgggugugccugaguauuacaagcaccggcacagguacucuuuccgcccauaauaaagaugggucuuugcacaucguccugccaucggaaaacggaaccaaggaccaaugucagauuuuacauuucacggugccugagguugaggaagaguuuauguacagcugcgauggcgacgaacguccccuccuggugaaagguacccuuaucgcuauagauccauucgacgauagaagggaggcaggcggggagucaacagucguaaauccgaaguccggaaguuggaacuuuuucgacugguucucuggccugaugagcugguuugggggaccuuugaaaacuauccuccugauuugucuauacguggcccuguccaucggccucuucuuucugcuuauuuauuugggucgcaccgggcugucaaagaugugguuagcggcuacaaagaaagccucuuga

SEQ ID NO: 11223 - RNA, 3480 nt, Artificial Sequence
  derived and/or modified CDS sequence (opt3) from RVFV(200803167)__JF311382.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggaccugcaccuucgcaauagaccagguaaagggcauaacuauauugauggaaugacccaggaggacgccacauguaagcccguuacuuacgcgggcgcauguucuucguucgaugugcuguuggaaaaaggcaaguuuccucucuuccagucauaugcccaccauaggacccugcuggaggcuguccacgacacaaucauugccaaagcagauccacccagcugcgaccuccagagugcucacgggaauccuugcaugaaggaaaaguuagugaugaaaacccauuguccaaacgauuaccaauccgcccacuaucugaauaacgacggaaagauggcgucuguaaaaugcccgcccaaguacgagcuuacugaagauuguaauuuuugccggcagaugacaggugccagcuugaaaaagggcuccuauccucugcaggaccuauucugucagucaagugaggacgaugggagcaaacucaagaccaagaugaaaggaguuugcgaggugggcguccaagcacugaagaaaugcgacggucagcuuucuacggcucaugaaguggugccauuugccgucuucaagaacuccaaaaagguuuaccuggauaaguuggaccucaaaacugaggaaaaucuguuacccgauucauuuguguguuucgagcacaaggggcaguacaaaggaaccauggacagcggccagacaaagcgcgaacugaaaaguuuugauaucucucaaugcccuaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccacucugugugggcuacgagcgaguuguggucaagagagaacuuucagccaaacccauucagaggguggagccgugcacaaccuguaucacgaagugcgaaccucacggucugguaguucggaguacuggguuuaagaucagcuccgcuguggccugugcaucuggcgucugcgugacaggaagccagucacccaguaccgagauugccuugaaauauccaggcauaucccagagcucugggggagauaucgguguccauauggcucacgacgaucaaucagugaguagcaagauuguugcccauugcccuccccaggacccaugucuagugcacggcugcaucguaugugcacacgggcugauaaacuaccagugccauacugcgcucuccgcuuucgucgugguuuucguguuuucuucgauugccaucaucugucuggcaauucuuuaucguguccugaaaugcuugaagaucgcuccccgcaaagugcucaauccucugauguggauuacagccuucauaagauggguauacaagaaaaugguggccaggguugcagacaacaucaaccaggucaaucgggaaauuggauggauggagggcggucaauuagugcuggggaacccagcuccgaucccccgacacgccccuaucccacgcuacagcaccuaucuaaugcuccugcuuauuguguccuacgcgucagccuguagugaguugauacaggcuucuagcagaaucacgaccugcuccacagaaggcgucaauacuaaguguaggcugucaggaaccgcacucauucgggccggcagcguuggggcugaggccugccugaugcuuaagggagugaaagaagaucagacaaaguuucugaaaaucaagacugugucuuccgaguugaguugucgcgagggucagagcuauuggaccggcucuuucucccccaaaugccucucaaguagaaggugccaucugguaggggaaugucacgucaaccguugcuuaagcuggcgggacaaugagacaucggcagaauuuuccuucgugggagagucuaccacuaugcgagaaaacaaguguuuugagcaaugcggcgguuggggguguggcugcuucaauguuaacccuagcugucuguuugugcacacguaccuacagucagucagaaaggaggcgcucaggguguucaauugcauugauuggguucauaaacugacacuugaaaucaccgacuuugauggaaguguguccacuauagacuugggcgccucuagcucccgcuucaccaacugggggucaguaagccugagucucgaugcugagggaaucucuggcuccaauagcuuuucguucauugaaucaccagguaagggguaugccaucgucgacgagcccuucucugaaauuccgcggcagggauuucugggcgagaucagauguaacagugaguccagcguguuaucugcacacgaaagcugccugagggcuccuaaucuuauauccuacaaaccaaugauugaucaguuggaguguacaaccaaccucaucgaccccuucguggucuuugaacgcgguucacugccucaaacucgaaaugauaagacauucgccgcaaguaaaggcaaccgugggguucaggccuuuagcaagggaucugugcaggcugaccuaacgcugauguucgauaacuuugagguagacuucgugggcgcggccgucuccugcgacgcagcuuuucucaaucugaccgggugcuauucauguaacgccggagcccgggugugccuuaguauuacuagcacaggcaccgguacauuguccgcucauaauaaggaugggucucugcacaucguuuuacccucggaaaacggaacuaaagaccaaugucagauacuccauuucaccgugccagaggucgaggaagaguuuauguacagcugcgauggcgacgaaagaccucugcuugugaaggguacgcugaucgcaauugaucccuucgacgauaggcgcgaggccggcggggagucaaccguugugaauccaaaauccggaaguuggaacuuuuucgacugguucucuggcuugaugagcugguuugggggaccgcucaagacaaugcugcuaaucugucuguacgucgcgcucuccauuggccuguucuuucuuuugaucuaucugggucggacuggguuaucaaaaauguggcucgcugccaccaagaaggcaucuuga

SEQ ID NO: 11224 - RNA, 3480 nt, Artificial Sequence
  derived and/or modified CDS sequence (opt3) from RVFV(25010-24)__KM210509.1__NSm-Gn-Gc
augaucgagagagccugggacagccugagggaagaggaaaugcccgaggaacucuccugcucuauuucaggcauacgggaggugaagaccaguagccaggagcuuuaccgcgcucugaaagcaaucauugccgcggauggguugaauaauaucacaugucacggaaaggacccugaagauaaaauuuccuuaaucaaggguccaccgcauaaaaagcgagucggcauaguucguugcgagagaaggcgggacgcuaagcaaguggggcgcgaaacuauggccggaaucgcaaugacgguacugcccgcccuagcuguguucgcacucgccccugucguguuugcugaggauccacaccugagaaacaggcccggcaaaggucauaauuauauugacgggaugacccaggaggaugccacauguaagccuguuacuuacgcgggagcauguucuucguucgacgugcuucuggaaaaaggcaaguuuccauuguuccagucauaugcccaccaucggacccuccuggaggcuguccacgauacaaucauugccaaagcagaucccccuagcugcgaccugcagagugcucacggcaacccaugcaugaaggaaaagcucgugaugaaaacccauuguccgaaugacuaccaauccgcccacuauuuaaacaaugaugggaagauggcgucuguaaaaugucccccuaaguacgagcugacugaagacugcaacuuuugccgccagaugacaggagccagccuuaaaaaggguuccuauccauugcaggaccuguucugucagucaagugaggaugacggcagcaaacuaaagaccaagaugaaagggguuugcgaggugggaguccaagcacucaagaaaugcgauggccagcugucuacggcucaugaaguggugcccuuugccgucuucaaaaauuccaaaaagguuuaccuugacaagcuggauuugaaaacugaggaaaaccuccugccugacucauuuguguguuucgagcacaagggucaguacaaagggaccauggauagcggacagacaaagcgagaauuaaaaaguuuugacaucucucaaugcccaaagauaggcggccacggguccaagaaauguacuggagaugcugccuucugcagcgcauaugaguguaccgcccaguacgcuaaugcguauugcucgcaugcaaacgguucuggcauuguacagauccaaguguccggggucuggaagaaaccccugugugugggauacgagagaguuguggucaagagggaacucucagccaaaccgauucagcggguggagccuugcacaaccuguaucacgaagugcgaaccccacggccuuaucguacguaguacugguuuuaagauuagcuccgcuguugccugugcaucuggggugugcgucacaggcagccagucaccaaguaccgagauaacucugaaauauccuggaaucucccagagcucuggcggggacauuggagugcauauggcccacgaugaccaaucagucaguagcaagaucguggcucauugucccccacaggaccccugcuugguucacgguugcauagugugugcccacggccuaauuaauuaccagugccauacagcacuguccgcguucguagucguguucguguuuucuucgguugcuaucaucugucucgccauucuguauaaaguccuuaagugccugaaaaucgcaccuaagaaaguguugaacccacucauguggauuaccgccuucauacgcuggguauacaagaagaugguggcuagaguugccgauaauaucaaccaggucaacagggaaauuggguggauggagggaggccaacuggcauuagguaauccggcucccaucccucggcacgccccaaucccccgauacagcacguaucugaugcuacuccugauuguguccuacgcgucagccuguagugagcuuauacaggcuucuagccgcaucaccacaugcuccacugaaggggugaacaccaaauguagauugucaggcacagcacugauuagggccggaagcgucggcgcugaggccugccucaugcugaaggggguuaaagacgaucagacuaaguuucuuaaaaucaagaccgugucuuccgaacugaguugucgggagggacagagcuauuggacagguucuuucuccccuaagugcuugucaagucgcagaugccaucucgugggcgagugucacguaaauaggugccugagcuggcgugacaacgaaaccucggcagaguuuuccuucgucggggaaucuacuacgaugcgggagaauaaauguuuugaacaaugcggaggcugggguugugggugcuucaacgugaauccaagcuguuuauuuguucacacauaccugcagucagugcgaaaggaggcgcuaagagucuucaacugcauugauugggugcauaaacucacccuggagaucacugacuuugauggcaguguuuccaccauagaccuuggagccucuagcuccagguucacaaauuggggcucagugagcuugagucuggaugcugaagggaucucuggauccaacagcuuuucguucauugagucacccggcaaggguuaugccaucguagacgaaccguucucugagauuccucgccagggguuucucggagaaauccgguguaauagugaguccagcguccugucugcacacgagagcugcuuaagagcuccaaaccugauauccuacaaacccaugauugaucagcuugaauguaccacuaauuugaucgacccuuucgugguguuugagaggggcucacucccccaaacacgcaacgauaagacguucgccgcaaguaaggguaaucgaggcguccaggccuuuagcaaagggucuguucaggcugaccugacccuaauguucgacaacuuugaaguggauuucguaggagcggccguguccugcgacgcagcuuuucugaaccucacuggcugcuauucauguaaugccggggcccgggucugccugaguauuacaagcaccggaacaggcacucuuuccgcucauaacaaggaugguucuuugcacaucgugcugccaucggagaaugggaccaaagaccaaugucagauauuacauuucacgguuccugaaguggaggaggaauuuauguacagcugcgauggagacgagcguccccuccuggucaagggcacccuuaucgcaauugauccauucgacgauagaagggaagccgguggcgagucaacagugguuaacccgaaauccgggaguuggaacuuuuucgacugguucucuggacugaugagcugguuuggcgggccuuugaagacuauccuccugauuugucuauacguggcgcuguccaucggacucuucuuucugcuuauauauuugggccgcaccggucugucaaagaugugguuagcugccacaaagaaggcaucuuga

SEQ ID NO: 11225 - RNA, 3480 nt, Artificial Sequence
  derived and/or modified CDS sequence (opt3) from RVFV(Sudan 2V-2007)__JQ820490.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcauguucuucguucgaugugcuucuggaaaaaggcaaguuuccauuguuccagucauaugcccaccauaggacccuccuggaggcuguccacgacacaaucauugccaaagcagaucccccuagcugcgaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaaguguccggagucuggaagaaaccccugugugugggcuacgagcgaguuguggucaagagagaacucucagccaaaccgauucagaggguggagccuugcacaaccuguaucacgaagugcgaaccccacggucuuguaguucggaguacuggguuuaagaucagcuccgcuguggccugugcaucuggcgucugcgugacaggaagccagucaccaaguaccgagauuacucugaaauauccuggcauaucccagagcucugggggagauaucgguguccauauggcccacgacgaucaaucagugaguagcaagauuguugcucauugucccccacaggaccccugcuccgugcacggcugcaucguaugugcccacggguugauaaacuaccagugccauacagcacuaucugcguucgucgugguuuucguguuuucgagcauugcuaucaucugucuggccauucucuaucguguccugaaaugccuuaagaucgcaccucgcaaagugcugaauccauugauguggauuaccgccuucauaagauggguauacaagaaaaugguggcuaggguugccgacaacaucaaccaggucaaucgggaaauuggauggauggagggcggucaacucgugcuggggaacccggcacccaucccucgacacgcuccaaucccccgcuacuccacguauuuaaugcugcuacucauugugucacaugccagugcguguucugagcugauacaggccagcuccagaaucaccacaugcucaacugaaggcgucaauaccaaguguaggcuuagcggaacagcuuugauucgggcaggcucuguuggggccgaggcuugccugaugcucaagggagugaaagaagaucagacuaaguuucugaaaaucaagaccguguccagugagcuuagcugucgcgagggucagucuuacuggacaggcuccuucucaccuaaaugccugaguagcagaaggugccacuugguaggggaaugucacgucaaccguugccucucguggcgggacaaugagaccuccgccgaauuuucuuucgugggagagagcacuacgaugcgagaaaacaaguguuuugagcaaugcggcgguuggggguguggcugcuucaauguuaacccaucaugucuguuugugcauacauauuuacagagugucagaaaggaggcacugaggguguucaauugcauugauuggguucacaaacuaacccucgaaaucacugacuuugauggauccgugucuaccauagaccugggcgcgagcuccucacgcuucacaaacugggggagcguaagucuuucuuuggaugccgagggaaucuccggcagcaauucguuuucauucauugaaucucccgguaagggguacgcuaucgucgacgagccguucagugaaauuccucggcagggauuucugggcgagaucagauguaacuccgagagcucugugcucagcgcccaugaauccugccugagggcaccaaauuuaauaucauauaaacccaugauugaucagcuggaguguaccacuaaccuuaucgacccuuucguggucuuugaacgcgguaguuugccccaaacacgaaaugauaagacguucgcugccagcaaaggcaaccgugggguucaggcauuuucuaagggauccgugcaggccgaccucacccugauguucgauaacuuugagguagacuucgugggcgcugcggucucaugcgacgccgcauuucuaaaucugacugggugcuacaguuguaacgcuggagcccgggugugccucagcauuacauccaccggcacagguacucugucugcccacaauaaggaugggucgcuucauaucguuuugccaagcgaaaacggaaccaaagaccaaugucagauacugcacuucacggugccugaggucgaggaagaguuuauguauucaugcgauggcgacgaaagacccuuacucgugaaggguacccugauggcuaucgauccauucgacgauaggcgcgaggcaggcggggaguccacaguugugaauccgaaaaguggaucuuggaacuuuuucgacugguucagcggccuuauguccugguuugggggaccucugaagacuauuuugcucaucugucuguacgucgcccuaucaauuggccuguucuuucuccugaucuaccuuggucggaccggguugucuaaaauguggcuggcggcuacaaagaaggccagcuga

SEQ ID NO: 11226 - RNA, 3480 nt, Artificial Sequence
  derived and/or modified CDS sequence (opt3) from RVFV(SAUDI 200010901)__KU978778.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcggacguagaagggauacuaagcaaauaggccgggagacgauggcugguaucgccaugaccguacugcccgcacuagccguguucgcucucgcaccugucguguuugccgaagacccacaucugcgcaauagacccgggaaaggacacaacuauauugauggcaugacacaggaggacgcuacuuguaagccuguuaccuacgccggcgcguguucuucguucgaugugcuucuggagaaagggaaguuuccauuguuccagucauaugcacaccauaggacacuccuggaagccguccacgacaccaucauugcuaaagccgaucccccuagcugcgaccugcagagugcacacggaaauccaugcaugaaggagaagcucgugaugaaaacucauuguccgaacgauuaccaauccgcucacuauuuaaauaacgacgguaagauggccucuguaaaaugucccccuaaguacgaacugacagaggauugcaauuuuugccggcagaugaccggcgcgagccuuaaaaagggguccuauccauugcaggaccuguucugucagucaagugaagacgauggaagcaaacuaaagacgaagaugaaaggcguuugcgagguggguguccaagcccucaagaaaugcgacgggcagcugucuacugcacaugagguggugcccuuugcugucuucaagaacuccaaaaagguuuaccuugauaagcuggacuugaaaaccgaagagaaucuccugccugauucauuuguguguuucgaacacaagggacaguacaaaggcacaauggacagcggccagacuaagcgcgaguuaaaaaguuuugauaucucucaaugcccaaagauagggggacacgguuccaagaaauguaccggcgacgccgcuuucugcagcgccuaugaauguacagcacaguacgccaacgcuuuuugcucgcaugcgaaugggucuggaauuguacagauccaaguguccggcgucuggaagaaaccccuguguguggguuaugagcgaguuguggucaagagagagcucucagcaaaaccgauucagaggguggaaccuugcaccacguguaucacuaagugcgagccccacgggcuuguaguucggaguacaggcuucaagaucagcuccgccguggcuugugccucuggagucugcgugaccggcagccagucaccaaguacugaaauuacacugaaauacccugggauaucccagagcucuggaggugauaucggcguccauauggcacacgacgaucaaucagugaguagcaagauuguugcccauugucccccacaggaccccugcuuggugcacgggugcaucguaugugcucacggacuaauaaacuaucagugccauaccgcccuguccgcauucgucgugguuuuuguguucucuucgauugcgaucaucugucucgcuauucuguaccguguccuuaaaugccugaagaucgccccucgcaaaguguugaauccacucauguggauuacggcauuuauaagauggguauauaagaaaaugguggccaggguugcugacaacaucaaccaggucaaucgggagauuggcuggauggaaggugggcaacugguguuaggcaacccggcccccaucccucgacacgcaccaaucccccgcuacagcaccuaccugaugcuacuccugauuauauccuaugcuucagccuguagugagcuuauccaggcgucuagcagaauuacaacuugcuccaccgagggagugaauacaaaguguagguugucaggcacugcccugauccgggcugggagcgucggagcagaagccugccucaugcugaaggguguuaaagaggaucagaccaaguuccuuaaaauuaagacagugucuuccgaacugaguugucgcgagggccagagcuacuggaccgggucuuuuuccccuaaaugcuugucaaguagaaggugccaucucgugggagagugucacguaaaccguugccugagcuggcgggacaaugaaacuucggcugaguucuccuuugucggcgaaucuacgacaaugcgagagaacaaguguuucgaacaaugcgguggguggggcuguggaugcuuuaaugugaacccaagcuguuuauucguucacaccuaucugcagucagugagaaaggaggcccuaagggucuuuaauugcaucgauugggugcauaaacucacucuggagauaaccgacuucgauggcaguguuuccacaaucgaccuuggggcaucuagcucccgcuuuaccaacuggggaucagugagcuugagucuggaugcggaaggcauuucugguuccaauagcuucucguucaucgagucacccgggaagggauacgccauuguagacgaaccguuuucugagaucccucggcagggcuuccucggugaaauaagauguaacagugaguccagcguccugucugcucacgagagcugcuuaagggccccaaaucugauuuccuauaaacccaugaucgaucagcuugaauguacuacaaacuugauugacccuuuugugguguucgagcgcggcucacucccccaaacgcgaaaugaaaagaccuuugcagcuaguaaagggaaccggggaguccaggccuucagcaagggcucuguucaggcagaucugacucuaauguuugacaacuucgagguggauuuuguaggggccgcuguguccugcgacgcggccuuccugaaucucacaggaugcuacucauguaacgcaggcgcucgugucugccugaguaucaccagcacagguacugggacccuuuccgcccauaauaaggacggaucuuugcacauagugcugccaucggaaaacggcacgaaagaucaaugucagaucuuacauuuuaccguuccugagguggaggaagaguucauguauagcugcgacggugaugaaagaccccuccuggucaagggcacacuuauugccaucgacccauuugaugacaggcgcgaggcugggggagagucaacugugguuaauccgaaauccggcaguuggaacuucuucgauugguuuucugggcugaugagcugguucggaggcccuuugaagaccauucuccugaucugucuauacguggcacuguccauaggucucuuuuuccugcuuauuuacuuggggcggacaggacugucaaaaaugugguuagccgcgacuaagaaggcuucuuga

SEQ ID NO: 11227 - RNA, 3480 nt, Artificial Sequence
  derived and/or modified CDS sequence (opt3) from RVFV(2373/74)__DQ380194.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaauaauaucacauguuaugguaaggacccugaagauaaaauuuccuuaaucaagggcccaccgcacaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuacaucgacggaaugacccaggaggaugccacauguaagccugugacuuaugcgggcgcauguucuucguucgacguucuucuggaaaaaggcaaguuuccauuguuccagucauacgcccaucacaggacccuccuggaggcugugcaugauacaauuaucgccaaagcagaucccccuagcugcgaccugcagagugcucacgggaacccaugcaugaaggaaaagcucgucaugaaaacccacuguccgaaugacuaucaauccgcccauuacuuaaacaaugauggaaagauggcgucugugaaaugucccccuaaguaugagcugacugaagacugcaacuuuugccggcagaugacaggugccagccuuaaaaagggcuccuacccauugcaggaccuguucugucagucaagugaggaugacgggagcaaacuaaagaccaagaugaaaggaguaugcgagguuggcgugcaagcacucaagaaaugcgauggucagcugucuacggcucacgaagucgugcccuuugccguguucaaaaauuccaagaaggucuaccuugacaagcuggauuugaaaacugaggaaaaccuccugccugacucauuuguuuguuucgagcauaaggggcaguauaaaggaaccauggauagcggccagacaaagcgcgaauuaaaaaguuuugacauaucucaaugcccaaagauuggcgggcacggauccaagaaauguacuggugaugcugccuucugcagcgcauacgaguguaccgcccaguaugcuaaugcguacugcucgcacgcaaacggcucugggaucgugcagauucaaguauccggaguguggaagaaaccccugugugucggcuaugagcgagugguugugaagagagaacucucagccaaaccgauccagagggucgagccuugcacaaccuguaucacgaagugcgaaccccauggucuugugguacggaguacuggguuuaagauuagcuccgcuguugccugugcaucuggcgugugcgucacaggaagccagucaccaaguaccgagauaacucugaaauacccuggcaucucccagagcucugggggagacauuggugugcacauggcccaugaugaccaaucagucaguagcaagaugguggcucacugucccccacaggaccccugcuugguucauggcugcaucgugugugcccacgggcuaauaaauuaucagugccacacagcacuguccgcguucguagucguguucguguuuucuucgguugcuauuaucugucucgccauccuguacaaaguccuuaagugccugaaaauugcaccucguaagguguugaacccacucauguggaucaccgccuucauucgcuggguauacaaaaagaugguggcuagaguugccgauaauauaaaccaggucaacagggaaaucggauggauggagggcggucaacuggcauuagggaauccggcucccauuccucggcaugccccaaucccccgauauagcacguaccugaugcuacuccugaucguguccuaugcgucagccuguagugagcuuauucaggcuucuagccgcauaaccacaugcuccacugaaggcgugaacaccaaguguagauugucaggaacagcacugaucagggccggcagcgucggggcugaggccugccucaugcugaaaggaguuaaggaagaccagacuaaauuucuuaagauuaaaaccgugucuuccgagcugaguugucgggagggucagagcuacuggacaggcucuuucuccccuaagugcuugucaagucgcagaugccaccucgugggggaaugucauguaaauaggugccugagcuggcgugauaacgagaccucggcagaauuuuccuucgucggagagucuacuacgaugcgggaaaauaaguguuuugagcaaugcggcgguuggggguguggcugcuucaacgugaauccaagcuguuuauuuguucacacauaucugcagucagugcgaaaagaggcgcuaagagucuucaacugcaucgacugggugcacaagcucacccuggaaauuacugauuuugacggaaguguuuccacccuugauuugggcgccucuagcuccagguucacaaauugggggucagugagccugagucucgacgcugagggaaucucuggcuccaacagcuuuucguucauagaaucacccgguaaaggguacgccaucguagaugagccguucucugaaauuccucgccagggauuucugggcgagauccgguguaauagugaguccagcgucuuaucugcacaugaaagcugccugagagcuccaaaccuuauuuccuauaagcccaugaucgaccaguuggaguguaccacuaaucucauagauccuuucgugguguuugaaagggguucacugccccaaacacgcaacgagaaaacguucgccgcaaguaagggcaaucgagggguccaggccuuuagcaagggaucuguucaggcugaccuaacccugauguucgauaacuuugaaguggacuucguaggcgcggccguguccugcgacgcagcuuuucucaaccugacugggugcuacucauguaaugccggagcccgggucugccuuaguauuacaagcaccggcacagguacuuuguccgcucacaacaaagaugggucucugcauaucguguuaccaucggagaauggaaccaaggaccaaugucagauucuccacuucacgguuccugagguggaagaggaauuuauguacagcugcgauggcgacgagcguccccugcuugucaaagguacccugaucgcaauagauccauucgacgauagaagggaggccggcggggaaucaacagugguuaacccgaaguccggaaguuggaacuuuuucgacugguucucuggcuugaugagcugguuugggggaccucucaaaacuauccugcuaauuugucuguauguggcgcucuccaucggccuguucuuucuuuugauuuaccugggucgcaccggguuaucaaagauguggcucgcugccacaaagaaagcaucuuga

SEQ ID NO: 11228 - RNA, 3480 nt, Artificial Sequence
  derived and/or modified CDS sequence (opt3) from RVFV(KEN/Kil-006/07)__HM586966.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguuggggugguacgaugcgagcguagaagggaugcuaagcaaaucggacgggaaacuauggccggcauagcaaugacggugcugcccgcccuagcugucuucgcacucgccccugugguuuuugcugaggacccacaucugcgcaauagacccgguaaagggcacaacuauaucgauggaaugacccaggaggacgccacauguaagccugugacuuacgcgggcgcaugcagcucguucgauguccuucuggaaaaaggcaaguuuccauuguuccagucauaugcccaccauaggacccuccuggaggcugugcacgacacaauuaucgccaaagcagaucccccuagcugugaccugcagagugcugaugggaauaagugcaugaaggaaaaacucguaaugaagacccacuguccaaacgacuaccaauccgcccauuauuuaaauaacgauggaaaaauggcgucuguuaagugcccgcccaaauacgagcugacugaagacuguaauuuuugccggcagaugacaggugccagccuuaagaaaggcuccuauccuuugcaggaccuguucugucagucaagugaggaugacgggagcaagcuaaagaccaaaaugaagggagugugcgaggucggcgugcaagcacucaaaaagugcgauggucagcugucuacggcucacgaaguggucccauuugccguuuucaaaaacuccaagaagguguaccuugacaaacuggauuugaagacugaggaaaaucuccugcccgacucauuuguauguuucgagcauaaagggcaguacaagggaaccauggauagcggccagacaaaacgcgaauuaaagaguuuugacauuucucaaugcccuaagaucggcgggcacggauccaaaaaguguacuggugaugcugccuucugcagcgcauaugaguguaccgcccaguacgcuaacgcguauugcucgcacgcaaauggcucugggauagugcagauucaagucuccggaguguggaaaaagccacuguguguuggcuacgagcgaguggucgugaaaagagaacucucagccaagcccauccagaggguagagccgugcacaaccuguauuacgaagugcgaaccucauggucuuguugugcggaguacuggguuuaaaaucagcuccgcugucgccugugcaucuggcgugugcgucacaggaagccagucacccaguaccgagaucacucugaaguauccaggcauuucccagagcucugggggagacauaggugugcacauggcccaugaugaccaaucaguuaguagcaaaaucguggcucacugcccuccccaggacccauguuugguacauggcugcauugucugugcccacgggcuaaucaacuaccagugccacacagcacuguccgcguucgugguuauauucguguuuucuucgaccgcuauuaucugucucgccguccuguaucgugugcuuaagugccugaaaaucgcaccccgcaagguauugaauccucucauguggauuacggccuucaucagauggguguacaaaaagaugguugcuagggucgccgauaacauuaaccaggugaaucgggaaauaggauggauggagggcggucaacuggcauuagggaacccagcuccgaucccccgacaugccccuauuccacgcuacagcaccuaucugaugcuacuccugaucguguccuacgcgucagccuguagugagcuuauccaggcuucuagcagaauuacaacuugcuccaccgaaggcgucaauacaaaguguagguugucaggaacugcacugauacgggccggcagcguuggggcugaggccugccucaugcugaaaggagugaaggaagaccagaccaaauuucuuaagaucaaaacagugucuuccgagcugaguugucgcgagggucagagcuauuggaccggcucuuucucccccaagugcuugucaaguagaaggugccaccucguaggggaaugucaugucaaccguugccugagcuggcgggauaaugagacuucggcagaauuuuccuucgugggagagucuacgacaaugcgagaaaacaaguguuuugagcaaugcggcgguuggggguguggcugcuucaauguuaacccuagcuguuuauuugugcacaccuaccugcagucagucagaaaagaggcgcuaaggguguucaauugcauugacuggguucacaagcucacucuggaaaucaccgauuuugacggaaguguguccacaauugaucuuggcgccucuagcucccgcuucaccaacugggggucaguaucuuugagucuggacgcugagggaaucucuggcuccaauagcuuuucguucauagaaucaccagguaaaggguaugccaucgucgaugagcccuucucugaaauuccgcggcagggauuucucggcgagaucagauguaacagugaguccagcgugcugucugcacaugaaagcugcuuaagggcuccuaaucugguguccuacaagccaaugauugaccagcuugaguguacuacaaacuugaucgaucccuucgucguuuuugaacgcgguucacucccucaaacgcgaaaugacaaaaccuucgccgcaaguaagggcaaccguggggugcaggccuuuagcaagggaucuguacaggcugaucugacucuaauguucgacaacuuugagguggacuucgucggcgcggccguguccugcgaugcagcuuuucugaaucucacagggugcuauucauguaacgccggagcccggguuugccugaguauaaccagcacaggcacugguacccuuuccgcucacaauaaagacgggucuuugcauauugugcugcccucggaaaacggaacgaaggaucaaugucagaucuuacacuucaccgucccagagguggaggaagaguuuauguacagcugcgacggcgaugaaagaccucuccugguuaaagguacacuuauugcaaucgaccccuucgaugacaggcgcgaggccggcggggagucaacuguggucaauccaaaguccggaaguuggaacuuuuucgauugguucucuggccugaugagcugguuugggggaccguugaaaaccauacuccugaucugucuauacguagcgcuguccauuggccucuucuuucugcuuaucuauuugggucggacagggcugucaaagaugugguuagcugccacuaagaaagcaucuuga

SEQ ID NO: 11229 - RNA, 3480 nt, Artificial Sequence
  derived and/or modified CDS sequence (opt3) from RVFV(MgH824)__DQ380210.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaacaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaaggguauaauuacaucgacggaaugacccaggaggaugccacauguaagccugugacuuaugcgggcgcauguucuucguucgacguucuucuggaaaaaggcaaguuuccauuguuccagucauacgcccaccacaggacccuccuggaggcugugcaugauacaauuaucgccaaagcagaucccccuagcugcgaccugcagagugcucacgggaacccaugcaugaaggaaaagcucgucaugaaaacccacuguccgaaugacuaucaauccgcccauuacuuaaacaaugauggaaagauggcgucugugaaaugucccccuaaguaugagcugacugaagacugcaacuuuugccggcagaugacaggugccagccuuaaaaagggcuccuacccauugcaggaccuguucugucagucaagugaggaugacgggagcaaacuaaagaccaagaugaaaggaguaugcgagguuggcgugcaagcacucaagaaaugcgauggucagcugucuacggcucacgaagucgugcccuuugccguguucaaaaauuccaagaaggucuaccuugacaagcuggauuugaaaacugaggaaaaccuccugccugacucauuuguuuguuucgagcgcaaggggcaguauaaaggaaccauggauagcggccagacaaagcgagaauuaaaaaguuuugacauaucucaaugcccaaagauuggcgggcauggauccaagaaauguacuggugaugcugccuucugcagcgcauacgaguguaccacacaguaugccaaugcuuacugcucgcacgcgaacggcucuggggugguacagauccaaguguccggagucuggaagaaaccccugugugugggcuaugagagaguuguggucaagagggaacucucagcaaaaccgauucagcggguggagccuugcaccacguguaucacuaagugcgaaccccacggucuuguaguucguaguacaggguuuaagaucagcuccgccguggcuugugccucuggcgucugcgugaccggaagccagucaccaaguacugagauuacacugaaauacccuggcauaucccagagcucugggggagacaucgguguccauauggcacacgaugaccaaucagugaguagcaagauuguugcccauugucccccacaggaccccugcuuggugcacggcugcaucguaugugcucaugggcuaauaaauuaucagugccacaccgcccuguccgcauucgucgugguuuucguguuuucuucgauugcgaucaucugucucgcuauucuguaccgcguccuuaaaugccugaagaucgccccuagaaaaguguugaacccacucauguggauuacggcauucauaagguggaucuacaagaaaaugguagcccggguggcugauaauauuaaccagguuaaccgagaaaucggauggauggagggcggucaacuggucuuagggaauccggcccccaucccucgccacgcaccaauucccagauauagcaccuaccugaugcuacuccugauaguguccuaugcuucagccuguagugagcuuauccaggcgucuagcaggauuacaacuugcuccaccgaaggcguggacacaaagugucgguugucaggaacugcccugauccgcgcuggcagcgucggggcagaggccugccucaugcugaagggaguuaaagaagaucagaccaaguuucuuaaaauuaagacagugucuuccgagcugaguuguagagagggucagagcuacuggaccggcucuuucuccccuaaaugcuugucaaguaggcguugccaucucgugggggaaugucacguaaaccggugccugagcuggcgagacaaugagacuucggcugaauuuuccuucgucggagagucuacgacaaugagagaaaacaaguguuuugagcaaugcggcgguuggggguguggcugcuucaaugugaacccaagcuguuuauuuguucauaccuaucugcagucagugaggaaggaggcccuacgcgucuucaauugcaucgauugggugcacaaacucacucuggaaauaaccgacuuugauggaaguguuuccacaaucgaccuuggcgcaucuagcucccgguucaccaacugggggucagugagcuugagucuggaugcggagggaauuucuggcuccaauagcuuuucguucaucgaaucacccgguaagggguacgccauuguagacgagccguucccugaaaucccaagacagggauuucucggcgagauaagguguaacucugagaguuccguccugagcgcucacgaaucuugcuuacgcgcccccaaucugauuagcuauaaaccuaugaucgaucagcuugaguguacuacaaacuugauugaccccuucgugguguuugaacgagguucccucccacaaacgcggaaugauaagaccuucgcagcuucaaaaggcaaccgugggguccaggccuuuaguaagggaagcguucaggcagaccugacucuaauguucgacaauuuugagguggauuucguaggcgccgcugugucuugcgacgcggccuuucugaaccucacagggugcuacuccuguaacgcaggagcuagagucugccugucaaucaccaguacaggcacugguagccuuuccgcccauaauaaggaugggucuuugcacauagugcugccuucggaaaacggaaccaaagaccaaugucagaucuuacauuucacgguucccgagguggaggaagaguuuauguacagcugcgauggcgacgaaaggccacuccuggucaaggguacccuuauugccaucgauccguucgacgaucgccgggaggcuggcggggagucaacagugguuaauccuaaauccggaaguuggaacuuuuucgacugguucucuggccugaugagcugguuugggggacccuugaagacuauucuccugaucugucuauauguggcacuguccauaggccucuucuuucugcuuauuuacuuggguagaaccgggcugucaaaaaugugguuagccgcgacaaagaaggcuucuuga

SEQ ID NO: 11230 - RNA, 3480 nt, Artificial Sequence
  derived and/or modified CDS sequence (opt3) from RVFV(SA01-1322)__KX096942.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcggacguagaagggauacuaagcaaauaggccgggagacgauggcugguaucgccaugaccguacugcccgcacuagccguguucgcucucgcaccugucguguuugccgaagacccacaucugcgcaauagacccgggaaaggacacaacuauauugauggcaugacacaggaggacgcuacuuguaagccuguuaccuacgccggcgcguguucuucguucgaugugcuucuggagaaagggaaguuuccauuguuccagucauaugcacaccauaggacacuccuggaagccguccacgacaccaucauugcuaaagccgaucccccuagcugcgaccugcagagugcacacggaaauccaugcaugaaggagaagcucgugaugaaaacucauuguccgaacgauuaccaauccgcucacuauuuaaauaacgacgguaagauggccucuguaaaaugucccccuaaguacgaacugacagaggauugcaauuuuugccggcagaugaccggcgcgagccuuaaaaagggguccuauccauugcaggaccuguucugucagucaagugaagacgauggaagcaaacuaaagacgaagaugaaaggcguuugcgagguggguguccaagcccucaagaaaugcgacgggcagcugucuacugcacaugagguggugcccuuugcugucuucaagaacuccaaaaagguuuaccuugauaagcuggacuugaaaaccgaagagaaucuccugccugauucauuuguguguuucgaacacaagggacaguacaaaggcacaauggacagcggccagacuaagcgcgaguuaaaaaguuuugauaucucucaaugcccaaagauagggggacacgguuccaagaaauguaccggcgacgccgcuuucugcagcgccuaugaauguacagcacaguacgccaacgcuuuuugcucgcaugcgaaugggucuggaauuguacagauccaaguguccggcgucuggaagaaaccccuguguguggguuaugagcgaguuguggucaagagagagcucucagcaaaaccgauucagaggguggaaccuugcaccacguguaucacuaagugcgagccccacgggcuuguaguucggaguacaggcuucaagaucagcuccgccguggcuugugccucuggagucugcgugaccggcagccagucaccaaguacugaaauuacacugaaauacccugggauaucccagagcucuggaggugauaucggcguccauauggcacacgacgaucaaucagugaguagcaagauuguugcccauugucccccacaggaccccugcuuggugcacgggugcaucguaugugcucacggacuaauaaacuaucagugccauaccgcccuguccgcauucgucgugguuuuuguguucucuucgauugcgaucaucugucucgcuauucuguaccguguccuuaaaugccugaagaucgccccucgcaaaguguugaauccacucauguggauuacggcauuuauaagauggguauauaagaaaaugguggccaggguugcugacaacaucaaccaggucaaucgggagauuggcuggauggaaggugggcaacugguguuaggcgauccggcccccaucccucgacacgcaccaaucccccgcuacagcaccuaccugaugcuacuccugauuauauccuaugcuucagccuguagugagcuuauccaggcgucuagcagaauuacaacuugcuccaccgagggagugaacacaaaguguagguugucaggcacugcccugauccgggcugggagcgucggagcagaagccugccucaugcugaaggguguuaaagaggaccagaccaaguuccuuaaaauuaagacagugucuuccgaacugaguugucgcgagggccagagcuacuggaccgggucuuuuuccccuaaaugcuugucaaguagaaggugccaucucgugggagagugucacguaaaucguugccugagcuggcgggauaacgaaacuucggcugaguucuccuuugucggcgaaucuacgacaaugcgagagaauaaguguuucgaacaaugcgguggguggggcuguggaugcuuuaacgugaauccaagcuguuuauucguucacaccuaucugcagucagugagaaaggaggcccuaagggucuuuaacugcaucgacugggugcauaaacucacucuggagauaaccgauuucgacggcaguguuuccacaaucgaucuuggggcaucuagcucccgcuuuaccaauuggggaucagugagcuugagucuggacgcggaaggcauuucugguuccaacagcuucucguucaucgagucacccgggaagggauacgccauuguagaugaaccguuuucugagaucccucggcagggcuuccucggugaaauaagauguaauagugaguccagcguccugucugcucacgagagcugcuuaagggccccaaaccugauuuccuauaaacccaugaucgaccagcuugaauguacuacaaauuugauugauccuuuugugguguucgagcgcggcucacucccccaaacgcgaaacgaaaagaccuuugcagcuaguaaagggaaucggggaguccaggccuucagcaagggcucuguucaggcagaccugacucuaauguuugauaacuucgagguggacuuuguaggggccgcuguguccugcgacgcggccuuccugaaccucacaggaugcuacucauguaaugcaggcgcucgugucugccugaguaucaccagcacagguacugggacccuuuccgcccauaacaaggauggaucuuugcacauagugcugccaucggaaaauggcacgaaagaccaaugucagaucuuacauuuuaccguuccugagguggaggaagaguucauguauagcugcgauggugacgaaagaccccuccuggucaagggcacacuuauugccaucgauccauuugacgauaggcgcgaggcugggggagagucaacugugguuaacccgaaauccggcaguuggaauuucuucgacugguuuucugggcugaugagcugguucggaggcccuuugaagaccauucuccugaucugucuauacguggcacuguccauaggucucuuuuuccugcuuauuuacuuggggcggacaggacugucaaaaaugugguuagccgcgacuaagaaggcuucuuga

SEQ ID NO: 11231 - RNA, 3480 nt, Artificial Sequence
  derived and/or modified CDS sequence (opt3) from RVFV(Kenya 56 (IB8))__DQ380190.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaacaauaucacaugucacgguaaggacccugaagauaaaauuuccuuaaucaagggcccaccgcauaaaaagcaagucgggauaguucgcugcgagcgacguagagacgcuaagcagaucggaagggaaacuauggccggcauugcaaugacggugcugcccgcccuagcuguauucgcacucgccccuguggucuuugcugaggauccacaucugcggaaccgccccgguaaagggcacaauuauaucgacggaaugacccagggcgaugccacauguaagccugugacuuacgcgggcgcauguucuucguucgacguucuucuggagaaagggaaguuuccauuguuccagucauaugcccaccauagaacccuccuggaagcugugcacgauacaauuaucgccaaagcagaucccccuagcugcgaccugcaaagugcucacggaaacccaugcaugaaggagaagcucgucaugaaaacccauuguccgaaggacuaccaguccgcccacuauuuaaauaacgaugguaaaauggcgucugugaagugucccccuaaauacgaacugacugaggacugcaauuuuugcaggcagaugacaggcgccagccuuaagaaaggguccuauccauugcaggaccuguucugucaaucaagugaagaugacggaagcaagcuaaagaccaaaaugaagggcguaugcgagguuggugugcaggcacucaaaaagugcgaugggcagcugucuacggcucaugaggucgugcccuuugccguguucaaaaacuccaagaaggucuaccuugacaaacuggauuugaagacugaagagaaucuccugccugacucauuuguuuguuucgaacacaaaggacaguacaagggcaccauggauagcggccaaacaaaacgggaguuaaagaguuuugacauaucucagugcccaaagauugggggacacgguuccaaaaaguguacuggcgaugcugccuucugcagcgcauaugaauguaccgcccaguacgcuaacgcguauugcucgcaugcaaaugggucuggaaucgugcaaauucagguauccggcguguggaaacgcccccugugugucgguuacgagcgagugguugugaagagagagcucucagccaaaccgauccagagggucgaaccuugcacaaccuguaucacgaagugcgagccccacgggcuugugguacggaguacuggcuuuaagauuagcuccgcuguugccugugcaucuggagugugcgucacaggcagccagucaccaaguaccgaaauaacucugaaauauccugggaugucccaaagcucuggaggugacaucggcgugcauauggcccacgaugaccagucagucaguagcaagauuguggcucauugucccccacaggaccccugcuugguucacgggugcaucgugugugcccacggacuaauaaacuaccagugccauacagcacuguccgcguucguagucguguucguguuuucuucgguugcuauuaucugucucgccauccuguauaaaguccuuaagugccugaaaauugcaccucguaagguguugaauccacucauguggaucaccgccuucauucgcuggguauacaaaaagaugguggcuagaguugccgauaacauaaaucaagucaacagggagaucggcuggauggaaggugggcagccggcacugggcaaccccgcuccuauuccacggcacgcccccaucccucgauacagcacguauuuaaugcugcuacucaucguguccuacgcgucagccuguagugagcugauucaggcuucuagccgcauaaccacaugcuccacugagggagugaauaccaaguguagacuuucaggcacagcauugaucagggccgggagcgucggagcugaagccugccugaugcucaaagguguuaaggaggaccagacuaaauuucugaagauuaaaaccgugucuuccgaacuuaguugucgggagggccaaagcuauuggacagggucuuucuccccaaagugccugucaagucgcagaugccauuuggugggagagugucacguaaacaggugccucagcuggcgugauaaugaaaccucggcagaguuuuccuucgucggcgaaucuacuacgaugcgggagaacaaguguuuugaacagugcgguggguggggcuguggaugcuucaaugugaaccccagcugucuguuuguucacacauacuuacagucagugcgaaaagaggcgcugagagucuucaauugcaucgacugggugcauaagcuaacccucgagauuacugauuuugacggcaguguuuccaccaucgaucugggggccucuagcuccagguucacaaacuggggaucagugagccuuaguuuggacgcugaaggcauaucugguuccaauagcuuuucguucaucgagucaccggggaaaggauaugccauuguagaugaaccuuucucugagaucccacgccagggcuuucugggugaaauucgguguaacagugaguccagcguccucucugcacacgagagcugccugagagcucccaauuuaaucuccuacaagccuaugauagaccaacuggaauguaccacuaaccuuauugaucccuucguggccuuugagaggggcucauugccacagacacgcaaugacaaaacguucgcagccaguaaggggaaccgaggagugcaggcuuuuagcaagggcucuguccaagcggaucucacccugauguucgacaauuuugaaguugacuucgugggggccgcaguauccugcgaugcugccuuucuaaaccugacuggaugcuauucauguaacgccggcgcucgggugugccucaguaucacaagcaccgguacagggacucuguccgcacauaauaaagacggaucucuucacauugucuugccuucggagaacggcaccaaggaucagugucagauccugcauuucacggugcccgaaguugaggaggaauuuauguacagcugcgacggugaugagcguccauuacucgugaaaggcacccugauagccaucgacccguucgaugacagaagggaagcugggggagagucaacagucgugaauccuaaguccggcaguuggaacuuuuucgauugguucucugggcuuaugagcugguuuggaggcccccugaaaacuauuuugcucaucugucuguacguugcgcuauccauuggucuguucuuucuccugaucuaucuugggcgcaccggauugucaaagauguggcuggccgcaacaaagaaagccucuuga

SEQ ID NO: 11232 - RNA, 3480 nt, Artificial Sequence
  derived and/or modified CDS sequence (opt3) from RVFV(KEN/Mal-032/07)__HM586967.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaggcuucaggaggacgccaccuguaagccuguuacauacgcgggcgcauguucuucguucgaugugcuguuggaaaaaggcaaguuuccacucuuccagucauaugcccaccaucggacucugcuggaggcuguccacgacaccaucauugccaaagcagaucccccuagcugcgaccuccagagugcugaugggaauaagugcaugaaggaaaaauuagugaugaagacacacuguccaaacgacuaccaauccgcccauuaucugaauaacgauggaaaaauggcgucuguaaagugcccgcccaaauacgagcuuaccgaagacuguaauuuuugccgccagaugacuggugccagcuugaagaaaggcuccuauccucugcaggaccuauucugucagucaagugaggaugacgggagcaagcucaagacaaaaaugaagggaguuugcgaggugggcguccaagcacugaaaaagugcgauggucagcuuucuaccgcucacgaaguggugccauuugccgucuucaaaaacuccaagaagguuuaccuggacaaauuggaucucaagacggaggaaaaucuguuacccgacucauuuguguguuucgagcauaaagggcaguacaagggaacuauggauagcggccagaccaaacgagaacugaagaguuuugacaucucucaaugcccuaagauaggcgggcacggauccaaaaaguguacaggugaugcugccuucugcagcgcauaugaguguacugcccaguacgcuaacgcguauugcucgcacgcaaauggcucugggauuguacagauccaaguguccggagucuggaaaaagccacucugugugggcuacgagagaguuguggucaaaagggaacuuucagccaagcccauucagcggguggagccgugcaccacauguaucaccaagugcgaaccucauggucugguaguucguaguacgggguuuaaaaucagcuccgcuguggccugugcaucuggcgucugcgugacuggaagccagucacccaguacagagauuaccuugaaguauccaggcauaucccagagcucugggggagacaucgguguccacauggcccaugaugaccaaucagugaguagcaaaauuguugcucacugcccuccccaggacccaugucuagugcauggcugcaucguaugugcccacgggcugauaaacuaccagugccacacugcacucuccgcguucgucgugauuuucguguuuucuucgacagcuaucaucugucuggccguucuuuaucgcguccugaagugcuugaaaauugcacccagaaaggugcucaauccucugauguggaucaccgccuucauuagguggguauacaaaaagaugguggcucggguugccgauaacauaaaccaggucaaucgagaaaucggauggauggagggcggucaauuagcacuggggaacccagcuccgauuccccgccaugccccuaucccaagauacagcacguaucuaaugcuccugcuuaucguguccuacgcgucagccuguagugaguugauucaggcuucuagcaggauaaccacaugcuccacugaaggcgugaauaccaagugucggcugucaggaacagcacucauccgcgccggcagcgucggggcugaggccugccugaugcuuaaaggaguuaaggaagaccagacuaaauuucugaagauuaaaaccgugucuuccgaguugaguuguagagagggucagagcuauuggacaggcucuuucucccccaagugccucucaaguaggcguugccaccuggugggggaaugucauguaaaccggugcuuaagcuggcgagauaaugagaccucggcagaauuuuccuucgucggagagucuacuacgaugagagaaaacaaguguuuugagcaaugcggcgguuggggguguggcugcuucaaugugaacccuagcugucuguuuguucacacauaccuacagucagugaggaaagaggcgcuccgcgucuucaauugcaucgacugggugcacaagcugacccuugaaauuacugauuuugacggaaguguuuccaccaucgauuugggcgccucuagcucccgguucacaaacugggggucagugagccugagucucgacgcugagggaauaucuggcuccaauagcuuuucguucaucgaaucaccagguaaaggguaugccauuguagaugagcccuucucugaaaucccgagacagggauuucugggcgagauuagguguaacagugaguccagcgucuuaucugcacaugaaagcugccugcgcgcuccuaaucuuguguccuacaagccaaugaucgaccaguuggaguguaccacuaaccucauagaucccuucguggucuuugaacgagguucacugccucaaacacggaaugacaaaacguucgccgcaaguaagggcaaccgugggguucaggccuuuagcaagggaucugugcaggcugaucuaacccugauguucgacaacuuugagguagacuucgugggcgcggccgucuccugcgaugcagcuuuucucaaucugacugggugcuauucauguaacgccggagccagagugugccuuaguauuacaagcaccggcacagguacuuuguccgcucacaauaaagacgggucucugcauaucguuuuacccucggaaaacggaaccaaggaucaaugucagauucuccacuucacggugccagaggucgaggaagaguuuauguacagcugcgacggcgaugaaaggccucugcuugugaaagguacccugaucgcaauagaccccuucgaugaccgccgggaggccggcggggagucaacaguugugaauccaaaguccggaaguuggaacuuuuucgauugguucucuggcuugaugagcugguuugggggaccgcucaaaacuauccugcuaauuugucuguacgucgcgcucuccaucggccuguucuuucuuuugauuuaucuggguagaaccggguuaucaaagauguggcucgcugccacaaagaaagcaucuuga

SEQ ID NO: 11233 - RNA, 3480 nt, Artificial Sequence
  derived and/or modified CDS sequence (opt3) from RVFV(KEN/Gar-008/06)__HM586965.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcauguucuucguucgaugugcuucuggaaaaaggcaaguuuccauuguuccagucauaugcccaccauaggacccuccuggaggcuguccacgacacaaucauugccaaagcagaucccccuagcugcgaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggauccaagaaauguacuggugacgcugccuucugcagcgcauaugaguguaccgcccaguacgcuaacgcguauugcucgcaugcaaauggcucugggauuguacagauccaagugucccgagucuggaagaaaccccugugugugggauacgagagaguuguggucaagagggaacucucagccaaaccgauucagcggguggagccuugcacaaccuguaucacgaagugcgaaccccacggccuuguaguucguaguacugguuuuaagaucagcuccgcuguggccugugcaucuggggucugcgugacaggcagccagucaccaaguaccgagauuacucugaaauauccuggaauaucccagagcucuggcggggauaucggaguccauauggcccacgacgaucaaucagugaguagcaagauuguugcucauugucccccacaggaccccugcuuggugcacgguugcaucguaugugcccacggccuaauaaacuaccagugccauacagcacuguccgcguucgucgugauuuucguguuuucuucgaccgcuaucaucugucucgccguucuguaucgcguccuuaaaugccugaagauugcaccuagaaaaguguugaauccacucauguggaucacggccuucauuagguggguauacaagaaaaugguggcucggguugccgacaacauaaaccaggucaaucgagaaaucggguggauggagggaggccaacuggcauuagguaacccggcucccauuccucgccacgccccaauccccagauacagcaccuaucugaugcuacuccugaucguguccuacgcgucagccuguagugagcuuauucaggcuucuagcaggauaacaacuugcuccaccgaaggggugaauacaaagugucgguugucaggcacugcacugauccgcgccggaagcgucggcgcugaggccugccucaugcugaaggggguuaaagaagaucagaccaaguuucuuaaaauuaagacagugucuuccgagcugaguuguagagagggacagagcuauuggaccgguucuuucuccccuaaaugcuugucaaguaggcguugccaucucgugggcgaaugucacguaaaccggugccugagcuggcgagacaaugagacuucggcagaauuuuccuucgucggggagucuacgacaaugagagaaaacaaguguuuugagcaaugcggaggcugggguugugggugcuucaaugugaacccaagcuguuuauuuguucacaccuaccugcagucagugaggaaggaggcgcuacgcgucuucaauugcaucgauugggugcauaaacucacucuggaaauuaccgacuuugauggcaguguuuccacaaucgaccuuggagccucuagcucccgguucaccaacuggggcucagugagcuugagucuggaugcugaggggauaucuggauccaauagcuuuucguucaucgaaucacccggcaaggguuaugccauuguagacgagccguucucugaaaucccuagacagggguuucucggagagauuagguguaacagugaguccagcguccugucugcacacgaaagcugcuuacgcgcuccaaaucugguguccuacaaacccaugaucgaucagcuugaguguacuacaaacuugauagacccuuucguggucuuugaacgaggcucacucccccaaacgcggaaugauaagaccuucgccgcaaguaaagguaaccguggcguucaggccuuuagcaaggggucugugcaggcugaccugacucuaauguucgauaaccugaagguagacuuugugggagcggccgucuccugcgacgcagcuuuccucaaucugacaggcugcuauucauguaacgccggggccagagugugccuuaguauuaccagcacaggaacuggcaccuuguccgcucauaauaaagaugguucucugcacaucguuuuaccaucggagaacgggacgaaggaccaaugucagauucuccauuuuaccgugccugaagucaaagaggaguucauguacagcugcgauggagacgaaagggcacugcuuaugaagggcacacugaucgccauagaucccuuugacgaucgccgggaggcggguggcgaaucaacugugguuaauccaaaauccgggaguuggaacuucuuugacugguucucuggauugaugagcugguucggcgggccgcucaagaccauccugcuaauuugucuguacguggcucucuccaucggacuguuuuuccuuuugauuuaucugggcagaacagguuuaucaaagauguggcucgccgcaacuaaaaaggccucuuga

SEQ ID NO: 11234 - RNA, 3480 nt, Artificial Sequence
  derived and/or modified CDS sequence (opt3) from RVFV(Beijing-01)__KX611606.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaaucauugccgcggauggauugaacaauaucacaugucacgguaaggacccugaagauaaaauuuccuuaaucaagggcccaccgcauaaaaagcgcgucgggauaguucgaugcgagcguagaagggacgcuaagcaaaucggacgggaaacuauggccggcauugcaaugacggugcugcccgcccuagcuguauucgcacucgccccuguggucuuugcugaggauccacaucugcgcaacagacccgguaaagggcacaauuauaucgacggagugacccaggaggaugccacauguaagccuguuacuuacgcgggcgcauguucuucguucgacgugcuucuggaaaaaggcaaguuuccauuguuccagucauaugcccaccauaggacccuccuggaggcuguccacgauacaauuaucgccaaagcagaucccccuagcugcgaccugcagagugcucacgggaacccaugcaugaaggaaaagcucgugaugaaaacccauuguccgaaugacuaccaauccgcccacuauuuaaacaaugauggaaagauggcgucuguaaaaugucccccuaaguacgagcugacugaagacugcaacuuuugccggcagaugacaggugccagccuuaaaaagggcuccuauccauugcaggaccuguucugucagucaagugaggaugacgggagcaaacuaaagaccaagaugaaaggaguuugcgaggugggcguccaagcacucaagaaaugcgauggucgccugucuacggcucaugaaguggugcccuuugccgucuucaaaaauuccaagaagguuuaccuugacaagcuggauuugaaaacugaggaaaaccuccugccugacucauuuguguguuucgagcacaaggggcaguacaaaggaaccauggauagcggccagacaaagcgagaauuaaaaaguuuugacauaucucagugcccaaagauuggcgggcacggauccaagaaauguacuggugaugcugccuucugcagcgcauaugaguguaccgcccaauacgcuaaugcguauugcucgcaugcaaacggcucugggaucguacagauucagguguccggagucuggaagaaaccccugugugugggcuacgagagaguuguggucaagagggaacucucagccaaaccgauccaacggguggagccuugcacaaccuguaucacgaagugcgaaccccacggucuuguaguucguaguacuggguuuaagauuagcuccgcuguggccugugcaucuggcgucugcgugacaggaagccagucaccaaguaccgagauaacucugaaauauccuggcaucucccagagcucugggggagacauugguguccauauggcccacgaugaccagucagugaguagcaagaucguuuucgacugucccccacaagaucccugcuuggugcauggcugcauaguaugugcucacgggcuaauuaauuaccagugccacacagcccuguccgcauucgucgugguuuuuguguucucuucggucgcgaucaucugucucgcuauucuguauaaagugcuucgcugccugaagaucgccccuaaaaagguauugaacccacucauguggauuaccgcauuuauaagauggguguacaaaaagaugguugccagggucgcugacaauaucaaccaggugaaccgggaaauuggauggauggagggcggucagcuggccuuagggaauccggcacccaucccucgacaugcuccaaucccccgcuacagcacguaucugaugcuacuccugauuauauccuacgccucagcguguagugagcuuauccaagccucuagcagaauuaccacaugcuccacugaaggcgugaacaccaaguguagguugucaggaacagcucugauccgggcaggcagcgucggggccgaggcuugccucauguucgaaggaguuaaagaggaucagacuaaguuucugaaaauuaagaccgugucuuccgagcuuaguugucgcgaaggucagagcuauuggacaggcucuuucuccccuaaaugccugucaaguagaaggugccacuuggugggggagugucauguaaaucguugccucagcuggcgggacaacgaaaccucggccgaguuuuccuucgucggagaaucuacuacgaugcgagagaauaaguguuuugagcagugcggcgguuggggguguggcugcuucaacgugaauccaagcugucuguuuguucacacauacuuacaaucagugagaaaggaagcacugagggucuucaacugcaucgauugggugcacaaacuaacccucgagauaacugacuuugauggaaguguuuccaccaucgaccugggcgcgucuagcucccgcuucacaaauugggggucagugagccuuaguuuggaugccgaaggaauuucuggcuccaacagcuucucguuuaucgagucacccgguaagggguaugcuauuguagacgaaccguucucugagaucccucggcagggauuucugggcgagauaagauguaauagugaauccagcguccucucugcccaugagagcugccugagggcaccaaacuuaauuuccuacaaacccaugaucgaucagcuggaauguaccacuaaucuuauugacccuuucgugguguuugagcgcgguucauugccccagacacgaaacgauaagacguucgcugccaguaaaggcaaucgugggguccaagcauuuagcaagggaucuguucaggccgaccucacccugauguucgacaacuuugaaguggauuucguaggcgcugcgguguccugcgacgccgcauuucuaaaccugacugggugcuauucauguaaugcuggagcccgggucugccucaguaucacaagcaccggcacagguacucuguccgcccacaacaaggaugggucucuucauauaguguugccaucggagaauggaaccaaagaccagugucaaauccugcacuucacgguuccugagguggaagaggaauuuauguacagcugcgauggcgacgagagacccuuacucgucaaggguacccugauugcuaucgauccauucgacgauaggcgcgaggcaggcggggaaucaacagugguuaacccgaaauccggaaguuggaauuucuuugacugguucucuggccuuaugagcugguuugggggaccucugaagacuauuuugcucaucugucuguacguggcccuauccauaggccuguucuuucuccugauuuaucuuggucggaccggguugucaaaaauguggcuggcggcuacaaagaaggccucuuga

SEQ ID NO: 11235 - RNA, 3480 nt, Artificial Sequence
  derived and/or modified CDS sequence (opt3) from RVFV(KEN/Bar-035/07)__HM586969.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaggcuucaggaggacgccaccuguaagccuguuacauacgcgggcgcauguucuucguucgaugugcuguuggaaaaaggcaaguuuccacucuuccagucauaugcccaccaucggacucugcuggaggcuguccacgacaccaucauugccaaagcagaucccccuagcugcgaccuccagagugcugaugggaauaagugcaugaaggaaaaauuagugaugaagacacacuguccaaacgacuaccaauccgcccauuaucugaauaacgauggaaaaauggcgucuguaaagugcccgcccaaauacgagcuuaccgaagacuguaauuuuugccgccagaugacuggugccagcuugaagaaaggcuccuauccucugcaggaccuauucugucagucaagugaggaugacgggagcaagcucaagacaaaaaugaagggaguuugcgaggugggcguccaagcacugaaaaagugcgauggucagcuuucuaccgcucacgaaguggugccauuugccgucuucaaaaacuccaagaagguuuaccuggacaaauuggaucucaagacggaggaaaaucuguuacccgacucauuuguguguuucgagcauaaagggcaguacaagggaacuauggauagcggccagaccaaacgagaacugaagaguuuugacaucucucaaugcccuaagauaggcgggcacggauccaaaaaguguacaggugaugcugccuucugcagcgcauaugaguguacugcccaguacgcuaacgcguauugcucgcacgcaaauggcucugggauuguacagauccaaguguccggagucuggaaaaagccacucugugugggcuacgagagaguuguggucaaaagggaacuuucagccaagcccauucagcggguggagccgugcaccacauguaucaccaagugcgaaccucauggucugguaguucguaguacgggguuuaaaaucagcuccgcuguggccugugcaucuggcgucugcgugacuggaagccagucacccaguacagagauuaccuugaaguauccaggcauaucccagagcucugggggagacaucgguguccacauggcccaugaugaccaaucagugaguagcaaaauuguugcucacugcccuccccaggacccaugucuagugcauggcugcaucguaugugcccacgggcugauaaacuaccagugccacacugcacucuccgcguucgucgugauuuucguguuuucuucgacagcuaucaucugucuggccguucuuuaucgcguccugaagugcuugaaaauugcacccagaaaggugcucaauccucugauguggaucaccgccuucauuagguggguauacaaaaagaugguggcucggguugccgauaacauaaaccaggucaaucgagaaaucggauggauggagggcggucaauuagcacuggggaacccagcuccgauuccccgccaugccccuaucccaagauacagcacguaucuaaugcuccugcuuaucguguccuacgcgucagccuguagugaguugauucaggcuucuagcaggauaaccacaugcuccacugaaggcgugaauaccaagugucggcugucaggaacagcacucauccgcgccagaagcgucggcgcugaggccugccugaugcuuaaagggguuaaggaagaccagacuaaauuucugaagauuaaaaccgugucuuccgaguugaguuguagggagggacagagcuauuggacagguucuuucucccccaagugccucucaagucgucggugccaccuggugggcgaaugucauguaaaccgaugcuuaagcuggagagauaaugagaccucggcagaauuuuccuucgucggggagucuacuacgaugagggaaaacaaguguuuugagcaaugcggaggcugggguugugggugcuucaaugugaacccuagcugucuguuuguucacacauaccuacagucagugcgcaaagaggcgcuccgggucuucaauugcaucgacugggugcacaagcugacccuugaaauuacugauuuugacggcaguguuuccaccaucgauuugggagccucuagcuccagauucacaaacuggggcucagugagccugagucucgacgcugaggggauaucuggauccaauagcuuuucguucaucgaaucaccaggcaaagguuaugccauuguagaugagcccuucucugaaaucccgaggcagggguuucugggagagauucgcuguaacagugaguccagcgucuuaucugcacaugaaagcugccugcgagcuccuaaucuuguguccuacaagccaaugaucgaccaguuggaguguaccacuaaccucauagaucccuucguggucuuugaacggggcucacugccucaaacacguaaugacaaaacguucgccgcaaguaaggguaacagaggcguucaggccuuuagcaaggggucugugcaggcugaucuaacccugauguucgacaacuuugagguagacuucgugggagcggccgucuccugcgaugcagcuuuucucaaucugacuggcugcuauucauguaacgccggggccagggugugccuuaguauuacaagcaccggaacaggcacuuuguccgcucacaauaaagacgguucucugcauaucguuuuacccucggaaaacgggaccaaggaucaaugucagauucuccacuucacggugccagaggucgaggaagaguuuauguacagcugcgacggagaugaacgcccucugcuugugaaaggcacccugaucgcaauagaccccuucgaugaccggagagaggccgguggcgagucaacaguugugaauccaaaguccgggaguuggaacuuuuucgauugguucucuggauugaugagcugguuuggcgggccgcucaaaacuauccugcuaauuugucuguacgucgcgcucuccaucggacuguucuuucuuuugauuuaucugggcaggaccgguuuaucaaagauguggcucgcugccacaaagaaagcaucuuga

SEQ ID NO: 11236 - RNA, 3480 nt, Artificial Sequence
  derived and/or modified CDS sequence (opt3) from RVFV(KEN/Bar-032/07)__HM586968.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaacaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaggcuucaggaggacgccaccuguaagccuguuacauacgcgggcgcauguucuucguucgaugugcuguuggaaaaaggcaaguuuccacucuuccagucauaugcccaccaucggacucugcuggaggcuguccacgacaccaucauugccaaagcagaucccccuagcugcgaccuccagagugcugaugggaauaagugcaugaaggaaaaauuagugaugaagacacacuguccaaacgacuaccaauccgcccauuaucugaauaacgauggaaaaauggcgucuguaaagugcccgcccaaauacgagcuuaccgaagacuguaauuuuugccgccagaugacuggugccagcuugaagaaaggcuccuauccucugcaggaccuauucugucagucaagugaggaugacgggagcaagcucaagacaaaaaugaagggaguuugcgaggugggcguccaagcacugaaaaagugcgauggucagcuuucuaccgcucacgaaguggugccauuugccgucuucaaaaacuccaagaagguuuaccuggacaaauuggaucucaagacggaggaaaaucuguuacccgacucauuuguguguuucgagcauaaagggcaguacaagggaacuauggauagcggccagaccaaacgagaacugaagaguuuugacaucucucaaugcccuaagauaggcgggcacggauccaaaaaguguacaggugaugcugccuucugcagcgcauaugaguguacugcccaguacgcuaacgcguauugcucgcacgcaaauggcucugggauuguacagauccaaguguccggagucuggaaaaagccacucugugugggcuacgagagaguuguggucaaaagggaacuuucagccaagcccauucagcggguggagccgugcaccacauguaucaccaagugcgaaccucauggucugguaguucguaguacgggguuuaaaaucagcuccgcuguggccugugcaucuggcgucugcgugacuggaagccagucacccaguacagagauuaccuugaaguauccaggcauaucccagagcucugucggggacaucggagugcacauggcccaugaugaccaaucaguuaguagcaaaauuguggcucacugcccuccccaggacccaugucuaguacaugguugcaucgucugugcccacggccugauaaacuaccagugccacacugcacucuccgcguucgugguuauuuucguguuuucuucgacagcuaucaucugucuggccguccuuuaucgcgugcugaagugcuugaaaauugcacccagaaagguacucaauccucugauguggaucaccgccuucauuagguggguguacaaaaagaugguugcucgggucgccgauaacauaaaccaggugaaucgagaaaucggguggauggagggaggccaauuagcacuggguaacccagcuccgauuccccgccaugccccuaucccaagauacagcacguaucuaaugcuccugcuuaucguguccuacgcgucagccuguagugaguugauucaggcuucuagcaggauaaccacaugcuccacugaaggggucaauaccaagugucggcugucacacacagcacucauccgcgccggcagcguuggagcugaggccugccugaugcuuaaaggcgugaaggaagaccagacuaaauuucugaagauuaaaaccgugucuuccgaguugaguuguagagaggggcagagcuauuggacaggaucuuucucccccaagugccucucaaguaggcguugccaucugguaggugaaugucacgucaaccggugcuuaagcuggcgagauaaugagaccucggcagaauuuuccuucgugggcgagucuacuacgaugagagaaaacaaguguuuugagcaaugcgggggauggggcugugguugcuucaauguuaacccuagcugucuguuugugcacacauaccuacagucagucaggaaagaggcgcuccgcguguucaauugcaucgacuggguucauaagcugacccuugaaauuacugauuuugacgggaguguguccaccaucgauuugggcgccucuagcucccgguucacaaacuggggaucaguaagccugagucucgacgcugagggcauaucuggguccaauagcuuuucguucaucgaaucaccaggaaaaggcuaugccauugucgaugagcccuucucugaaaucccgagacaggguuuucugggggagauuagguguaacagugaguccagcguguuaucugcacacgaaagcugccugcgcgcuccuaaucuuguguccuacaagccaaugaucgaccaguuggaguguaccacuaaccucauagaucccuucgucguuuuugaacgaggaucacugccucaaacacggaaugacaaaacguucgccgcaaguaagggcaaccguggugugcaggccuuuagcaagggcucuguacaggcugaucuaacccugagauucgacaacuuugagguggacuucgucggggcggccguguccugcgaugcagcuuuucucaaucugacuggaugcuauucauguaacgccggcgccaggguuugccuuaguauuacaagcaccgggacaggaacuuuguccgcucauaauaaagacggcucucugcacaucguguuacccucggaaaacgguaccaaggaucaaugucagauucuccauuucacggucccagagguggaggaagaguuuauguacagcugcgacggggaugaacgcccucugcuuguuaaaggaacccugaucgcaauagaccccuucgaugaccggagagaggccggcggugagucaacaguggucaauccaaaguccggcaguuggaacuuuuucgauugguucucuggguugaugagcugguuuggaggcccgcucaaaacuauccugcuaauuugucuguacguagcgcucuccaucgggcuguucuuucuuuugauuuaucugggaaggaccggcuuaucaaagauguggcucgcugccacaaagaaagcaucuuga

SEQ ID NO: 11237 - RNA, 3480 nt, Artificial Sequence
  derived and/or modified CDS sequence (opt3) from RVFV(TAN/Dod-002/07)__HM586971.1__NSm-Gn-Gc
augaucgagggcgccugggacagccugagagaagaggaaaugcccgaggaacucuccugcucugugucagggauuagggaggucaagaccaguagccaggagcuuuaccgggcucugaaagcaauaaucgccgcggauggauugaauaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcauguucuucguucgaugugcuucuggaaaaaggcaaguuuccauuguuccagucauaugcccaccauaggacccuccuggaggcuguccacgacacaaucauugccaaagcagaucccccuagcugcgaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacuccaaaaagguuuaccuugauaagcuggacuugaaaacugaggaaaaucuccugccugauucauuuguguguuucgagcacaaggggcaguacaaaggaaccauggacagcggccagacaaagcgcgaauuaaaaaguuuugauaucucucaaugcccaaagauaggcgggcacggacgaaagaaauguacuggugacgcugccuucugcuccgcauaugaguguaccgcccaguacgcuaacgcguauugcagccaugcaaauggcucggggauuguacagauccaagugucuggagucuggaagaaaccccugugugugggcuacgagagaguuguggucaagagggaacucuccgccaaaccgauucagcggguggagccuugcacaaccuguaucacgaagugcgaaccccacggucuuguaguucguucaacuggguuuaagaucaguagcgcuguggccugugcauccggcgucugcgugacaggaucucagagcccaucaaccgagauuacucugaaauauccuggcauaagucaguccagcgggggagauaucgguguccauauggcccacgacgaucaaucugugucaaguaagauuguugcucauugucccccacaggaccccugcuuggugcacggcugcaucguaugugcccaggcauggauaauuagccaguggcacacagcgcuauccgcuuucgucgugaucuucguguuuucuucgaccgccaucauuugccuggcaguucucuaccgcguccugaaaugucuuaagaucgccccuagaaaagugcugaacccauugauguggauuacggcuuucauaagguggguauauaagaaaaugguggcccggguugcagacaauaucaaccaagucaaccgagaaauuggguggauggagggaggccagcucgcucuggguaauccggcccccaucccucgccaugcgccaauccccagauacagcaccuacuuaaugcugcuacucauuguguccuaugccucagcuugcagugagcugauacaggcaucuagcaggaucacaacuuguuccaccgaaggggugaacacaaagugccggcuuucaggcacugccuugauucgcgcuggaagcgucggcgccgaggcaugucugaugcucaaggggguuaaagaagaucagaccaaguuucugaaaaucaagacagugucuuccgagcuuaguugcagagagggacaaagcuacuggaccgguucuuucuccccuaaaugucugucaaguaggcguugccacuuggugggcgaaugccauguaaaucggugucucagcuggcgagacaacgagacuucggcggaauuuuccuucgucggggagucuacgacaaugagagaaaauaagugcuuugagcaguguggaggcugggguugcggguguuucaacgugaauccaagcugccuguuuguucacaccuauuuacagucagugaggaaggaggcccugcgcgucuucaacuguauugauugggugcacaaacuaacucucgaaaucaccgacuuugauggcaguguuuccacaauagaccugggagcuucuagcucccgguucaccaauuggggcucagugagccuuaguuuggaugccgaggggaucucuggauccaacagcuuuucguucauugaaucacccggcaaggguuacgcaaucguagacgagccguucucugaaauuccuagacagggguuucugggagagaucaggugcaauagugaguccagcguccucucugcucaugaaagcugucugcgcgccccaaacuuaguguccuauaaacccaugauagaucaacuggagugcacuacaaaucuuauugacccuuucguggucuuugaacgaggcucauugccccagacgcggaacgauaagaccuucgcagccaguaaagguaaucguggcguucaggcuuuuagcaaggggucugugcaagcggaccucacucugauguucgauaacuuugagguagacuucgugggagccgcagucuccugugacgcugccuuucuaaaccugacaggcugcuacucaugcaaugccggggcuagagugugucucaguaucaccagcacaggaacuggcacccuguccgcacacaacaaggaugguucucuucauauuguuuugccaucggaaaaugggacgaaagaccagugccagauccugcacuucaccgugccugaggucgaggaagaguuuauguauagcugugauggagacgaaaggcccuuacucgugaagggcacacugauagccaucgauccauucgacgaucgccgggaggcggguggcgagucaacuguugugaacccgaaauccgggaguuggaacuuuuucgacugguucucuggacuuaugagcugguuuggcgggccucugaagaccauuuugcucaucugccuguacgucgcucuauccauuggacuguucuuucuccugaucuaccuuggcagaacagguuugucaaaaauguggcuggccgcaacuaagaaggccucuuga

SEQ ID NO: 11238 - RNA, 3480 nt, Artificial Sequence
  derived and/or modified CDS sequence (opt3) from RVFV(Smithburn)__DQ380193.1__NSm-Gn-Gc
augaucgagggcgccugggacagccugagagaagaggaaaugcccgaggaacucuccugcucuauuucagggauaagggaggugaagaccaguagccaggagcuuuaccgggcucugaaagcaacaaucgccgcggauggauugaacaauauuacuugucacgguaaggacccugaagauaaaaucuccuuaauuaagggcccaccgcauaaaaagcgcgucgggguugugcgaugcgagcgucaaagagacgcuaagcagaucggaaggggcacgauggccgguauagcaaugaccguauuccccgcccugguggucuuugcucuagcaccugugguuuucgccgaagauccacaccuccggaaccgccccgggaaaggacauaauuauaucgacggcaugacacaggaggaugcuacuuguaagccugugaccuacgccggcgcguguucuucguuugacguccugcuugagaaagggaaguucccacuguuucagucauaugcacaccauagaacauugcucgaagccgugcacgauauuaucauugcuaaagccgaucccccuagcugcaaccugcaaagugcacacggaaauccaugcaugaaggagaagcugguaaugaaaaccuacuguccgaacgacuaucaguccgcucauuaccucaauaacgacgguaagauggccucuguuaaaugucccccuaagcacgaauuaacugaggauugcaauuucugcaggcagaugacaggcgcgagccugaaagaaggguccuauccacuucaggacuuguuuugucaaucaagugaggacgauggaagcaagcugaaaaccaagaugaagggcgugugcgaggucgguguccaggugcuaaagaagugcgacgggcagcucucuacggcccaugaagugguucccuucgcaguguuuaaaaacuccaagaaaguauaccuggauaaacuugaccugaagacugaggaaaauuugcucccugauucauucguguguuuugagcacaaaggacaguacaagggcaccauggacagcggccaaaucaaacgggaacugaagaguuucgauauaucucagugcccaaaaauugggggacacgguuccaagaaguguacaggcgacgcugccuuuugcagcgcuuaugaguguacugcccaguacgcaaacgccuauugcucgcaugcuaaugggucuggaaucguccaaauucagguguccggcguuuggaaaaagcccuuauguguggguuacgagcgcgucgugguaaaacgagaacugucagcgaagccgauccagagaguugagccuugcaccacauguaucaccaaaugcgaaccccacgggcucguggucaggaguacgggcuucaagauuagcuccgcaguggccugugcuucuggagucugcgugacuggcagccagucaccaaguacagagauaacccuuaaguauccugggaucucccaaagcucuggaggugauauuggcguucauauggcccacgacgaucagucagugaguagcaaaaucguagcacauugucccccacaggaccccugccugguccacgggugcauagugugugcccacggauugauuaacuaccagugccauacugcuuucuccgccuuuguuguggucuucguguuuucuucgguagugaucaucugucuagcaauucuguauaagguucucaaaugccugaagaucgcgccucggaaaguccuuaauccacugauguggauuacagcuuucauacguuggguguacaagaaaaugguggcccgcgucgcagacaacaucaaccaaguuaauagagaaauuggcuggauggagggugggcaguuggugcucggcaacccggcccccaucccuaggcacgcuccaaucccccgguacagcaccuaucugauguuacugcuaauuguguccuacgccucagcauguagugagcucauacaggcuucuagccgaaucacgaccugcuccacagaaggaguaaauacuaagugucgccugucaggcaccgcccuuauuagagcggggagcgucggagccgaggcuugcuugaugcugaagggugugaaagaagaucagacaaaguuucucaaaaucaagacuguuucuuccgagcugaguuguagggagggccaaagcuauuggaccgggucuuucuccccuaaaugccuuucaagucggcgcugccaucuggugggagaaugucacgucaacagaugcuugagcuggagggacaaugagacaucggcagaauuuuccuucgugggcgagucuaccacuaugcgugaaaacaaguguuuugagcagugcgguggguggggcuguggaugcuucaauguuaacccaagcugucucuuugugcacacguaccugcagucaguacggaaggaggccuuacgagucuucaauugcauugauugggugcauaaacugacacuagaaaucaccgacuuugauggcaguguguccacugucgaccucggggcuucuagcuccagauucaccaacuggggaucaguuagccugagucuugaugccgagggcauaucugguuccaauagcuucucguuuaucgaaucacccgggaagggauaugcaauuguggacgagccguucucugaaaucccuaggcagggcuuuuugggugagauucgcuguaacagugaguccagcguacugucugcgcacgaaagcugccuccgggccccaaaucugaucuccuacaaacccaugauagaucaauuagaguguacaaccaaccugauugacccuuucguggucuuugaaagaggcucacuuccccagacuaggaaugauaagacauucgcugccaguaaagggaaccgcggagugcaggcauuuagcaagggcucuguucaagcugacuugacgcucauguucgauaacuuugagguggacuucgucggggccgcaguguccugcgacgccgcuuuucugaaucuaaccggaugcuauucauguaacgcgggcgcccgaguuugccugaguaucacuagcacagguaccgggacacucuccgcacauaauaaggauggaucucugcacauugugcuuccaucggaaaacggcacuaaagaccagugucagaucuugcauuucaccgucccugagguagaggaagaguuuauguacagcugcgauggugacgaacggccccuguuagugaagggcacgcucauagcuaucgauccauucgacgaucguagagaggccgggggagagucaaccguugugaauccgaaauccggcaguuggaacuucuuugacugguucucugggcugaugagcugguuuggaggcccucuuaagacaauucuguugaucugucucuacgucgcccuguccauuggucuauucuuuuuccugaucuaucucgggaggacuggacugucaaaaauguggcuugcugcaaccaagaaggccucuuga

SEQ ID NO: 11239 - RNA, 3480 nt, Artificial Sequence
  derived and/or modified CDS sequence (opt3) from RVFV(KEN/Gar-004/06)__HM586964.1__NSm-Gn-Gc
augaucgagggcgccugggacagccugagagaagaggaaaugcccgaggaacucuccugcucugugucagggauuagggaggucaagacaaguagccaggagcuuuaccgggcucugaaagcaauaaucgccgcggauggauugaauaauauuacaugucacgguaagaacccugaagacaaaaucuccuuaauuaagggcccaccgcauaaaaagcgcguugggaucgugcgaugcgagcguagaagggaugcuaagcaaauaggacgggaaacuauggccggcaucgcaaugacgguacugcccgcccuagcuguguucgcacucgccccugucguguuugcugaggacccacaucugcgcaauagacccgguaaagggcacaacuauauugauggaaugacccaggaggacgccacauguaagccuguuacuuacgcgggcgcauguucuucguucgaugugcuucuggaaaaaggcaaguuuccauuguuccagucauaugcccaccauaggacccuccuggaggcuguccacgacacaaucauugccaaagcagaucccccuagcugcgaccugcagagugcucacgggaauccaugcaugaaggaaaagcucgugaugaaaacccauuguccgaacgauuaccaauccgcccacuauuuaaauaacgacggaaagauggcgucuguaaaaugucccccuaaguacgagcugacugaagauugcaauuuuugccggcagaugacaggugccagccuuaaaaagggcuccuauccauugcaggaccuguucugucagucaagugaggacgaugggagcaaacuaaagaccaagaugaaaggaguuugcgaggugggcguccaagcacucaagaaaugcgacggucagcugucuacggcucaugaaguggugcccuuugccgucuucaagaacucccagaaaguuuaccuugauaagcuggacuugaagacugaggaaaaucuccugccugauucauuuguguguuucgagcacaaagggcaguacaagggaaccauggacagcggccaaacaaaacgcgaauuaaagaguuuugauaucucucagugcccaaaaauaggcgggcacggacgaaagaagagaacuggugacgcugccuucuguuccgcauaugagugcaccgcccaguacgcuaacgcguauuguagcagggcaaauggcucggggauuguacaaauccaggugucucgggucuggaaaaagccccugugcgugggauacgagcguguuguggucaaacgcgaacucuccgccaagccgauucagagaguggagccuuguacaaccugcaucacgaaaugugaaccccauggccuuguaguuaggucaacugguuuuaagaucaguagcgcuguggccugcgcauccggggucugugugacaggcucucagagcccaucaaccgagauuacucugaaguauccuggaauaagucaauccagcggcggggauaucggaguccacauggcccaugacgaucagucugugucaaguaaaauuguugcucacugucccccacaggaccccugcuuggugcaugguugcaucguaugcgcccacggccuaauaaacaaucagagccacuccgcacugucugcguucgucgugauuuucguguuuucgagcacagcuaucaucugucucgccguucuguaccggguccuuaagugccugaaaauugcaccucgaaagguguugaacccacucauguggaucaccgccuucauucgcuggguauauaaaaagaugguggcuagaguugccgacaacauaaaucaagucaacagggaaaucggguggauggagggaggccagcuggcauuagguaauccggcucccauuccucggcaugccccaaucccccgcuacuccacguaccugaugcuacuccugaucgugucauaugcgagugccuguucugagcuuauucaggcuagcuccagaauaaccacaugcucaacugaaggggugaacaccaaauguagguugagcggcacagcacugauccgugccggaucugucggcgcugaggccugccucaugcugaaggggguuaaggaagaucagacuaaauuucuuaagauuaaaaccguguccagugagcugagcugucgggagggacaaucuuacuggacagguuccuucucaccuaagugcuugaguagccgaagaugucaccucgugggcgaaugccauguaaauaggugccugucguggcgcgacaacgagaccuccgcagaauuuucuuucgucggggagagcacuacgaugcgggaaaauaaauguuuugagcagugcggaggcugggguugugggugcuucaacgugaauccaucauguuuauuuguucacacauaucugcagagugugagaaaggaggcgcuaagggucuucaacugcaucgauugggugcacaagcucacccuggaaauuacugacuuugauggcuccguuucuaccaucgaccuuggagccagcuccucacgcuucacaaauuggggcagcgugaguuugucucuggaugcugaggggauauccggaagcaacucguuuucauucaucgaaucucccggcaaagguuacgccauuguagacgagccguucagugaaaucccucgacagggguuucucggagagauucgguguaauuccgagagcucuguccugagcgcacaugaauccugcuuacgugcuccaaaccuggugucauauaagcccaugaucgaucaacuugaguguaccacuaauuugauagacccuuucguggucuuugaaagaggcagucucccccagacaaggaacgauaaaacguucgccgcaagcaaggguaaccgcggcguucaggccuuuucuaaaggguccgugcaagcugaccugacccuacgguucgauaauuuugagguagacuucgugggagcggccgucucaugcgacgcagcuuuucugaaccucacuggcuguuacaguugcaaugccggggccagagugugccugagcauuacauccaccggaacaggcacucuuucugcucacaacaaggaugguucguugcauaucguucugccaagcgaaaaugggaccaaggaccagugucagauuuuacacuucacggugccugaggucgaggaagaguuuauguauucaugcgauggagacgaaaggccccuccuggugaaaggcacccuuaucgcaauagauccauucgacgaucgacgcgaggccgguggcgaguccacaguugugaacccgaagagugggucuuggaacuuuuucgacugguucagcggacugauguccugguuuggcgggccuuugaaaacuauccuccugauuugucuauacgucgcgcugucaaucggacucuucuuucugcuuauuuacuugggccggaccggucugucuaagaugugguuagcugccaccaaaaaggcaagcuga

SEQ ID NO: 11240 - RNA, 3204 nt, Artificial Sequence
  derived and/or modified CDS sequence (opt3) from RVFV(ZH-548)__DQ380206.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcuuagugcgcauggaaacccuuguaugaaagagaagcuggugaugaagacucacugcccaaaugauuaucagagcgcacacuacuugaacaaugacggcaaaauggccuccguuaagugucccccuaaauaugaacucaccgaggauugcaacuuuugucgccagaugacaggugcuucucugaagaaagggucguacccacugcaggaccucuucugccaaucaagcgaggaugacggaaguaaguuaaagaccaaaaugaagggcgugugugaagucggcgugcaggcccugaaaaagugcgaugggcagcuuuccacugcacaugagguaguuccguuugcuguguucaaaaauucuaagaaagucuauuuggacaagcuggaccuaaagacagaagagaaccuccugcccgauagcuuuguguguuucgagcacaaaggacaguacaaggguaccauggacuccggccaaacgaaacgagaacuuaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcagauccaagucagcggcguuuggaaaaagccacugugcgugggcuaugaacguguaguggucaaaagagaguugagugccaagcccauacagaggguggaaccuuguacaacuugcaucaccaaaugugagccacacgggcucguugugcggucuacaggauuuaagauuuccagcgcagucgccugcgcuucggguguguguguaaccggcucucagucccccucaacggagaucacucugaaguacccggggauuagucaaagcuccggaggcgauaucgguguucauauggcgcacgacgaucagucugugagcucaaaaauagucgcacauugcccuccccaggacccauguuuagugcacgauugcauugucugcgcccaugggcugaucaauuaucagugucacacagcucucagugccuucgugguuguguucguauuuuccagcauugcaaucaucugccuugccauucuguaccgcgucuugaagugucuaaaaauagcuccuagaaaggugcugaacccccucauguggaucaccgccuucauuagguggaucuauaaaaagaugguugcacggguggcggacaauauaaaccaagucaaucgcgaaauuggcuggauggagggaggccagcuggugcuugggaacccagcucccaucccucgacacgccccaaucccgagauacucuacuuaccugauguugcuccugauuguaucauaugcaagugccugcagcgaauuaauccaggcuuccucuaggauuacaaccuguucgacggagggagugaacaccaagugccggcugagcgguacagcccuaauacgugcaggcuccguuggggcugaagccugucucaugcugaaaggagucaaggaggaucagacuaaauuucuuaagaucaaaaccgugucaagugaguugucuugccgcgaaggccaaagcuacuggacagguuccuucucacccaagugucugagcucuagaaggugccaucucgugggggagugucacgucaaucggugccuguccuggcgagacaacgaaaccagugcggaguuuagcuucguuggcgaaucuacuacaaugcgcgagaauaaaugcuuugagcaguguggaggcugggggugcggauguuucaacgugaauccuuccugccuuuuugugcauaccuaucugcagucaguaagaaaggaagccuugagggucuucaacuguauugacugggugcacaagcucacucuggagaucacggauuuugacgguaguguuagcacaaucgauuuaggcgcuucguccucucgguucaccaauugggggagcgugucacugagucuagacgcagaaggaauuuccggcucuaacagcuuuuccuucauagagucaccagguaaaggguacgccaucgucgaugagcccuucagcgaaauuccucgccagggcuuucucggagagaucagaugcaauagugaaucuuccgugcugagcgcucacgagucgugucuuagggccccaaacuugauuucauauaagcccaugaucgaccaacuggaaugcacuaccaaucucauagauccguucguuguguuugagcguggcucucugccucagacacggaacgacaaaaccuucgcagcgaguaaggggaaucgaggaguacaggccuuuuccaaaggcagcguccaggcugauuuaacucugauguucgacaacuuugagguggauuucgugggugccgcagucucuugugacgcugccuuucuuaauuugacagggugcuacagcuguaacgcaggagccagaguuugccucuccaucacgucaaccggcacugguagucugagcgcucauaacaaggauggcucucuacacauugugcugccauccgaaaaugggacaaaggaccaaugccagauccuccauuucaccguacccgagguggaagaggaauuuauguauucaugugacggagaugagaggccucugcuugucaaaggcacauugauugcgaucgaccccuucgaugaccgccgggaggccgggggagaaaguacugugguuaacccaaagagcggcuccuggaacuuuuucgauugguucucuggucugaugucgugguuugggggaccuuuaaaaaccauacuccugauuugccuuuacguggcacugagcaucggcuuguucuuucuccugauuuaccuagguagaacgggccugucaaagauguggcucgcugccaccaaaaaggccuccuga

SEQ ID NO: 11241 - RNA, 3204 nt, Artificial Sequence
  derived and/or modified CDS sequence (opt3) from RVFV(2007000094)__EU574055.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuuuaccgcguccugaaguguuugaaaauagcuccuagaaaggugcuaaacccccugauguggaucaccgccuucauuagguggguuuauaaaaagaugguggcacgggucgcggauaauaucaaccaggugaaucgcgaaauaggauggauggagggcgggcagcucguacugggaaacccagcucccauuccucgacacgccccaaucccgagauacucuacuuaccuuaugcuguugcucaucgugucauaugcaagugccugcagcgaacugauucaggcuuccucuaggaucacaaccuguucgacggaggguguuaacaccaagugccgguuaagcggcacagcccugauucgugcaggguccgucggagcugaagccugucuaaugcucaaaggcgugaaggaggaccaaacuaaauuucugaagauaaaaaccgugucaagugagcuuucuugccgcgaaggucagagcuacuggacaggguccuucucacccaaguguuugagcucuagaaggugccaucuggucggcgagugucacguuaaucggugccucuccuggcgagauaacgaaacaagugcggaguuuagcuucgugggagaaucuaccacaaugcgcgagaauaaaugcuuugagcaguguggcggguggggaugcgguuguuucaacgugaauccuuccugccuguuuguacauaccuaucuucagucagucagaaaggaagcccugaggguguucaacuguaucgacuggguucacaaguugacucucgagauuacggacuuugauggcagugugagcacaaucgaccugggggcuucguccucucgguucaccaauuggggaagcgucucauuaagucuggaugcagaaggcaucuccgguucuaacagcuuuuccuucauugagucaccagggaaaggcuacgccauaguggacgagcccuucagcgaaaucccucgccaaggauuucuaggcgagauuagaugcaauagugaaucuuccguucucagcgcucacgagucgugucugagggccccaaaccuuaucucauauaagcccaugauugaucaguuggaaugcacuaccaaucugaucgacccguucgugguauuugagcgugggucucucccucagacacggaacgauaaaaccuucgcagcgaguaagggaaaucgaggcguccaggccuuuuccaaagguagcgugcaagcugaccugacuuuaauguucgauaacuuugagguggacuucgucggggccgcaguuucuugugaugcugccuuucugaaucuuacaggaugcuacagcuguaacgcaggcgccagagugugcuuguccauaacgucaaccgguacuggcacacucagugcucauaacaaggacgggagccugcacaucguacuaccaucugaaaauggaaccaaggaucagugccagauucugcauuucacagugcccgaggucgaagaggaauuuauguauuccugugacggcgacgagaggccucuccuggugaaagggacucuuaucgcgauugaucccuucgacgaucgccgggaggccggaggcgaaucaaccguugugaacccaaagagugguagcuggaacuuuuucgacugguucuccggguugaugucuugguuuggaggcccucugaaaacgaucuuacucauaugccuguacgucgcacuuucgauuggucuguucuuuuugcucaucuaccugggcagaaccgggcuaagcaagauguggcuggcugccacuaaaaaggccucauga

SEQ ID NO: 11242 - RNA, 3204 nt, Artificial Sequence
  derived and/or modified CDS sequence (opt3) from RVFV(ZH-548M12)__M25276.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcuuagugcgcauggaaacccuuguaugaaagagaagcuggugaugaagacucacugcccaaaugauuaucagagcgcacaccauuugaacaaugacggcaaaauggccuccguuaagugucccccuaaauacgaacucaccgaggauugcaacuuuugucgccagaugacaggugcuucucugaagaaagggucguauccacugcaggaccucuucugccaaucaagcgaggaugacggaaguaaguuaaagaccaaaaugaagggcgugugugaagucggcgugcaggcccugaaaaagugcgaugggcagcuuuccacugcacacgagguaguuccguuugcuguguucaaaaauucuaagaaagucuacuuggacaagcuggaccuaaagacagaagagaaccuccugcccgauagcuuuguguguuucgagcauaaaggacaguauaaggguaccauggacuccggccaaacgaaacgagaacuuaagucauuugauauuagucagugcccuaaaaucgggggacacggcagcaagaagugcacuggugacgccgcguucuguucugccuacgagugcaccgcacaguacgcuaaugccuauuguucccacgcuaacgggucaggaauugugcagauccaagucagcggcguuuggaaaaagccacugugcgugggcuacgaacguguaguggucaaaagagaguugagugccaagcccauacagaggguggaaccuuguacaacuugcaucaccaaaugugagccacaugggcucguugugcggucuacaggauuuaagauuuccagcgcagucgccugcgcuucggguguguguguaaccggcucucagucccccucaacggagaucacucugaaguauccggggauuagucaaagcuccggaggcgauaucgguguucacauggcgcaugacgaucagucugugagcucaaaaauagucgcacacugcccuccccaggacccauguuuagugcaugauugcauugucugcgcccacgggcugaucaauuaccagugucacacagcucucagugccuucgugguuguguucguauuuuccagcauugcaaucaucugccuugccauucuguaucgcgucuugaagugucuaaaaauagcuccuagaaaggugcugaacccccucauguggaucaccgccuucauuagguggaucuacaaaaagaugguugcacggguggcggacaauauaaaccaagucaaucgcgaaauuggcuggauggagggaggccagcuggugcuugggaacccagcucccaucccucgacaugccccaaucccgagauauucuacuuaccugauguugcuccugauuguaucauacgcaagugccugcagcgaauuaauccaggcuuccucuaggauuacaaccuguucgacggagggagugaacaccaagugccggcugagcgguacagcccuaauacgugcaggcuccguuggggcugaagccugucucaugcugaaaggagucaaggaggaucagacuaaauuucuuaaguugaaaaccgugucaagugagcugucuugccgcgaaggccaaagcuauuggacagguuccuucucacccaagugucucagcucuagaaggugccaccuggugggggagugucaugucaaucggugccuuuccuggcgagacaacgaaaccagugcggaguuuagcuucguuggcgaaucuacuacaaugcgcgagaauaaaugcuuugagcaguguggaggcugggggugcggauguuucaacgugaauccuuccugccuguuugugcacaccuacuugcagucaguaagaaaggaagcccucagggucuucaacuguaucgacugggugcacaagcugacuuuagagauuacggauuuugacgguaguguuagcacaaucgaucugggcgcuucguccucucgguucaccaauugggggagcgugucacuaagucucgacgcagaaggaaucuccggcucuaacagcuuuuccuucauugagucaccagguaaaggguaugccauagucgaugagcccuucagcgaaaucccucgccagggcuuucugggagagauuagaugcaauagugaaucuuccgugcuuagcgcucaugagucguguuugagggccccaaaccugaucucauacaagcccaugauugaccaacucgaaugcacuaccaaucugaucgauccguucguuguguuugagcguggcucuuuaccucagacacggaacgacaaaaccuucgcagcgaguaaggggaaucgaggaguacaggccuuuuccaaaggcagcguccaggcugaucugacucuuauguucgacaacuuugagguggauuucgugggugccgcagucucuugugacgcugccuuuuugaaucucacagggugcuauagcuguaacgcaggagccagaguuugccuguccauaacgucaaccggcacugguagucuaagcgcucacaacaaggauggcucucugcauaucgugcucccauccgaaaaugggacaaaggaccaaugccagauucugcacuucaccguacccgagguggaagaggaauuuauguacucaugugacggagaugagaggccucuuuuggucaaaggcacacugaucgcgauugaccccuucgaugaccgccgggaggccgggggagaaaguacugugguuaacccaaagagcggcuccuggaacuuuuucgauugguucucugguuuaaugucgugguuugggggaccucucaaaaccauccugcuuauaugccuguauguggcauugagcauuggccucuucuuucugcuaaucuaccuggguggcacggggcucucaaagauguggcuggcugccaccaaaaaggccuccuga

SEQ ID NO: 11243 - RNA, 3204 nt, Artificial Sequence
  derived and/or modified CDS sequence (opt3) from RVFV(Sudan 86-2010)__JQ820489.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuuuaccgcguccugaaguguuugaaaauagcuccuagaaaggugcuaaacccccugauguggaucaccgccuucauuagguggguuuauaaaaagaugguggcacgggucgcggauaauaucaaccaggugaaucgcgaaauaggauggauggagggcgggcagcucguacugggaaacccagcucccauuccucgacacgccccaaucccgagauacucuacuuaccuuaugcuguugcucaucgugucauaugcaagugccugcagcgaacugauucaggcuuccucuaggaucacaaccuguucgacggaggguguuaacaccaagugccgguuaagcggcacagcccugauucgugcaggguccgucggagcugaagccugucuaaugcucaaaggcgugaaggaggaccaaacuaaauuucugaagauaaaaaccgugucaagugagcuuucuugccgcgaaggucagagcuacuggacaggguccuucucacccaaguguuugagcucuagaaggugccaucuggucggcgagugucacguuaaucggugccucuccuggcgagauaacgaaacaagugcggaguuuagcuucgugggagaaucuaccacaaugcgcgagaauaaaugcuuugagcaguguggcggguggggaugcgguuguuucaacgugaauccuuccugccuguuuguacauaccuaucuucagucagucagaaaggaagcccugaggguguucaacuguaucgacuggguucacaaguugacucucgagauuacggacuuugauggcagugugagcacaaucgaccugggggcuucguccucucgguucaccaauuggggaagcgucucauuaagucuggaugcagaaggcaucuccgguucuaacagcuuuuccuucauugagucaccagggaaaggcuacgccauaguggacgagcccuucagcgaaaucccucgccaaggauuucuaggcgagauuagaugcaauagugaaucuuccguucucagcgcucacgagucgugucugagggccccaaaccuuaucucauauaagcccaugauugaucaguuggaaugcacuaccaaucugaucgacccguucgugauauuugagcgugggucucucccucagacacggaacgauaaaaccuucgcagcgaguaagggaaaucgaggcguacaggccuuuuccaaagguagcguccaagcugaccugacuuuaauguucgauaacuuugagguggacuucgugggggccgcagucucuugugaugcugccuuucugaaucuuacaggaugcuacagcuguaacgcaggcgccagaguuugcuuguccaucacgucaaccgguacuggcacacucagugcucauaacaaggacgggagccugcacauugugcuaccaucugaaaauggaaccaaggaucagugccagauccugcauuucacaguacccgagguggaagaggaauuuauguauuccugugacggcgacgagaggccucuccuggucaaagggacucuuauugcgaucgaucccuucgacgaucgccgggaggccggaggcgaaucaaccgugguuaacccaaagagugguagcuggaacuuuuucgacugguucuccggguugaugucuugguuuggaggcccucugaaaacgauauuacucauuugccuguacguggcacuuucgaucggucuguucuuuuugcucauuuaccugggcagaaccgggcuaagcaagauguggcuggcugccacuaaaaaggccucauga

SEQ ID NO: 11244 - RNA, 3204 nt, Artificial Sequence
  derived and/or modified CDS sequence (opt3) from RVFV(ZS-6365)__DQ380205.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuuuaccgcguccugaaguguuugaaaauagcuccuagaaaggugcuaaacccccugauguggaucaccgccuucauuagguggaucuauaaaaagaugguugcacggguggcggauaauauaaaccaggucaaucgcgaaauuggauggauggagggcgggcagcucgugcugggaaacccagcucccaucccucgacacgccccaaucccgagauacucuacuuaccuuaugcuguugcucauuguaucauaugcaagugccugcagcgaacugauccaggcuuccucuaggauuacaaccuguucgacggagggugugaacaccaagugccgguuaagcggcacagcccugauacgugcaggguccguuggagcugaagccugucuaaugcucaaaggcgucaaggaggaccaaacuaaauuucugaagaucaaaaccgugucaagugagcuuucuugccgcgaaggucagagcuacuggacaggguccuucucacccaaguguuugagcucuagaaggugccaucuggugggcgagugucacgucaaucggugccucuccuggcgagauaacgaaaccagugcggaguuuagcuucguuggagaaucuacuacaaugcgcgagaauaaaugcuuugagcaguguggcggguggggaugcgguuguuucaacgugaauccuuccugccuguuugugcauaccuaucuucagucaguaagaaaggaagcccugagggucuucaacuguauugacugggugcacaaguugacucucgagaucacggacuuugauggcaguguuagcacaaucgaccugggggcuucguccucucgguucaccaauuggggaagcgugucauuaagucuggaugcagaaggcauuuccgguucuaacagcuuuuccuucauagagucaccagggaaaggcuacgccaucgucgacgagcccuucagcgaaauuccucgccaaggauuucuaggcgagaucagaugcaauagugaaucuuccgugcucagcgcucacgagucgugucugagggccccaaaccuuauuucauauaagcccaugaucgaucaguuggaaugcacuaccaaucugauagacccguucguuguguuugagcgugggucucucccucagacacggaacgauaaaaccuucgcagcgaguaagggaaaucgaggcguacaggccuuuuccaaagguagcguccaagcugaccugacuuuaauguucgauaacuuugagguggacuucgugggggccgcagucucuugugaugcugccuuucugaaucuuacaggaugcuacagcuguaacgcaggcgccagaguuugcuuguccaucacgucaaccgguacuggcagucucagcgcucauaacaaggacgggucucugcacauugugcuaccauccgaaaauggaacaaaggaucagugccagauccugcauuucaccguacccgagguggaagaggaauuuauguauucaugugacggcgacgagaggccucuccuggucaaagggacacuuauugcgaucgaucccuucgacgaucgccgggaggccggaggcgaaaguacugugguuaacccaaagagcgguuccuggaacuuuuucgacugguucucuggguugaugucgugguuuggaggcccucugaaaaccauauuacucauuugccuguacguggcacuuagcaucggucuguucuuuuugcucauuuaccugggcagaacggggcuaucaaagauguggcuggcugccaccaaaaaggccuccuga

SEQ ID NO: 11245 - RNA, 3204 nt, Artificial Sequence
  derived and/or modified CDS sequence (opt3) from RVFV(1853/78)__DQ380220.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggagugguccaaauucagguuagcggcguguggaaaaagccacuuugcguaggcuaugaacguguggucgugaaaagagagcugagugccaagcccauccagaggguugaaccuuguacaacuugcauaaccaaaugugagccacacggguuggugguccggucuacaggauuuaagaucuccagcgcaguggccugcgcuucggguguauguguuaccggcucucaaucccccucaacggagauuacucucaaguacccggggaucagucagagcuccggaggcgauauuggugugcauauggcgcacgacgaucagucugucagcucaaaaaucguggcacauugcccuccccaggacccaugucugguccacgggugcauagugugcgcccauggcuuaauuaauuaucaaugucacacagcucugagugccuucguugugguauucgucuuuuccagcaucgcaauuaucugccucgccauccuuuaccgcgugcugaaguguuugaaaauugcuccuagaaagguucuaaacccccugauguggauaaccgccuucaucagguggguguauaaaaagauggucgcacggguggcggauaauauuaaccagguaaaucgcgaaaucggauggauggagggcgggcagcucgugcugggaaacccagcucccauaccucgacacgccccaauuccgagauacucuacuuaccuuaugcuguugcucaucguuucauaugcaagugccugcagcgaacugauccaggcuuccucuaggauuacaaccuguucgacggagggugucaacaccaagugccgguuaagcggcacagcccugauccgugcaggguccgugggagcugaagccugucuaaugcucaaaggcgugaaggaggaccaaacuaaauuucugaagauuaaaaccgucucaagugagcuuucuugccgcgaaggucagagcuacuggacaggguccuucucacccaaguguuugagcucuagaaggugccaucugguuggcgagugucacgugaaucggugccucuccuggcgagauaacgaaacaagugcggaguuuagcuucgugggagaaucuaccacaaugcgcgagaauaaaugcuuugagcaguguggcggguggggaugcgguuguuucaacguaaauccuuccugccuguuuguccauaccuaucuucagucagugagaaaggaagcccugaggguuuucaacuguauagacugggugcacaaguugacucucgagaucacggacuuugauggcagugucagcacaauugaccugggggcuucguccucucgguucaccaauuggggaagcgugucauuaagucuggaugcagaaggcaucuccgguucuaacagcuuuuccuucaucgagucaccagggaaaggcuacgccauuguugacgagcccuucagcgaaauaccucgccaaggauuucuaggcgagaucagaugcaauagugaaucuuccgugcucagcgcucacgagucgugucugagggccccaaaccuuauuucauauaagcccaugaucgaucaguuggaaugcacuaccaaucugauugacccguucguagucuuugagcgugggucucucccucagacacggaacgauaaaaccuucgcagcgaguaagggaaaucgaggcgugcaggccuuuuccaaagguagcgugcaagcugaccugacuuuaauguucgauaacuuugaggucgacuucguuggggccgcagugucuugugaugcugccuuucugaaucuuacaggaugcuacagcuguaacgcaggcgccagaguaugcuuguccaucacgucaaccgguacuggcacacucagugcucauaacaaggacgggagccugcacauagugcuaccaucugaaaauggaaccaaggaucagugccagauccugcauuucacaguccccgagguggaagaggaauuuauguauuccugugacggcgacgagaggccucuccugguuaaagggacucuuauugcgaucgaucccuucgacgaucgccgggaggccggaggcgaaucaaccguggucaacccaaagagugguagcuggaacuuuuucgacugguucuccggguugaugucuugguuuggaggcccucugaaaacgauuuuacucaucugccuguacguggcacuuucgauaggucuguucuuuuugcucauuuaccugggcagaaccgggcuaagcaagauguggcuggcugccacuaaaaaggccucauga

SEQ ID NO: 11246 - RNA, 3204 nt, Artificial Sequence
  derived and/or modified CDS sequence (opt3) from RVFV(T1)__DQ380201.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccguccuuuaccgcgugcugaaguguuugaaaauugcuccuagaaagguucuaaacccccugauguggauaaccgccuucaucagguggauuuauaaaaagaugguggcacgggucgcggauaauaucaaccaggugaaucgcgaaauaggauggauggagggcgggcagcucguacugggaaacccagcucccauuccucgacacgccccaaucccgagauacucuacuuaccuuaugcuguugcucaucgugucauaugcaagugccugcagcgaacugauucaggcuuccucuaggaucacaaccuguucgacggaggguguuaacaccaagugccgguuaagcggcacagcccugauucgugcaggguccgucggagcugaagccugucuaaugcucaaaggcgugaaggaggaccaaacuaaauuucugaagauaaaaaccgugucaagugagcuuucuugccgcgaaggucagagcuacuggacaggguccuucucacccaaguguuugagcucuagaaggugccaucuggucggcgagugucacguuaaucggugccucuccuggcgagauaacgaaaccagugcggaguuuagcuucgugggagaaucuacuacaaugcgcgagaauaaaugcuuugagcaguguggcggguggggaugcgguuguuucaacgugaauccuuccugccuguuuguacauaccuaucuucagucagucagaaaggaagcccugaggguguucaacuguaucgacuggguucacaaguugacucucgagauuacggacuuugauggcagugugagcacaaucgaccugggggcuucguccucucgguucaccaauuggggaagcgucucauuaagucuggaugcagaaggcaucuccgguucuaacagcuuuuccuucauugagucaccagggaaaggcuacgccauaguggacgagcccuucagcgaaaucccucgccaaggauuucuaggcgagauuagaugcaauagugaaucuuccguucucagcgcucacgagucgugucugagggccccaaaccuuaucucauauaagcccaugauugaucaguuggaaugcacuaccaaucugaucgacccguucgugguauuugagcgugggucucucccucagacacggaacgauaaaaccuucgcagcgaguaagggaaaucgaggcguccaggccuuuuccaaagguagcgugcaagcugaccugacuuuaauguucgauaacuuugagguggacuucgucggggccgcaguuucuugugaugcugccuuucugaaucuuacaggaugcuacagcuguaacgcaggcgccagagugugcuuguccauaacgucaaccgguacuggcagucucagcgcucauaacaaggacgggucucugcacaucguacuaccauccgaaaauggaacaaaggaucagugccagauucugcauuucaccgugcccgaggucgaagaggaauuuauguauucaugugacggcgacgagaggccucuccuggugaaagggacacuuaucgcgauugaucccuucgacgaucgccgggaggccggaggcgaaaguacuguugugaacccaaagagcgguuccuggaacuuuuucgacugguucucuggguugaugucgugguuuggaggcccucugaaaaccaucuuacucauaugccuguacgucgcacuuagcauuggucuguucuuuuugcucaucuaccugggcagaacggggcuaucaaagauguggcuggcugccaccaaaaaggccuccuga

SEQ ID NO: 11247 - RNA, 3204 nt, Artificial Sequence
  derived and/or modified CDS sequence (opt3) from RVFV(Kenya 83 (21445))__DQ380198.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuuuaccgcguccugaaguguuugaaaauagcuccuagaaaggugcuaaacccccugauguggaucaccgccuucauuagguggguuuauaaaaagaugguggcacgggucgcggauaauaucaaccaggugaaucgcgaaauaggauggauggagggcgggcagcucgcucugggaaacccagcccccauuccucgacacgcaccaaucccgagauacucuacuuaccuuaugcuguugcucaucguaucauaugccagugcuugcagcgaacugauucaggccuccucuaggaucacaaccuguucgacggagggugugaacaccaagugccgguuaagcggcacagcacugauucgugcuggguccguuggagccgaagcgugucuaaugcucaaaggcgucaaggaggaccaaacuaaauuucugaagauaaaaaccgugucaagugagcuuucuugccgcgaaggucagagcuacuggacaggguccuucucacccaaguguuugagcucuagaaggugccaucuggugggcgagugucacgucaaucggugccucuccuggcgagauaacgaaacaagugccgaguuuagcuucguuggagaaucuaccacaaugcgcgagaauaaaugcuuugagcaguguggcggguggggaugcgguuguuucaacgugaauccuuccugccuguuugugcauaccuaucuucagucaguaagaaaggaagcucugagggucuucaacuguaucgacugggugcacaaguugacucucgagauuacggacuuugauggcaguguuagcacaaucgaccugggggcaucguccucucgguucaccaauuggggaagcgugucauuaagucuggaugccgaaggcaucuccgguucuaacagcuuuuccuucauugagucaccagggaaaggcuacgcuauagucgacgagcccuucagcgaaaucccucgccaaggauuucuaggcgagauuagaugcaauagugaaucuuccgugcucagcgcccacgagucgugucugagggcaccaaaccuuaucucauauaagcccaugauugaucaguuggaaugcacuaccaaucugaucgacccguucguuguguuugagcgugggucucucccucagacacggaacgauaaaaccuucgcggccaguaagggaaaucgaggcguacaggcuuuuuccaaagguagcguccaagccgaccugacuuuaauguucgauaacuuugagguggacuucgugggggcagcugucucuugugaugccgcauuucugaaucuuacaggaugcuacagcuguaacgccggcgcuagaguuugcuuguccauaacgucaaccgguacuggcacacucagugcgcauaacaaggacgggagccugcacaucgugcuaccaucugaaaauggaaccaaggaucagugccagauucugcauuucacaguacccgagguggaagaggaauuuauguauuccugugacggcgacgagaggccucuccuggucaaagggacucuuaucgccauugaucccuucgacgaucgccgggaggcaggaggcgaaucaaccgugguuaacccaaagagugguagcuggaacuuuuucgacugguucuccggguugaugucuugguuuggaggcccucugaaaacgaucuuacucauaugccuguacguggcucuuucgauuggucuguucuuuuugcucaucuaccugggcagaaccgggcuaagcaagauguggcuggccgccacuaaaaaggcuucauga

SEQ ID NO: 11248 - RNA, 3204 nt, Artificial Sequence
  derived and/or modified CDS sequence (opt3) from RVFV(Sudan 85-2010)__JQ820488.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuuuaccgcguccugaaguguuugaaaauagcuccuagaaaggugcuaaacccccugauguggaucaccgccuucauuagguggguuuauaaaaagaugguggcacgggucgcggauaauaucaaccaggugaaucgcgaaauaggauggauggagggcgggcagcucguacugggaaacccagcucccauuccucgacacgccccaaucccgagauacucuacuuaccuuaugcuguugcucaucgugucauaugcaagugccugcagcgaacugauucaggcuuccucuaggaucacaaccuguucgacggaggguguuaacaccaagugccgguuaagcggcacagcccugauucgugcaggguccgucggagcugaagccugucuaaugcucaaaggcgugaaggaggaccaaacuaaauuucugaagauaaaaaccgugucaagugagcuuucuugccgcgaaggucagagcuacuggacaggguccuucucacccaaguguuugagcucuagaaggugccaucuggucggcgagugucacguuaaucggugccucuccuggcgagauaacgaaacaagugcggaguuuagcuucgugggagaaucuaccacaaugcgcgagaauaaaugcuuugagcaguguggcggguggggaugcgguuguuucaacgugaauccuuccugccuguuuguacauaccuaucuucagucagucagaaaggaagcccugaggguguucaacuguaucgacuggguucacaaguugacucucgagauuacggacuuugauggcagugugagcacaaucgaccugggggcuucguccucucgguucaccaauuggggaagcgucucauuaagucuggaugcagaaggcaucuccgguucuaacagcuuuuccuucauugagucaccagggaaaggcuacgccauaguggacgagcccuucagcgaaaucccucgccaaggauuucuaggcgagauuagaugcaauagugaaucuuccguucucagcgcucacgagucgugucugagggccccaaaccuuaucucauauaagcccaugauugaucaguuggaaugcacuaccaaucugaucgacccguucgugguauuugagcgugggucucucccucagacacggaacgagaaaaccuucgcagcgaguaagggaaaucgaggcguccaggccuuuuccaaagguagcgugcaagcugaucugacuuuaauguucgacaacuuugaaguggauuucgucggggccgcaguuucuugugacgcugccuuucugaaucuuacaggaugcuacagcuguaacgcaggcgccagagugugcuuguccauaacgucaaccgguacuggcacacucagugcucauaacaaggaugggagccugcacaucguacuaccaucugagaauggaaccaaggaccagugccagauucugcauuucacagugcccgaagucgaggaagaguuuauguauuccugugauggcgacgagaggccucuccuggugaaagggacucuuaucgcgauugaccccuucgaugaccgccgggaagccggaggcgagucaaccguugugaacccaaagagugguagcuggaacuuuuucgauugguucuccggguugaugucuugguuuggaggcccucugaaaacgaucuuacucauaugccuguacgucgcacuuucgauuggucuguucuuuuugcucaucuaccugggcagaaccgggcuaagcaagauguggcuggcugccacuaaaaaggccucauga

SEQ ID NO: 11249 - RNA, 3204 nt, Artificial Sequence
  derived and/or modified CDS sequence (opt3) from RVFV(2007004194)__EU574031.1__Gn-Gc
auggccggcaucgcuaugacagugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccuguccaacgacggcaaaauggccucuguuaagugucccccuaaauaugaauugaccgaggauugcaauuuuugucgccagaugacaggugcuucgcucaagaaagggucauacccacugcaagaccuguucugccagagcagugaggaugacggauccaagcucaagaccaaaaugaagggcgugugugaagucggcgugcaggccuuaaagaagugcgaugggcagcugucuacugcacaugagguaguuccguuugcuguguucaaaaacagcaagaaagucuaucuugacaaguuggaccugaagacagaagagaaucuacuccccgauuccuuuguguguuucgagcacaaaggacaauacaaggguaccauggacucaggccagacgaaacgagaacugaagaguuuugauauuagccagugcccuaaaaucgggggacauggcucuaagaagugcacuggugacgccgcguucuguuccgccuacgagugcaccgcacaguaugcuaacgccuacuguucacacgcuaaugggagcggaauugugcaaauccaggucaguggcguuuggaaaaagccacuuugcgugggcuaugaacguguaguggucaaaagagagcugucugccaagcccauacagaggguggaaccuuguacaacuugcaucaccaaaugugagccacacggguugguugugcgguccacaggauuuaagauuagcucggcagucgccugcgcuucugguguguguguaaccggcucccaaucacccaguacggagaucacucucaaguacccggggauuagccaguccucuggaggcgauaucgguguucauauggcgcacgacgaucagagcgugucaaguaaaauagucgcacauugcccuccccaggacccaugucuggugcacgggugcauugucugcgcccauggcuuaaucaacuaucaaugucacacagcucuguccgccuucgugguuguguucguauuuagcucuauugcaaucaucugccucgccauucuuuaccgcguccugaaguguuugaaaauagcuccuagaaaggugcuaaauccccugauguggaucaccgccuucauuagguggguuuauaaaaagaugguggcacgggucgcggauaacaucaaucaggugaaccgcgaaauaggauggauggagggcgggcagcucguacugggaaauccagcucccauuccucgacacgccccaaucccgagauacucaacuuaccuuaugcuguugcucaucgugaguuaugcaagcgccugcuccgaacugauucaggcuucuucgaggaucacaaccuguagcacggaggguguuaacaccaagugccgguuauccggcacagcccugauucgugcagggucagucggagcugaagccugucuaaugcucaaaggcgugaaggaggaccaaacuaaauuucugaagauaaaaaccgugaguucugagcuuagcugccgcgaaggucaguccuacuggacagggucauucagccccaaguguuugucuuccagaaggugccaucuggucggcgagugucacguuaaccggugccucaguuggcgagauaaugaaacuagcgcggaguuuucuuucgugggagaauccaccacaaugcgcgagaacaaaugcuuugagcaguguggcggguggggaugcgguuguuucaaugugaacccuucaugccuguuuguacauaccuaucuucagagugucagaaaggaagcccugaggguguucaauuguaucgacuggguucacaaguugacucucgagauuacggacuuugauggcagcgugucgacaaucgaccugggggcuuccucuagccgguucaccaacuggggaucagucaguuuaucccuggaugcagaaggcaucucugguagcaauuccuuuucauucauugagagcccagggaaaggcuacgccauaguggacgagcccuucagugaaaucccucgccaaggauuucuaggcgagauuagaugcaacucugaauccagcguucucucggcucacgagucaugucugagggccccaaaucuuaucucuuauaagcccaugauugaucaguuggaaugcacuaccaaccugaucgacccguucgugguauuugagcgugggagucucccucagacacggaaugauaaaaccuucgcagcguccaagggaaaccgaggcguccaggccuuuagcaaagguucugugcaagcugaccugacuuuaauguucgauaauuuugagguggacuucgucggggccgcaguuagcugugaugcugccuuucugaaccuuacaggaugcuacuccuguaaugcaggcgccagagugugcuugucaauaacgaguaccgguacuggcacacucagcgcucauaacaaggacgggucucugcacaucguacuaccauccgaaaacggaaccaaggaucagugccagauucugcauuucacagugcccgaggucgaagaggaauuuauguauucaugugacggcgacgagaggccucuccuggugaaagggacucuuaucgcgauugaucccuucgacgaucgccgggaggccggaggcgaaaguaccguugugaauccaaagagcgguuccuggaacuuuuucgacugguucucuggguugaugucgugguuuggaggcccucugaaaacgaucuuacucauaugccuguacgucgcacuuagcauuggucuguucuuuuugcucaucuaccugggcagaaccgggcuaucaaagauguggcuggcugccaccaaaaaggccuccuga

SEQ ID NO: 11250 - RNA, 3204 nt, Artificial Sequence
  derived and/or modified CDS sequence (opt3) from RVFV(2250/74)__DQ380209.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuuuaccgcguccugaaguguuugaaaauagcuccuagaaaggugcuaaacccccugauguggaucaccgccuucauuagguggaucuauaaaaagaugguugcacggguggcggauaauauaaaccaggucaaucgcgaaauuggauggauggagggcgggcagcucgugcugggaaacccagcucccaucccucgacacgccccaaucccgagauacucuacuuaccuuaugcuguugcucauuguaucauaugcaagugccugcagcgaacugauccaggcuuccucuaggauuacaaccuguucgacggagggugugaacaccaagugccgguuaagcggcacagcccugauacgugcaggguccguuggagcugaagccugucuaaugcucaaaggcgucaaggaggaccaaacuaaauuucugaagaucaaaaccgugucaagugagcuuucuugccgcgaaggucagagcuacuggacaggguccuucucacccaaguguuugagcucuagaaggugccaucuggugggcgagugucacgucaaucggugccucuccuggcgagauaacgaaaccagugcggaguuuagcuucguuggagaaucuacuacaaugcgcgagaauaaaugcuuugagcaguguggcggguggggaugcgguuguuucaacgugaauccuuccugccuguuugugcauaccuaucuucagucaguaagaaaggaagcccugagggucuucaacuguauugacugggugcacaaguugacucucgagaucacggacuuugauggcaguguuagcacaaucgaccugggggcuucguccucucgguucaccaauuggggaagcgugucauuaagucuggaugcagaaggcauuuccgguucuaacagcuuuuccuucauagagucaccagggaaaggcuacgccaucgucgacgagcccuucagcgaaauuccucgccaaggauuucuaggcgagaucagaugcaauagugaaucuuccgugcucagcgcucacgagucgugucugagggccccaaaccuuauuucauauaagcccaugaucgaucaguuggaaugcacuaccaaucugauagacccguucguuguguuugagcgugggucucucccucagacacggaacgauaaaaccuucgcagcgaguaagggaaaucgaggcguacaggccuuuuccaaagguagcguccaagcugaccugacuuuaauguucgauaacuuugagguggacuucgugggggccgcagucucuugugaugcugccuuucugaaucuuacaggaugcuacagcuguaacgcaggcgccaagguuugcuuguccaucacgucaaccgguacuggcagucucagcgcucauaacaaggacgggucucugcacauugugcuaccauccgaaaauggaacaaaagaucagugccagauccugcauuucaccguacccgagguggaagaggaauuuauguauucaugugacggcgacgagagaccucuccuggucaaggggacacuuauugcgaucgaucccuucgacgauaggcgcgaggccggaggcgaaaguacugugguuaacccaaaaagcgguuccuggaacuuuuucgacugguucucuggguugaugucgugguuuggaggcccucugaagaccauauuacucauuugccuguacguggcacuuagcaucggucuguucuuuuugcucauuuaccugggccggacggggcuaucaaaaauguggcuggcugccaccaagaaggccuccuga

SEQ ID NO: 11251 - RNA, 3204 nt, Artificial Sequence
  derived and/or modified CDS sequence (opt3) from RVFV(Sudan 28-2010)__JQ820491.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuuuaccgcguccugaaguguuugaaaauagcuccuagaaaggugcuaaacccccugauguggaucaccgccuucauuagguggguuuauaaaaagaugguggcacgggucgcggauaauaucaaccaggugaaucgcgaaauaggauggauggagggcgggcagcucguacugggaaacccagcucccauuccucgacacgccccaaucccgagauacucuacuuaccuuaugcuguugcucaucgugucauaugcaagugccugcagcgaacugauucaggcuuccucuaggaucacaaccuguucgacggaggguguuaacaccaagugccgguuaagcggcacagcccugauucgugcaggguccgucggagcugaagccugucuaaugcucaaaggcgugaaggaggaccaaacuaaauuucugaagauaaaaaccgugucaagugagcuuucuugccgcgaaggucagagcuacuggacaggguccuucucacccaaguguuugagcucuagaaggugccaucuggucggcgagugucacguuaaucggugccucuccuggcgagauaacgaaacaagugcggaguuuagcuucgugggagaaucuaccacaaugcgcgagaauaaaugcuuugagcaguguggcggguggggaugcgguuguuucaacgugaauccuuccugccuguuuguacauaccuaucuucagucagucagaaaggaagcccugaggguguucaacuguaucgacuggguucacaaguugacucucgagauuacggacuuugauggcagugugagcacaaucgaccugggggcuucguccucucgguucaccaauuggggaagcgucucauuaagucuggaugcagaaggcaucuccgguucuaacagcuuuuccuucauugagucaccagggaaaggcuacgccauaguggacgagcccuucagcgaaaucccucgccaaggauuucuaggcgagauuagaugcaauagugaaucuuccguucucagcgcucacgagucgugucugagggccccaaaccuuaucucauauaagcccaugauugaucaguuggaaugcacuaccaaucugaucgacccguucgugguauuugagcgugggucucucccucagacacggaacgauaaaaccuucgcagcgaguaagggaaaucgaggcguccaggccuuuuccaaagguagcgugcaagcugaccugacuuuaauguucgauaacuuugagguggacuucgucggggccgcaguuucuugugaugcugccuuucugaaucuuacaggaugcuacagcuguaacgcaggcgccagagugugcuuguccauaacgucaaccgguacuggcacacucagugcucauaacaaggacgggagccugcacaucguacuaccaucugaaaauggaaccaaggaucagugccagauucugcauuucacagugcccgaggucgaagaggaauuuauguauuccugugacggcgacgagaggccucuccuggugaaagggacucuuaucgcgauugaucccuucgacgaucgccgggaggccggaggcgaaucaaccguugugaacccaaagagugguagcuggaacuuuuucgacugguucuccggguugaugucuugguuuggaggcccucugaaaacgaucuuacucauaugccuguacgucgugcuuucgauuggucuguucuuuuugcucaucuaccugggcagaaccgggcuaagcaagauguggcuggcagcuacuaaaaaggccucauga

SEQ ID NO: 11252 - RNA, 3204 nt, Artificial Sequence
  derived and/or modified CDS sequence (opt3) from RVFV(2007000324)__JF326195.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuauuuucguguuuuccagcaccgcaaucaucugccucgccguacuuuaccgcguccugaaguguuugaaaauugcuccuagaaaggugcuaaacccccugauguggauaacugccuucaucagguggguuuauaaaaagaugguggcacgggucgcggauaauauuaaccaggugaaucgcgaaaucggauggauggagggcgggcagcucgcucugggaaacccagcccccauaccucgacacgcaccaauuccgagauacucuacauaccuuaugcuguugcucaucguaucauaugccagugcuugcagcgaacugauccaggccuccucuaggauuaccacguguucgaccgagggugugaacacaaagugccgguuaagcggcacugcacugauccgugcuggguccguuggagccgaagcgugucuaaugcucaaaggcgucaaggaggaccaaaccaaauuucugaagauuaaaacagugucaagugagcuuucuugccgcgaaggucagagcuacuggacuggguccuucucacccaaguguuugagcucuagaaggugccaucuggugggcgagugucacgucaaucggugccucuccuggcgagauaacgaaaccagugccgaguuuagcuucguuggagaaucuacaaccaugcgcgagaauaaaugcuuugagcaguguggcggguggggaugcgguuguuucaacgugaauccuuccugccuguuugugcauacuuaucuucagucaguaagaaaggaagcucugagggucuucaacuguauagacugggugcacaaguugacgcucgagaucacagacuuugauggcaguguuagcaccauugaccugggggcaucguccucucgguucacuaauuggggaagcgugucauuaagucuggaugccgaaggcaucuccgguucuaacagcuuuuccuucaucgagucaccagggaaaggcuacgcuauugucgacgagcccuucagcgaaauaccucgccaaggauuucuaggcgagaucagaugcaauagugaaucuuccgugcucagcgcccacgagucgugucugagggcaccaaaccuuguuucauauaagcccaugauugaucaguuggaaugcaccacaaaucugaucgacccguucgugguauuugagcgugggucucucccucagacccggaacgauaaaacuuucgcggccaguaagggaaaucgaggcguccaggcuuuuuccaaagguagcgugcaagccgaccugacauuaauguucgauaacuuugagguggacuucgucggggcagcuguuucuugugaugccgcauuucugaaucuuacgggaugcuacagcuguaacgccggcgcuagagugugcuuguccauuaccucaacugguacaggcacccucagugcgcauaacaaggacgggagccugcacaucguacuaccaucugaaaauggaacaaaggaucagugccagauacugcauuucacugugcccgaggucgaagaggaauuuauguauuccugugacggcgacgagaggccucuccuggugaaagggacccuuaucgccauugaucccuucgacgaucgccgggaggcaggaggcgaaucaacgguugugaacccaaagagugguagcuggaacuuuuucgacugguucuccggguugaugucuugguuuggaggcccucugaaaaccaucuuacucauuugccuguacgucgcucuuucgaucggucuguucuuuuugcucauauaccugggcagaacagggcuaagcaagauguggcuggccgccacuaaaaaggcuucauga

SEQ ID NO: 11253 - RNA, 3204 nt, Artificial Sequence
  derived and/or modified CDS sequence (opt3) from RVFV(ZM-657)__DQ380204.1__Gn-Gc
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaagccuacuguucccacgcuaaugggucaggaauugugcaaauccaggucagcggcguuuggaagaaaccacuuugcgugggcuaugaacguguaguggucaagagagagcugagugccaaacccauacagaggguggaaccuuguacaacuugcaucaccaagugugagccacacggguugguugugcggucuacaggauuuaagauuuccagcgcagucgccugcgcuucggguguguguguaaccggcucucaaucccccucaacggagaucacucucaaauacccggggauuagucagagcuccggaggcgauaucgguguucauauggcgcacgacgaucagucugugagcucaaagauagucgcacauugcccuccccaggacccaugucuggugcacgggugcauugucugcgcccauggcuuaaucaacuaucaaugucacacagcucugagugccuucgugguuguguucguauuuuccagcauugcaaucaucugccucgccauucuuuaccgcguccugaaauguuugaagauagcuccuagaaaagugcuaaauccccugauguggaucaccgccuucauuagguggaucuauaagaagaugguugcacggguggcggauaacauaaaucaggucaaccgcgaaauuggauggauggagggcgggcagcucgugcugggaaauccagcucccaucccucgacacgccccaaucccgagauacucuacuuaccuuaugcuguugcucauuguaucauaugcaagugccugcagcgaacugauccaggcuuccucuaggauuacaaccuguucgacggagggugugaacaccaaaugccgguuaagcggcacagcccugauacgugcaggguccguuggagcugaagccugucuaaugcucaagggcgucaaagaggaccaaacuaaguuucugaaaaucaagaccgugucaagugagcuuucuugccgcgaaggucagagcuacuggacaggguccuucucacccaaauguuugagcucuagaaggugccaucuggugggcgagugucacgucaaccggugccucuccuggcgagauaaugaaaccagugcggaguuuagcuucguuggagaaucuacuacaaugcgcgagaacaagugcuuugagcaguguggcggguggggaugcgguuguuucaaugugaacccuuccugccuguuugugcauaccuaucuucagucaguaagaaaggaagcccugagggucuucaauuguauugacugggugcacaaauugacucucgagaucacggacuuugauggcaguguuagcacaaucgaccugggggcuucguccucucgguucaccaacuggggaagcgugucauuaagucuggaugcagaaggcauuuccgguucuaauagcuuuuccuucauagagucaccagggaagggcuacgccaucgucgacgagcccuucagcgaaauuccucgccaaggauuucuaggcgagaucagaugcaacagugaaucuuccgugcucagcgcucacgagucgugucugagggccccaaaucuuauuucauauaaacccaugaucgaucaguuggaaugcacuaccaaccugauagacccguucguuguguuugagcgugggucucucccucagacacggaaugauaagaccuucgcagcgaguaaaggaaaccgaggcguacaggccuuuuccaaggguagcguccaagcugaccugacuuuaauguucgauaauuuugagguggacuucgugggggccgcagucucuugugaugcugccuuucugaaccuuacaggaugcuacagcuguaaugcaggcgccagaguuugcuuguccaucacgucaaccgguacuggcagucucagcgcucauaacaaggacgggucucugcacauugugcuaccauccgaaaacggaacaaaagaucagugccagauccugcauuucaccguacccgagguggaagaggaauuuauguauucaugugacggcgacgagaggccucuccuggucaaggggacacuuauugcgaucgaucccuucgacgaucgccgggaggccggaggcgaaaguacugugguuaauccaaaaagcgguuccuggaacuuuuucgacugguucucuggguugaugucgugguuuggaggcccucugaagaccauauuacucauuugccuguacguggcacuuagcaucggucuguucuuuuugcucauuuaccugggcagaacggggcuaucaaaaauguggcuggcugccaccaagaaggccuccuga

SEQ ID NO: 11254 - RNA, 3204 nt, Artificial Sequence
  derived and/or modified CDS sequence (opt3) from RVFV(T-46 (228113))__DQ380199.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccaaagacuccggccagacgaagcgagaacugaaaucauuugauauuagucagugcccuaagaucgggggacauggcagcaagaaaugcacuggugacgccgcguucuguucugccuacgagugcaccgcacaguaugcuaaugccuacuguucccacgcuaacgggucaggaauugugcaaauccaggucagcggcguuuggaagaaaccacuuugcgugggcuaugaacguguaguggucaagagagagcugagugccaaacccauacagaggguggaaccuuguacaacuugcaucaccaagugugagccacacggguugguugugcggucuacaggauuuaagauuuccagcgcagucgccugcgcuucggguguguguguaaccggcucucaaucccccucaacggagaucacucucaaauacccggggauuagucagagcuccggaggcgauaucgguguucauauggcgcacgacgaucagucugugagcucaaagauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccguccuuuaccgcgugcugaaauguuugaagauugcuccuagaaaaguucuaaacccccugauguggauaaccgccuucaucagguggauuuauaagaagaugguggcacgggucgcggauaauaucaaccaggugaaucgcgaaauaggauggauggagggcgggcagcucguacugggaaacccagcucccauuccucgacacgccccaaucccgagauacucuacuuaccuuaugcuguugcucaucgugucauaugcaagugccugcagcgaacugauucaggcuuccucuaggaucacaaccuguucgacggaggguguuaacaccaaaugccgguuaagcggcacagcccugauucgugcaggguccgucggagcugaagccugucuaaugcucaagggcgugaaagaggaccaaacuaaguuucugaaaauaaagaccgugucaagugagcuuucuugccgcgaaggucagagcuacuggacaggguccuucucacccaaauguuugagcucuagaaggugccaucuggucggcgagugucacguuaaucggugccucuccuggcgagauaacgaaaccagugcggaguuuagcuucgugggagaaucuacuacaaugcgcgagaauaagugcuuugagcaguguggcggguggggaugcgguuguuucaacgugaauccuuccugccuguuuguacauaccuaucuucagucagucagaaaggaagcccugaggguguucaacuguaucgacuggguucacaaauugacucucgagauuacggacuuugauggcagugugagcacaaucgaccugggggcuucguccucucgguucaccaauuggggaagcgucucauuaagucuggaugcagaaggcaucuccgguucuaacagcuuuuccuucauugagucaccagggaagggcuacgccauaguggacgagcccuucagcgaaaucccucgccaaggauuucuaggcgagauuagaugcaauagugaaucuuccguucucagcgcucacgagucgugucugagggccccaaaccuuaucucauauaaacccaugauugaucaguuggaaugcacuaccaaucugaucgacccguucgugguauuugagcgugggucucucccucagacacggaacgauaagaccuucgcagcgaguaaaggaaaucgaggcguccaggccuuuuccaaggguagcgugcaagcugaccugacuuuaauguucgauaacuuugagguggacuucgucggggccgcaguuucuugugaugcugccuuucugaaucuuacaggaugcuacagcuguaacgcaggcgccagagugugcuuguccauaacgucaaccgguacuggcagucucagcgcucauaacaaggacgggucucugcacaucguacuaccauccgaaaauggaacaaaagaucagugccagauucugcauuucaccgugcccgaggucgaagaggaauuuauguauucaugugacggcgacgagaggccucuccuggugaaggggacacuuaucgcgauugaucccuucgacgaucgccgggaggccggaggcgaaaguacuguugugaacccaaaaagcgguuccuggaacuuuuucgacugguucucuggguugaugucgugguuuggaggcccucugaagaccaucuuacucauaugccuguacgucgcacuuagcauuggucuguucuuuuugcucaucuaccugggcagaacggggcuaucaaaaauguggcuggcugccaccaagaaggccuccuga

SEQ ID NO: 11255 - RNA, 3204 nt, Artificial Sequence
  derived and/or modified CDS sequence (opt3) from RVFV(MP12)__Z30318.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcuuagugcgcauggaaacccuuguaugaaagagaagcuggugaugaagacucacugcccaaaugauuaucagagcgcacaccauuugaacaaugacggcaaaauggccuccguuaagugucccccuaaauacgaacucaccgaggauugcaacuuuugucgccagaugacaggugcuucucugaagaaagggucguauccacugcaggaccucuucugccaaucaagcgaggaugacggaaguaaguuaaagaccaaaaugaagggcgugugugaagucggcgugcaggcccugaaaaagugcgaugggcagcuuuccacugcacacgagguaguuccguuugcuguguucaaaaauucuaagaaagucuacuuggacaagcuggaccuaaagacagaagagaaccuccugcccgauagcuuuguguguuucgagcauaaaggacaguauaaggguaccauggacuccggccaaacgaaacgagaacuuaagucauuugauauuagucagugcccuaaaaucgggggacacggcagcaagaagugcacuggugacgccgcguucuguucugccuacgagugcaccgcacaguacgcuaaugccuauuguucccacgcuaacgggucaggaauugugcagauccaagucagcggcguuuggaaaaagccacugugcgugggcuacgaacguguaguggucaaaagagaguugagugccaagcccauacagaggguggaaccuuguacaacuugcaucaccaaaugugagccacaugggcucguugugcggucuacaggauuuaagauuuccagcgcagucgccugcgcuucggguguguguguaaccggcucucagucccccucaacggagaucacucugaaguauccggggauuagucaaagcuccggaggcgauaucgguguucacauggcgcaugacgaucagucugugagcucaaaaauagucgcacacugcccuccccaggacccauguuuagugcaugauugcauugucugcgcccacgggcugaucaauuaccagugucacacagcucucagugccuucgugguuguguucguauuuuccagcauugcaaucaucugccuugccauucuguaucgcgucuugaagugucuaaaaauagcuccuagaaaggugcugaacccccucauguggaucaccgccuucauuagguggaucuacaaaaagaugguugcacggguggcgcauaauauaaaccaagucaaucgcgaaauuggcuggauggagggaggccagcuggugcuugggaacccagcucccaucccucgacacgccccaaucccgagauauucuacuuaccugauguugcuccugauuguaucauacgcaagugccugcagcgaauuaauccaggcuuccucuaggauuacaaccuguucgacggagggagugaacaccaagugccggcugagcgguacagcccuaauacgugcaggcuccguuggggcugaagccugucucaugcugaaaggagucaaggaggaccagacuaaauuucuuaaguugaaaaccgugucaagugagcugucuugccgcgaaggccaaagcuauuggacagguuccuucucacccaagugucucagcucuagaaggugccaucuggugggggagugucacgucaaucggugccuuuccuggcgagauaacgaaaccagugcggaguuuagcuucguuggcgaaucuacuacaaugcgcgagaauaaaugcuuugagcaguguggaggcugggggugcggauguuucaacgugaauccuuccugccuguuugugcacaccuacuugcagucaguaagaaaggaagcccucagggucuucaacuguaucgacugggugcauaagcugacuuuagagauuacggacuuugaugguaguguuagcacaaucgaccugggcgcuucguccucucgguucaccaauugggggagcgugucacuaagucucgaugcagaaggaaucuccggcucuaacagcuuuuccuucauugagucaccagguaaaggguaugccauagucgacgagcccuucagcgaaaucccucgccagggcuuucugggagagauuagaugcaauagugaaucuuccgugcuuagcgcucacgagucguguuugagggccccaaaccugaucucauacaagcccaugauugaucaacucgaaugcacuaccaaucugaucgacccguucguuguguuugagcguggcucuuuaccucagacacggaacgauaaaaccuucgcagcgaguaaggggaaucgaggaguacaggccuuuuccaaaggcagcguccaggcugaccugacucuuauguucgauaacuuugagguggacuucgugggugccgcagucucuugugaugcugccuuuuugaaucucacagggugcuauagcuguaacgcaggagccagaguuugccuguccauaacgucaaccggcacugguagucuaagcgcucauaacaaggacggcucucugcacaucgugcucccauccgaaaaugggacaaaggaucaaugccagauucugcauuucaccguacccgagguggaagaggaauuuauguacucaugugacggagacgagaggccucuuuuggucaaaggcacacugaucgcgauugaucccuucgacgaucgccgggaggccgggggagaaaguacugugguuaacccaaagagcggcuccuggaacuuuuucgacugguucucugguuuaaugucgugguuugggggaccucucaaaaccauccugcuuauaugccuguauguggcauugagcauuggccucuucuuucugcuaaucuaccuggguggcacggggcucucaaagauguggcuggcugccaccaaaaaggccuccuga

SEQ ID NO: 11256 - RNA, 3204 nt, Artificial Sequence
  derived and/or modified CDS sequence (opt3) from RVFV(200803166)__JF311381.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuaaagaaagggaaguuuccucuguuccaaucuuacgcacaccaucggacccuacucgaggccguccacgacacaauaaucgcuaaagccgauccacccucaugcgaccugcagagugcgcauggaaacccuuguaugaaggaaaaacuugugaugaagacucacugcccaaaugauuaucagagcgcacacuaccugaacaaugacggcaagauggccuccguuaaaugucccccuaaguaugaguugaccgaagauugcaacuuuugucgccagaugacaggugcuucucucaaaaaggggucguacccacugcaagaccuguucugccagucaagcgaggaugacggaaguaagcucaaaaccaagaugaaaggcgugugugaggucggcgugcaggccuuaaagaaaugcgaugggcagcuguccacugcacaugaaguaguuccguuugcuguguucaaaaauucuaagaaggucuaucuugacaaguuggaccugaaaacagaggaaaaccuacuccccgauagcuuuguguguuucgagcacaagggacaauacaaagguaccauggacuccggccagacgaagcgagagcugaaaucauuugauauuagucagugcccuaagaucgggggacauggcagcaagaaaugcacuggugacgccgcguucuguucugccuacgaaugcaccgcacaguaugcuaaugccuacuguucccacgcuaacgggucaggaauugugcaaauccaggucagcggcguuuggaagaaaccacuuugcgugggcuaugagcguguaguggucaagagagaacugagugccaaacccauacagaggguggagccuuguacaacuugcaucaccaagugugaaccacacggguugguugugcggucuacaggauuuaagauuuccagcgcagucgccugcgcuucggguguguguguaaccggcucucaaucccccucaacggagaucacucucaaauacccggggauuagucagagcuccggaggcgauaucgguguucauauggcgcacgacgaucagucugugagcucaaagauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuuuaccgcguccugaaauguuugaagauagcuccuagaaaagugcuaaacccccugauguggaucaccgccuucauuagguggguuuauaagaagaugguggcacgggucgcggauaauaucaaccaggugaaucgcgagauaggauggauggaaggcgggcagcucguacugggaaacccagcucccauuccucgacacgccccaaucccgagauacucuacuuaccuuaugcuguugcucaucgugucauaugcaacagccugcagugagcugauucaggcuagcuccaggaucaccacguguucuaccgaagguguuaacacaaaaugccgguuaucgggcacugcccugauucgugcagggagcgucggagcugaggccugucuaaugcucaagggcgugaaagaagaccaaaccaaguuucugaaaauaaagacaguguccucagagcuuaguugccgcgagggucagucuuacuggacugggagcuucucccccaaauguuugucaagcagaaggugccaucuggucggcgaaugucacguuaaucggugccucucuuggcgagauaacgagaccuccgcggaauuuaguuucgugggagagagcacaaccaugcgcgaaaauaagugcuuugagcaguguggcggguggggaugcgguuguuucaacgugaauccuucuugccuguuuguacauacuuaucuucaguccgucagaaaggaggcccugaggguguucaacuguaucgacuggguucacaaauugacgcucgaaauuacagacuuugauggcucagugaguaccaucgaccugggggcuagcucgucccgguucacuaauuggggaucugucagcuuaucacuggaugcagagggcaucagugguuccaacucuuuuagcuucauugaauccccagggaagggcuacgccauaguggacgagcccuucucagagaucccucgccaaggauuucuaggcgaaauuagaugcaauagcgagaguucuguucucuccgcucacgaaagcugucugagggccccaaaccuuaucucguauaaacccaugauugaucaguuggagugcaccacaaaucugaucgacccguucgugguauuugaacgugggucacucccucagacccggaacgauaagacuuucgcagcgucuaaaggaaaucgaggcguccaggccuuuaguaaggguuccgugcaagcugaccugacauuaauguucgauaacuuugagguggacuucgucggggccgcaguuagcugugaugcugccuuucugaaucuuacgggaugcuacucuuguaacgcaggcgccagagugugcuugagcauaaccuccacugguacaggcacccucucagcucauaacaaggacgggagucugcacguagugcuaccaagcgagaauggaacaaaagaucagugccagauccugcauuucacuguccccgaaguggaggaagaguuuauguauucuugugacggcgacgaaaggccucuccugguuaaggggacccuuauugcgaucgaucccuucgacgaucgccgggaggccggaggcgaguccacgguggucaacccaaaaucagguaguuggaacuuuuucgacugguucagcggguugauguccugguuuggaggcccucugaagaccauuuuacucaucugccuguacguggcacuuucuauaggucuguucuuuuugcucauuuaccugggcagaacagggcuaucgaaaauguggcuggcugccacuaagaaggccagcuga

SEQ ID NO: 11257 - RNA, 3204 nt, Artificial Sequence
  derived and/or modified CDS sequence (opt3) from RVFV(200803162)__JF311377.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucgcaaaaugugagccacacggguugguugugcggucuaccggauuuaagauuuccagcgccgucgcuugcgcgucggguguguguguaacaggcucucaaucccccucaaccgagaucacgcucaaguacccggggauuagucagagcuccggaggcgauaucgguguucauauggcacacgacgaucagucugugagcucaaaaauagucgcccauugcccuccccaggacccaugucuggugcacgauugcauugucugcgcucauggguuaaucaauuaucaaugucacacugcccugagugcauucgugguuauuuucguguuuuccagcacagccaucaucugccucgcuguacuuuaccgcguccugaaguguuugaaaauugccccuagaaaggugcuaaacccccugauguggauaaccgcauucaucagguggguuuauaaaaagaugguggcgcgggucgcugacaauauuaaccaggugaaucgcgaaaucggcuggauggagggaggccagcucgcccugcgaaacccagcacccauaccuagacacgccccaauuccgagguacucuacuuaccuuaugcuguugcucaucguaucauaugcuagugccugcagcgaacugauccaggcauccucucggauuacaaccuguucgacggagggggugaacaccaagugccguuuaagcggaacagcucugauccgcgccgguuccguuggcgcggaagccugucuaaugcucaaaggggucaaggaggaucaaacuaaauuucugaagauuaaaaccgugucaagugagcuuucuugcagagaaggacagagcuacuggacaggcuccuucucacccaaguguuugagcucuaggcggugccaucuggugggugagugucacgucaaucgaugccucuccuggcgcgacaacgaaacaagugcugaguuuagcuucguuggggaaucuaccacaaugagagagaauaaaugcuuugagcaguguggcggauggggcugcggguguuucaacgugaauccuuccugccuguuugugcauaccuaucuucagucaguaaggaaggaagcacugcgggucuucaacuguauagacugggugcacaaguugacucucgagaucacggauuuugacggaaguguuagcacaauugaucugggugccucguccucucgcuucaccaauuggggcagcgugucauuaagucuggacgcugaagggaucuccggaucuaacagcuuuuccuucaucgagucaccaggcaaagguuacgccauugucgaugagcccuucagcgaaauaccuagacaaggguuucuaggcgagaucaggugcaauagugaaucuuccgugcucagcgcacacgagucgugucugcgugcgccaaaccuuguuucauauaagcccaugauugaccaguuggaaugcacuaccaaucugaucgauccguucgugguauuugagcggggaucucucccucagacacgaaacgacaaaaccuucgccgcuaguaagggcaauagagggguccaggccuuuuccaaaggaagcgugcaagcagaucugacuuuaauguucgacaacuuugagguggauuucgucggcgcugccguuucuugugacgcagccuuucugaaucuuacagguugcuacagcuguaacgcuggggcgagggugugcuuguccauuacgucaaccggaacuggcacacucagugcccauaacaaggaugguagccugcacaucguacuaccaucugaaaauggcaccaaggaccagugccagauacugcauuucacagugcccgaggucgaagaggaauuuauguauuccugugacggggaugagcgcccucuccuggugaaaggaacucuuaucgcaauugaccccuucgaugaccggagagaggcuggcggggaaucaaccguugugaacccaaagaguggaagcuggaacuuuuucgauugguucuccggcuugaugucuugguuuggugggccucugaaaacgaucuuacucauuugccuguacgucgcccuuucgaucggacuguucuuuuugcucauauaccugggcaggaccggucuaagcaagauguggcuggccgcuacuaaaaaggcaucauga

SEQ ID NO: 11258 - RNA, 3204 nt, Artificial Sequence
  derived and/or modified CDS sequence (opt3) from RVFV(Hv-B375)__DQ380218.1__Gn-Gc
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaaaacgaauugaccgaggauugcaauuuuugucgccagaugacaggugcuucucucaagaaagggucguauccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaacucuaagaaagucuaccuugacaaguuggaccugaagacagaagagaaucuacuccccgauagcuuuguguguuucgagcacaaaggacaauauaaggguaccauggacuccggccagacgaaacgagaacugaagucauuugauauuagucagugcccuaaaaucgggggacauggcagcaagaagugcacuggugacgccgcguucuguucugccuacgagugcaccgcacaguacgcuaacgccuauuguucccacgcuaaugggucaggaauugugcaaauccaggucagcggcguuuggaaaaagccacuuugcgugggcuacgaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguauccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaacuaccaaugucacacagcucugagugccuucgugguuguguucguauuuuccagcauugcaaucaucugccucgccauucuuuaucgcguccugaaguguuugaaaauagcuccuagaaaggugcuaaauccccugauguggaucaccgccuucauuagguggguuuacaaaaagaugguggcacgggucgcggauaacaucaaucaggugaaccgcgaaauaggauggauggagggcgggcagcucguacugggaaacccagcucccauuccucgacacgccccaaucccgagauauucuacuuaccuuaugcuguugcucaucgugucauacgcaagugccugcagcgaacugauucaggcuuccucuaggaucacaaccuguucgacggaggguguuaauaccaagugccgguuaagcggcacagcccugauucgugcaggguccgucggagcugaagccugucuaaugcucaaaggcgugaaggaggaccaaacuaaauuucugaagauaaaaaccgugucaagugagcuuucuugccgcgaaggucagagcuauuggacaggguccuucucacccaaguguuugagcucuagaaggugccaucuggucggcgagugucacguuaaccggugccucuccuggcgagauaaugaaacaagugcggaguuuagcuucgugggagaaucuaccacaaugcgcgagaacaaaugcuuugagcaguguggcggguggggaugcgguuguuucaaugugaacccuuccugccuguuuguacauaccuaccuucagucagucagaaaggaagcccugaggguguucaauuguaucgacuggguucacaaguugacucucgagauuacggacuuugauggcagugugagcacaaucgaccugggggcuucguccucucgguucaccaacuggggaagcgucucauuaagucuggaugcagaaggcaucuccgguucuaauagcuuuuccuucauugagucaccagggaaaggcuaugccauaguggacgagcccuucagcgaaaucccucgccaaggauuucuaggcgagauuagaugcaacagugaaucuuccguucucagcgcucacgagucgugucugagggccccaaaucuuaucucauacaagcccaugauugaucaguuggaaugcacuaccaaccugaucgacccguucgugguauuugagcgugggucucucccucagacacggaaugauaaaaccuucgcagcgaguaagggaaaccgaggcguccaggccuuuuccaaagguagcgugcaagcugaccugacuuuaauguucgauaauuuugagguggacuucgucggggccgcaguuucuugugaugcugccuuucugaaccuuacaggaugcuauagcuguaacgcaggcgccagagugugcuuguccauaacgucaaccgguacuggcacacucagugcucauaauaaggacgggagccugcacaucguacuaccaucugaaaacggaaccaaggaucagugccagauucugcauuucacagugcccgaggucgaagaggaauuuauguacuccugugacggcgacgagaggccucuccuggugaaagggacucuuaucgcgauugaucccuucgacgaucgccgggaggccggaggcgaaucaaccguugugaauccaaagagugguagcuggaacuuuuucgacugguucuccggguugaugucuugguuuggaggcccucugaaaacgaucuuacucauaugccuguaugucgcacuuucgauuggucuguucuuuuugcucaucuaccugggcagaaccgggcuaagcaagauguggcuggcugccacuaaaaaggccucauga

SEQ ID NO: 11259 - RNA, 3204 nt, Artificial Sequence
  derived and/or modified CDS sequence (opt3) from RVFV(1260/78)__DQ380214.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuucaccgcguccugaaguguuugaaaauagcuccuagaaaggugcuaaacccccugauguggaucaccgccuucauuagguggguuuacaaaaagaugguggcacgggucgcggauaauaucaaccaggugaaucgcgaaauaggauggauggagggcgggcagcucguacugggaaacccagcucccauuccucgacaugccccaaucccgagauauucuacuuaccuuaugcuguugcucaucgugucauacgcaagugccugcagcgaacugauucaggcuuccucuaggaucacaaccuguucgacggaggguguuaacaccaagugccgguuaagcggcacagcccugauucgugcaggguccgucggagcugaagccugucuaaugcucaaaggcgugaaggacgaucaaacuaaauuucugaagauaaaaaccgugucaagugagcuuucuugccgcgagggucagagcuauuggacaggguccuucucacccaaguguuugagcucuagaaggugccaccuggucggcgaaugucauguuaaucggugccucuccuggcgagacaacgagacaagugcggaauuuagcuucgugggagagucuaccacaaugcgcgaaaauaaaugcuuugagcaguguggcggguggggaugcgguuguuucaacgugaauccuuccugccuguuuguacacaccuaccuucagucagucagaaaggaggcccugaggguguucaacuguaucgacuggguucacaaguugacucucgaaauuacggauuuugacggcagugugagcacaaucgaucugggggcuucguccucucgguucaccaauuggggaagcgucucauuaagucuggacgcagagggcaucuccgguucuaacagcuuuuccuucauugaaucaccagggaaaggcuaugccauaguggaugagcccuucagcgagaucccucgccaaggauuucuaggcgaaauuagaugcaauagugagucuuccguucucagcgcucaugaaucgugucugagggccccaaaccuuaucucauacaagcccaugauugaccaguuggagugcacuaccaaucugaucgauccguucgugguauuugaacgugggucucucccucagacacggaacgacaaaaccuucgcagcgaguaagggaaaucgaggcguccaggccuuuuccaaagguagcgugcaagcugaucugacuuuaauguucgacaacuuugagguggauuucgucggggccgcaguuucuugugacgcugccuuucugaaucuuacaggaugcuauagcuguaacgcaggcgccagagugugcuuguccauaacgucaaccgguacuggcacacucagugcucacaacaaggaugggagccugcauaucguacuaccaucugagaauggaaccaaggaccagugccagauucugcacuucacagugcccgaagucgaggaagaguuuauguacuccugugacggcgaugaaaggccucuccuggugaaagggacucuuaucgcgauugaccccuucgaugaccgccgggaggccggaggcgagucaaccguugugaacccaaagagugguagcuggaacuuuuucgauugguucuccggguugaugucuugguuuggaggcccucugaaaacgaucuuacucauaugccuguaugucgcacuuucgauuggucuguucuuuuugcucaucuaccugggcagaaccgggcuaagcaagauguggcuggcugccacuaaaaaggccucauga

SEQ ID NO: 11260 - RNA, 3204 nt, Artificial Sequence
  derived and/or modified CDS sequence (opt3) from RVFV(ZH-501-777)__DQ380202.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacccuggccagacgaaacgagaacugaaguccuuugauauuucacagugcccaaaaaucgggggacauggcaguaagaagugcacuggugacgccgcguucuguagcgccuacgagugcaccgcacaguaugcuaaugccuacuguucucacgcuaacggguccggaauugugcaaauccaggucucaggcguuuggaaaaagccccuuugcgugggcuaugaacguguaguggucaaaagagagcugagcgccaagccuauacagaggguggaaccauguacaacuugcaucaccaaaugugagccccacggguugguugugcggaguacaggauuuaagauuucuuccgcagucgccugcgcuagcgguguguguguaaccggcucgcaaucuccguccacggagaucacucucaaguacccugggauuucacagaguagcggaggcgauaucgguguucauauggcgcacgacgaucaguccgugucuagcaaaauagucgcacauugucccccacaggacccuugccuggugcacgggugcauugucugcgcccauggcuuaaucaauuaucaaugucacacagcucugucagccuucgugguuguguucguauuuaguuccauugcaaucaucugccucgccguccuuuaccgcgugcugaaguguuugaaaauugcucccagaaagguucuaaacccacugauguggauaaccgccuucaucagguggauuuauaaaaagaugguggcacgggucgcggauaauaucaaccaggugaaucgcgaaauaggauggauggagggcgggcagcucguacugggaaaccccgcuccuauuccacgacacgccccgauccccagauacagcacuuaccuuaugcuguugcucaucgugucuuaugcaucagccugcagugaacugauucaggcuagcuccaggaucacaaccuguucuacggaggguguuaacaccaagugccgguuaucgggcacagcccugauucgugcagggagcgucggagcugaagccugucuaaugcucaaaggcgugaaggaggaccaaacuaaauuucugaagauaaaaaccguguccucagagcuuaguugccgcgaaggucagucuuacuggacagggagcuucuccccuaaguguuugucaagcagaaggugccaucuggucggcgagugucacguuaaucggugccucucuuggcgagauaacgaaacuuccgcggaguuuaguuucgugggagaaagcaccacaaugcgcgagaauaaaugcuuugagcaguguggcggguggggaugcgguuguuucaacgugaauccaucuugccuguuuguacauaccuaucuucaguccgucagaaaggaagcccugaggguguucaacuguaucgacuggguucacaaguugacucucgagauuacggacuuugauggcucagugaguacaaucgaccugggggcuagcucgucccgguucaccaauuggggaucugucagcuuaucacuggaugcagaaggcaucagugguuccaacucuuuuagcuucauugagucccccgggaaaggcuacgccauaguggacgagccuuucucagaaaucccacgccaaggauuucuaggcgagauuagaugcaauagcgaaaguucuguucucuccgcucacgagagcugucugagggcccccaaccuuaucucguauaagccgaugauugaucaguuggaaugcacuaccaaucugaucgacccuuucgugguauuugagcgugggucacucccacagacacggaacgauaaaaccuucgcagcgucuaagggaaaucgaggcguccaggccuuuaguaaagguuccgugcaagcugaccugacuuuaauguucgauaacuuugagguggacuucgucggggccgcaguuagcugugaugcugccuuucugaaucuuacaggaugcuacucuuguaacgcaggcgccagagugugcuugagcauaacguccaccgguacuggcucacucagugcucauaacaaggacgggagccugcacaucguacuacccucugaaaauggaacaaaggaucagugccagauucugcauuucaccgugccugaggucgaagaggaauuuauguauuccugugacggcgacgagaggccccuccuggugaaagggacacuuaucgcgauugauccauucgacgaucgccgggaggccggaggcgaaucaacuguugugaacccuaagagugguagcuggaacuuuuucgacugguucuccggguugaugucuugguuuggaggcccccugaaaaccaucuuacucauaugccuguacgucgcacuuucgauuggucuguucuuuuugcucaucuaccugggcagaacggggcuaagcaagauguggcuggcugccaccaaaaaggccucauga

SEQ ID NO: 11261 - RNA, 3204 nt, Artificial Sequence
  derived and/or modified CDS sequence (opt3) from RVFV(OS-3)__DQ380184.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggagugguccaaauucagguuagcggcguguggaaaaagccacuuugcguaggcuaugaacguguggucgugaaaagagagcugagugccaagcccauccagaggguugaaccuuguacaacuugcauaaccaaaugugagccacacggguuggugguccggucuacaggauuuaagaucuccagcgcaguggccugcgcuucggguguauguguuaccggcucucaaucccccucaacggagauuacucucaaguacccggggaucagucagagcuccggaggcgauauuggugugcauauggcgcacgacgaucagucugucagcucaaaaaucguggcacauugcccuccccaggacccaugucugguccacgggugcauagugugcgcccauggcuuaauuaauuaucaaugucacacagcucugagugccuucguugugguauucgucuuuuccagcguggcaaucauuugccucgccauccuuuacaagguucugaaauguuugaagaucgcuccucgcaaagugcuaaacccccugauguggauuaccgccuucauaagaugggucuauaagaagaugguggcaaggguagcggauaauaucaaccaggugaaucgggaaauuggauggauggagggcgggcagcucgcucugggaaacccagcccccaucccucgccacgcaccaauaccgcgauacucuacuuaccuuaugcuguugcucauuguuucauaugccagugcuugcagcgaacugauccaggccuccucuagaaucacaaccuguucgacggagggugucaacaccaaaugcagguuaagcggcacagcacugauucgggcuggguccgugggagccgaagcgugucuaaugcucaagggcgugaaagaggaccaaacuaaguuucugaaaaucaagaccgucucaagugagcuuucuugccgugaaggucagagcuacuggacaggguccuucucacccaaauguuugagcucucgcagaugccaucugguuggcgagugucacgugaauaggugccucuccuggcgggauaacgaaaccagugccgaguuuagcuucgugggagaaucuacuacaaugcgagagaauaagugcuuugagcaguguggcggguggggaugcgguuguuucaacguaaauccuuccugccuguuuguccauaccuaucuucagucagugcgcaaggaagcucugagaguuuucaacuguauugacugggugcacaaauugacucucgagauaacggacuuugauggcagugucagcacaaucgaccugggggcaucguccucuagguucaccaauuggggaagcgugucauuaagucuggaugccgaaggcauuuccgguucuaacagcuuuuccuucaucgagucaccagggaagggcuacgcuaucguugacgagcccuucagcgaaauuccucggcaaggauuucuaggcgagauacgcugcaauagugaaucuuccgugcucagcgcccacgagucgugucugagagcaccaaaccuuaucucauauaaacccaugauugaucaguuggaaugcacuaccaaucugaucgacccguucguagucuuugagagggggucucucccucagacacguaacgauaagaccuucgcggccaguaaaggaaaucggggcgugcaggcuuuuuccaaggguagcgugcaagccgaccugacuuuaauguucgauaacuuugaggucgacuucguuggggcagcugugucuugugaugccgcauuucugaaucuuacaggaugcuacagcuguaacgccggcgcucgaguaugcuuguccauuacgucaaccgguacuggcacacucagugcgcauaacaaggacgggagccugcacaucgugcuaccaucugaaaauggaaccaaagaucagugccagauacugcauuucacaguccccgagguggaagaggaauuuauguauuccugugacggcgacgagagaccucuccugguuaaggggacucuuaucgccauugaucccuucgacgauaggcgcgaggcaggaggcgaaucaaccguggucaacccaaaaagugguagcuggaacuuuuucgacugguucuccggguugaugucuugguuuggaggcccucugaagacgaucuuacucauuugccuguacguggcucuuucgaucggucuguucuuuuugcucauauaccugggccggaccgggcuaagcaaaauguggcuggccgccacaaagaaggcuucauga

SEQ ID NO: 11262 - RNA, 3204 nt, Artificial Sequence
  derived and/or modified CDS sequence (opt3) from RVFV(SAUDI 200010901)__KU978778.1__Gn-Gc
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuuuuguucccacgcuaacgggucaggaauugugcaaauccaggucagcggcguuuggaaaaagccacuuugcgugggcuacgaacguguaguggucaaaagagagcugagugccaagcccauacagaggguggaaccuuguacaacuugcaucaccaaaugugagccacacggguugguugugcggucuacaggauucaagauuuccagcgcagucgccugcgcuucggguguguguguaaccggcucucaaucccccucaacggagaucacucucaaguauccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaccaaugucacacagcucugagugccuucgugguuguguuuguauucuccagcauugcaaucaucugccucgccauucuuuaucgcguccugaaguguuugaaaauagcuccuagaaaggugcuaaacccccugauguggaucaccgccuuuauuagguggguuuacaaaaagaugguggcacgggucgcggauaauaucaaccaggugaaucgcgaaauaggauggauggagggcgggcagcucguacugggaaacccagcucccauuccucgacacgccccaaucccgagauauucuacuuaccuuaugcuguugcucaucauuucauacgcaagugccugcagcgaacugauccaggcuuccucuaggauuacaaccuguucgacggagggugugaacaccaagugccgguuaagcggcacagcccugauacgugcaggguccguuggagcugaagccugucuaaugcucaaaggcgucaaggaggaccaaacuaaauuccugaagaucaaaaccgugucaagugagcuuucuugccgcgaaggucagagcuauuggacaggguccuuuucacccaaguguuugagcucuagaaggugccaucuggugggcgagugucacgucaaucggugccucuccuggcgagauaacgaaacaagugcggaguucagcuuuguuggagaaucuaccacaaugcgcgagaauaaaugcuucgagcaguguggcggguggggaugcgguuguuuuaacgugaauccuuccugccuguucgugcauaccuaccuucagucaguaagaaaggaagcccugagggucuuuaacuguauugacugggugcacaaguugacucucgagaucacggacuucgauggcaguguuagcacaaucgaccugggggcuucguccucucgguuuaccaauuggggaagcgugucauuaagucuggaugcagaaggcauuuccgguucuaacagcuucuccuucauagagucaccagggaaaggcuaugccaucgucgacgagcccuuuagcgaaauuccucgccaaggauuccuaggcgagaucagaugcaauagugaaucuuccgugcucagcgcucacgagucgugucugagggccccaaaccuuauuucauacaagcccaugaucgaucaguuggaaugcacuaccaaucugauagacccguuuguuguguucgagcgugggucucucccucagacacggaacgagaaaaccuuugcagcgaguaagggaaaucgaggcguacaggccuucuccaaagguagcguccaagcugaucugacuuuaauguuugacaacuucgaaguggauuuugugggggccgcagucucuugugacgcugccuuccugaaucuuacaggaugcuauagcuguaacgcaggcgccagaguuugcuuguccaucacgucaaccgguacuggcacacucagugcucauaacaaggaugggagccugcacauugugcuaccaucugagaauggaaccaaggaccagugccagauccugcauuuuacaguacccgaaguggaggaagaguucauguacuccugugauggcgacgagaggccucuccuggucaaagggacucuuauugcgaucgaccccuuugaugaccgccgggaagccggaggcgagucaaccgugguuaacccaaagagugguagcuggaauuucuucgauugguuuuccggguugaugucuugguucggaggcccucugaaaacgauauuacucauuugccuguauguggcacuuucgaucggucuguuuuucuugcucauuuaccugggcagaaccgggcuaagcaagauguggcuggcugccacuaaaaaggccucauga

SEQ ID NO: 11263 - RNA, 3204 nt, Artificial Sequence
  derived and/or modified CDS sequence (opt3) from RVFV(2007001811)__EU574040.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuuuaccgcguccugaaguguuugaaaauagcuccuagaaaggugcuaaacccccugauguggaucaccgccuucauuagguggguuuauaaaaagaugguggcacgggucgcggauaauaucaaccaggugaaucgcgaaauaggauggauggagggcgggcagcucguacugggaaacccagcucccauuccucgacacgccccaaucccgagauacucuacuuaccuuaugcuguugcucaucgugucauaugcaagugccugcagcgaacugauucaggcuuccucuaggaucacaaccuguucgacggaggguguuaacaccaagugccgguuaagcggcacagcccugauucgugcaggguccgucggagcugaagccugucuaaugcucaaaggcgugaaggaggaccaaacuaaauuucugaugauaaagaccgugucaagugagcuuucuugccgcgaaggucagagcuacuggacaggguccuucucacccaaauguuugagcucuagaaggugccaucuggucggcgagugucacguuaaucggugccucuccuggcgagauaacgaaaccagugcggaguuuagcuucgugggagaaucuacuacaaugcgcgagaauaagugcuuugagcaguguggcggguggggaugcgguuguuucaacgugaauccuuccugccuguuuguacauaccuaucuucagucagucagaaaagaagcccugaggguguucaacuguaucgacuggguucacaaguugacucucgagauuacggacuuugauggcagugugagcacaaucgaccugggggcuucguccucucgguucaccaauuggggaagcgucucauuaagucuggaugcagaaggcaucuccgguucuaacagcuuuuccuucauugagucaccagggaagggcuacgccauaguggacgagcccuucagcgaaaucccucgccaaggauuucuaggcgagauuagaugcaauagugaaucuuccguucucagcgcucacgagucgugucugagggccccaaaccuuaucucauauaaacccaugauugaucaguuggaaugcacuaccaaucugaucgacccguucgugguauuugagcgugggucucucccucagacacggaacgagaagaccuucgcagcgaguaaaggaaaucgaggcguccaggccuuuuccaaggguagcgugcaagcugaucugacuuuaauguucgacaacuuugaaguggauuucgucggggccgcaguuucuugugacgcugccuuucugaaucuuacaggaugcuacagcuguaacgcaggcgccagagugugcuuguccauaacgucaaccgguacuggcacacucagugcucauaacaaagaugggagccugcacaucguacuaccaucugagaauggaaccaaggaccagugccagauucugcauuucacagugcccgaagucgaggaagaguuuauguauuccugugauggcgacgagaggccucuccuggugaaggggacucuuaucgcgauugaccccuucgaugaccgccgggaagccggaggcgagucaaccguugugaacccaaaaagugguagcuggaacuuuuucgauugguucuccggguugaugucuugguuuggaggcccucugaagacgaucuuacucauaugccuguacgucgcacuuucgauuggucuguucuuuuugcucaucuaccugggcagaaccgggcuaagcaaaauguggcuggcugccacaaagaaagccucauga

SEQ ID NO: 11264 - RNA, 3204 nt, Artificial Sequence
  derived and/or modified CDS sequence (opt3) from RVFV(2007000253)__JF326192.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuauuuucguguuuuccagcaccgcaaucaucugccucgccguacuuuaccgcguccugaaguguuugaaaauugcuccuagaaaggugcuaaacccccugauguggauaacugccuucaucagguggguuuauaaaaagaugguggcacgggucgcggauaauauuaaccaggugaaucgcgaaaucggauggauggagggcgggcagcucgcucugggaaacccagcccccauaccucgacacgcaccaauuccgagauacucuacauaccuuaugcuguugcucaucguaucauaugccagugcuugcagcgaacugauccaggccuccucuaggauuaccacguguucgaccgagggugugaacacaaagugccgguuaagcggcacugcacugauccgugcuggguccgccggagcggaagccugucuaaugcucaaaggcguuaaggaggaccaaaccaaauuucugaagauuaaaacagucucaagugagcuuucuugccgcgaaggucagagcuacuggacuggguccuucucacccaaguguuugagcucuagaaggugccaucuggugggcgagugucacgugaaucggugccucuccuggcgagauaacgaaaccagugcugaguuuagcuucgucggagaaucuacaaccaugcgcgagaauaaaugcuuugagcaguguggcggguggggaugcgguuguuucaacguuaauccuuccugccuguuugugcauacuuaucuucagucagugagaaaggaagcacugaggguauucaacuguauagacuggguccacaaguugacgcucgagaucacagacuuugauggcagugugagcaccauugaccugggggccucguccucucgguucacuaauuggggaagcguuucauuaagucuggaugcugaaggcaucuccgguucuaacagcuuuuccuucaucgagucaccagggaaaggcuacgccauuguggacgagcccuucagcgaaauaccucgccaaggauuucuaggcgagaucagaugcaauagugaaucuuccguccucagcgcacacgagucgugucugagggcgccaaaccuugugucauauaagcccaugauugaucaguuggaaugcaccacaaaucugaucgacccguucguuguguuugagcgugggucucucccucagacccggaacgauaaaacuuucgccgcuaguaagggaaaucgaggcguacaggccuuuuccaaagguagcguccaagcagaccugacauuaauguucgauaacuuugagguggacuucgugggggcugccgucucuugugaugcagccuuucugaaucuuacgggaugcuacagcuguaacgcuggcgcgagaguuugcuuguccauuaccucaacugguacaggcacccucagugcccauaacaaggacgggagccugcacaucgugcuaccaucugaaaauggaacaaaggaucagugccagauacugcauuucacuguacccgagguggaagaggaauuuauguauuccugugacggcgacgagaggccucuccuggucaaagggacccuuaucgcaauugaucccuucgacgaucgccgggaggcuggaggcgaaucaacggugguuaacccaaagagugguagcuggaacuuuuucgacugguucuccggguugaugucuugguuuggaggcccucugaaaaccaucuuacucauuugccuguacguggcccuuucgaucggucuguucuuuuugcucauauaccugggcagaacagggcuaagcaagauguggcuggccgcuacuaaaaaggcaucauga

SEQ ID NO: 11265 - RNA, 3204 nt, Artificial Sequence
  derived and/or modified CDS sequence (opt3) from RVFV(2007001292)__EU574046.1__Gn-Gc
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuauuuucguguuuuccagcaccgcaaucaucugccucgccguacuuuaccgcguccugaaguguuugaaaauugcuccuagaaaggugcuaaacccccugauguggauaacugccuucaucagguggguuuauaaaaagaugguggcacgggucgcggauaauauuaaccaggugaaucgcgaaaucggauggauggagggcgggcagcucgcucugggaaacccagcccccauaccucgacacgcaccaauuccgagauacucuacauaccuuaugcuguugcucaucguaucauaugccagugcuugcagcgaacugauccaggccuccucuaggauuaccacguguucgaccgagggugugaacacaaagugccgguuaagcggcacugcacugauccgugcuggguccguuggagccgaagcgugucuaaugcucaaaggcgucaaggaggaccaaaccaaauuucugaagauuaaaacagugucaagugagcuuucuugccgcgaaggucagagcuacuggacuggguccuucucacccaaguguuugagcucuagaaggugccaucuggugggcgagugucacgucaaucggugccucuccuggcgagauaacgaaaccagugccgaguuuagcuucguuggagaaucuacaaccaugcgcgagaauaaaugcuuugagcaguguggcggguggggaugcgguuguuucaacgugaauccuuccugccuguuugugcauacuuaucuucagucaguaagaaaggaagcucugagggucuucaacuguauagacugggugcacaaguugacgcucgagaucacagacuuugauggcaguguuagcaccauugaccugggggcaucguccucucgguucacuaauuggggaagcgugucauuaagucuggaugccgaaggcaucuccgguucuaacagcuuuuccuucaucgagucaccagggaaaggcuacgcuauugucgacgagcccuucagcgaaauaccucgccaaggauuucuaggcgagaucagaugcaauagugaaucuuccgugcucagcgcccacgagucgugucugagggcaccaaaccuuguuucauauaagcccaugauugaucaguuggaaugcaccacaaaucugaucgacccguucgugguauuugagcgugggucucucccucagacccggaacgauaaaacuuucgcggccaguaagggaaaucgaggcguccaggcuuuuuccaaagguagcgugcaagccgaccugacauuaauguucgauaacuuugagguggacuucgucggggcagcuguuucuugugaugccgcauuucugaaucuuacgggaugcuacagcuguaacgccggcgcuagagugugcuuguccauuaccucaacugguacaggcacccucagugcgcauaacaaggacgggagccugcacaucguacuaccaucugaaaauggaacaaaggaucagugccagauacugcauuucacugugcccgaggucgaagaggaauuuauguauuccugugacggcgacgagaggccucuccuggugaaagggacccuuaucgccauugaucccuucgacgaucgccgggaggcaggaggcgaaucaacgguugugaacccaaagagugguagcuggaauuuguuugacugguucuccgggcugaugucuugguucggaggcccuuuaaaaaccauccuccugauuugccuuuacgucgcucugucgaucgguuuguuuuuccuccugauauaccuaggcagaacagggcugagcaagauguggcucgccgccacuaaaaaggcuucauga

SEQ ID NO: 11266 - RNA, 3204 nt, Artificial Sequence
  derived and/or modified CDS sequence (opt3) from RVFV(2007002476)__EU574036.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuauuuucguguuuuccagcaccgcaaucaucugccucgccguacuuuaccgcguccugaaguguuugaaaauugcuccuagaaaggugcuaaacccccugauguggauaacugccuucaucaaauggguuuauaagaagaugguggcaagggucgcggauaauauuaaccaggugaaucgggaaaucggauggauggagggcgggcagcucgcucugggaaacccagcccccauaccucgccacgcaccaauuccgcgauacucuacauaccuuaugcuguugcucaucguaucauaugccagugcuugcagcgaacugauccaggccuccucuagaauuaccacguguucgaccgagggugugaacacaaaaugcagguuaagcggcacugcacugauccgggcuggguccguuggagccgaagcgugucuaaugcucaagggcgucaaagaggaccaaaccaaguuucugaaaauuaagacagugucaagugagcuuucuugccgugaaggucagagcuacuggacuggguccuucucacccaaauguuugagcucucgcagaugccaucuggugggcgagugucacgucaauaggugccucuccuggcgggauaacgaaaccagugccgaguuuagcuucguuggagaaucuacaaccaugcgagagaauaagugcuuugagcaguguggcggguggggaugcgguuguuucaacgugaauccuuccugccuguuugugcauacuuaucuucagucaguacgcaaggaagcucugagagucuucaacuguauagacugggugcacaaauugacgcucgagaucacagacuuugauggcaguguuagcaccauugaccugggggcaucguccucuagguucacuaauuggggaagcgugucauuaagucuggaugccgaaggcaucuccgguucuaacagcuuuuccuucaucgagucaccagggaagggcuacgcuauugucgacgagcccuucagcgaaauaccucggcaaggauuucuaggcgagauccgcugcaauagugaaucuuccgugcucagcgcccacgagucgugucugagagcaccaaaccuuguuucauauaaacccaugauugaucaguuggaaugcaccacaaaucugaucgacccguucgugguauuugagagggggucucucccucagacccguaacgauaagacuuucgcggccaguaaaggaaaucggggcguccaggcuuuuuccaaggguagcgugcaagccgaccugacauuaauguucgauaacuuugagguggacuucgucggggcagcuguuucuugugaugccgcauuucugaaucuuacgggaugcuacagcuguaacgccggcgcucgagugugcuuguccauuaccucaacugguacaggcacccucagugcgcauaacaaggacgggagccugcacaucguacuaccaucugaaaauggaacaaaagaucagugccagauacugcauuucacugugcccgaggucgaagaggaauuuauguauuccugugacggcgacgagagaccucuccuggugaaggggacccuuaucgccauugaucccuucgacgauaggcgcgaggcaggaggcgaaucaacgguugugaacccaaaaagugguagcuggaacuuuuucgacugguucuccggguugaugucuugguuuggaggcccucugaagaccaucuuacucauuugccuguacgucgcucuuucgaucggucuguucuuuuugcucauauaccugggccggacagggcuaagcaaaauguggcuggccgccacuaagaaggcuucauga

SEQ ID NO: 11267 - RNA, 3204 nt, Artificial Sequence
  derived and/or modified CDS sequence (opt3) from RVFV(73HB1230)__DQ380221.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaaaaggaacugaaaucauuugauauuagucagugcccuaagaucgggggacauggcagcaagaaaugcacuggugacgccgcguucuguucugccuacgagugcaccgcacaguaugcuaaugccuacuguucccacgcuaacgggucaggaauugugcaaauccaggucagcggcguuuggaagaaaccacuuugcgugggcuaugaacgaguaguggucaagcgugagcugagugccaaacccauacagagaguggaaccuuguacaacuugcaucaccaagugugagccacacggguugguugugaggucuacaggauuuaagauuuccagcgcagucgccugcgcuucggguguguguguaaccggcucucaaucccccucaacggagaucacucucaaauacccggggauuagucagagcuccggaggcgauaucgguguucauauggcgcacgacgaucagucugugagcucaaagauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuuuaccggguccugaaauguuugaagauagcuccucgcaaagugcuaaacccccugauguggaucaccgccuucauuagauggguuuauaagaagaugguggcaagggucgcggauaauaucaaccaggugaaucgggaaauaggauggauggagggcgggcagcucguacugggaaacccagcucccauuccucgccacgccccaaucccgcgauacucuacuuaccuuaugcuguugcucaucgugucauaugcaagugccugcagcgaacugauucaggcuuccucuagaaucacaaccuguucgacggaggguguuaacaccaaaugcagguuaagcggcacagcccugauucgggcaggguccgucggagcugaagccugucuaaugcucaagggcgugaaagaggaccaaacuaaguuucugaaaauaaagaccgugucaagugagcuuucuugccgugaaggucagagcuacuggacaggguccuucucacccaaauguuugagcucucgcagaugccaucuggucggcgagugucacguuaauaggugccucuccuggcgggauaacgaaaccagugcggaguuuagcuucgugggagaaucuacuaucaugcgagagaauaagugcuuugagcaguguggcggguggggaugcgguuguuucaacgugaauccuuccugccuguuuguacauacauaucuucagucaguccgcaaggaagcccugagaguguucaacuguauugacuggguucacaaauugacccucgagaucacugacuuugauggcagugugagcacgaucgaccugggggcuucguccucuagguucacaaauuggggaagcgucucauuaagucuggaugcagaaggcauuuccgguucuaacagcuuuuccuucauagagucaccagggaagggcuacgccaucguggacgagcccuucagcgaaauuccucggcaaggauuucuaggcgagauccgcugcaauagugaaucuuccguucucagcgcucacgagucgugucugagagccccaaaccuuauuucauauaaacccaugaucgaucaguuggaaugcaccacuaaucugauagacccguucgugguauuugagagggggucucucccucagacccguaacgauaagacauucgcagcgaguaaaggaaaucggggcguccaggccuuuuccaaggguagcgugcaagcugaccugaccuuaauguucgauaacuuugagguggacuucgucggggccgcaguuucuugugaugcugccuuucugaaucuuacuggaugcuacagcuguaacgcaggcgcccgagugugcuuguccaucacaucaacggguaccggcacucucagugcucauaacaaggacgggagccugcacauuguacuaccaucugaaaauggaacaaaagaucagugccagauccugcauuucaccgugcccgaggucgaagaggaauuuauguauuccugugacggcgacgagagaccucuccuggugaaggggacacuuauugcgaucgaucccuucgacgauaggcgcgaggccggaggcgaaucaacuguugugaacccaaaaagugguagcuggaacuuuuucgacugguucuccggguugaugucuugguuuggaggcccucugaagaccauauuacucauuugccuguacgucgcacuuucgaucggucuguucuuuuugcucauuuaccugggccggacggggcuaagcaaaauguggcuggcugccaccaagaaggccucauga

SEQ ID NO: 11268 - RNA, 3204 nt, Artificial Sequence
  derived and/or modified CDS sequence (opt3) from RVFV(ZINGA J83 R1)__KU978776.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaagauggccuccguuaagugucccccuaaauaugaauugaccgaggauugcaacuuuugucgccucaugacaggugcuucucugaagaaagggucguacccacugcaggaccucuucugccaaucaagcgaggaugacggaaguaaguuaaagaccaaaaugaagggcgugugugaagucggcgugcaggcccugaaaaagugcgaugggcagcuuuccacugcacaugagguaguuccguuugcuguguucaaaaauucuaagaaagucuauuuggacaagcuggaccuaaagacagaagagaaccuccugcccgauagcuuuguguguuucgagcacaaaggacaguacaaggguaccauggacuccggccaaacgaaacgagaacuuaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcagauccaagucagcggcguuuggaaaaagccacugugcgugggcuaugaacguguaguggucaaaagagaguugagugccaagcccauacagaggguggaaccuuguacaacuugcaucaccaaaugugagccacacgggcucguugugcggucuacaggauuuaagauuuccagcgcagucgccugcgcuucggguguguguguaaccggcucucagucccccucaacggagaucacucugaaguacccggggauuagucaaagcuccggaggcgauaucgguguucauauggcgcacgacgaucagucugugagcucaaaaauagucgcacauugcccuccccaggacccauguuuagugcacgggugcauugucugcgcccauggccugaucaauuaucagugucacacagcucucagugccuucgugguuguguucguauuuuccagcauugcaaucaucugccuugccauucuguaccgcgucuugaagugucuaaaaauagcuccuagaaaggugcugaacccccucauguggaucaccgccuucauuagguggguuuaucggaaaaugguggcacgcgucgcggauaauaucaaccaagugaaucgagaaauaggauggauggagggcgggcagcugguacuuggaaacccagcucccauuccuagacacgugccaaucccgagguacucuacuuaccugauguugcuccugaucguuucauaugccagugcaugcagcgaauuaauucaggccuccucucggaucacaaccuguucgacggagggugucaacaccaagugccgucugagcggcacagcucuaauucgcgccggguccgugggagcagaggcuugucucaugcugaagggcgugaaagaagaccagacuaaguuucuuaaaauaaagaccgucucaagugaguugucuugcagagaaggucaaagcuacuggacaggguccuucucacccaaaugucugagcucuaggcggugccaucucguuggcgagugucacgugaaucgaugccuguccuggcgcgauaacgaaacaagugccgaguuuagcuucgugggagaaucuaccacaaugagagagaauaagugcuuugagcaguguggcggguggggaugcgguuguuucaacguaaauccuuccugccuuuuuguccauaccuaucugcagucagugaggaaagaagcguugcggguuuucaacuguaucgacugggugcacaagcucacucuggagauuacggacuuugauggcagugucagcacaaucgacuuaggggccucguccucucgcuucaccaauuggggaagcgugucacugagucuagaugcugaaggcaucuccgguucuaacagcuuuuccuucauugagucaccagggaagggcuacgcaauaguugacgagcccuucagcgaaaucccuagacagggauuucucggcgagauuaggugcaauagugaaucuuccgugcugagcgcccacgagucgugucuucgugcuccaaacuugaucucauauaaacccaugauugaucaacuggaaugcacuaccaaucucaucgacccguucguagucuuugagcgggggucucugccucagacacgaaacgauaagaccuucgccgcaaguaaaggaaauagaggcgugcaggcguuuuccaaggguagcgugcaggccgacuuaacucugauguucgauaacuuugaggucgacuucguuggggcugccgugucuugugaugcagcuuuucuuaauuugacaggaugcuacagcuguaacgccggcgcaaggguaugccucuccauaacgucaaccgguacuggcacacugagugcccauaacaaagacgggagccuacacaucgugcugccaucugaaaauggaaccaaggaucaaugccagauucuccauuucacaguccccgagguggaagaggaauuuauguauuccugugacggcgacgagcgcccucugcuuguucgggggacuuugaucgcuauugaucccuucgacgauagaagggaggcgggaggcgaaucaaccguggucaacccaaagagugguagcuggaacuuuuucgacugguucuccgggcugaugucuugguuuggaggcccuuuaaaaacgauccuccugauaugccuuuacguggcccugucgauugguuuguucuuucuccugaucuaccuaggccgcaccgggcugagcaagauguggcucgcagcuacuaaaaaggccucauga

SEQ ID NO: 11269 - RNA, 3204 nt, Artificial Sequence
  derived and/or modified CDS sequence (opt3) from RVFV(2008/00101)__HE687306.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuauuuucguguuuuccagcaccgcaaucaucugccucgccguacuuuaccgcguccugaaguguuugaaaauugcuccuagaaaggugcuaaacccccugauguggauaacugccuucaucagguggguuuauaaaaagaugguggcacgggucgcggauaauauuaaccaggugaaucgcgaaaucggauggauggagggcgggcagcucgcucugggaaacccagcccccauaccucgacacgcaccaauuccgagauacucuacauaccuuaugcuguugcucaucguaucauaugccagugcuugcagcgaacugauccaggccuccucuaggauuaccacguguucgaccgagggugugaacacaaagugccgguuaagcggcacugcacugauccgugcuggguccguuggagccgaagcgugucuaaugcucaaaggcgucaaggaggaccaaaccaaauuucugaagauuaaaacagugucaagugagcuuucuugccgcgaaggucagagcuacuggacuggguccuucucacccaaguguuugagcucuagaaggugccaucuggugggcgagugucacgucaaucggugccucuccuggcgagauaacgaaaccagugccgaguuuagcuucguuggagaaucuacaaccaugcgcgagaauaaaugcuuugagcaguguggcggguggggaugcgguuguuucaacgugaauccuuccugccuguuugugcauacuuaucuucagucaguaagaaaggaagcucugagggucuucaacuguauagacugggugcacaaguugacgcucgagaucacagacuuugauggcaguguuagcaccauugaccugggggcaucguccucucgguucacuaauuggggaagcgugucauuaagucuggaugccgaaggcaucuccgguucuaacagcuuuuccuucaucgagucaccagggaaaggcuacgcuauugucgacgagcccuucagcgaaauaccucgccaaggauuucuaggcgagaucagaugcaauagugaaucuuccgugcucagcgcccacgagucgugucugagggcaccaaaccuuguuucauauaagcccaugauugaucaguuggaaugcaccacaaaucugaucgacccguucgugguauuugagcgugggucucucccucagacccggaacgauaaaacuuucgcggccaguaagggaaaucgaggcguccaggcuuuuuccaaagguagcgugcaagccgaccugacauuaauguucgauaacuuugagguggacuucgucggggcagcuguuucuugugaugccgcauuucugaaucuuacgggaugcuacagcuguaacgccggcgcuagagugugcuuguccauuaccucaacugguacaggcacccucagugcgcauaacaaggacgggagccugcacaucguacuaccaucugaaaauggaacaaaggaucagugccagauacugcauuucacugugcccgaggucgaagaggaauuuauguauuccugugacggcgacgagaggccucuccuggugaaagggacccuuaucgccauugaucccuucgacgaucgccgggaggcaggaggcgaaucaacgguugugaacccaaagagugguagcuggaacuuuuucgacugguucuccggguugaugucuugguuuggaggcccucugaaaaccacauuacucaucugccuguacgucgcucuuucgauuggucuguucuuuuugcucaucuaccugggcagaacugggcuaagcaagauguggcuggccgccaccaaaaaggcuucauga

SEQ ID NO: 11270 - RNA, 3204 nt, Artificial Sequence
  derived and/or modified CDS sequence (opt3) from RVFV(2007002445)__EU574037.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuauuuucguguuuuccagcaccgcaaucaucugccucgccguacuuuaccgcguccugaaguguuugaaaauugcuccuagaaaggugcuaaacccccugauguggauaacugccuucaucagguggguuuauaaaaagaugguggcacgggucgcggauaauauuaaccaggugaaucgcgaaaucggauggauggagggcgggcagcucgcucugggaaacccagcccccauaccucgacacgcaccaauuccgagauacucuacauaccuuaugcuguugcucaucguaucauaugccagugcuugcagcgaacugauccaggccuccucuaggauuaccacguguucgaccgagggugugaacacaaagugccgguuaagcggcacugcacugauccgugcuggguccguuggagccgaagcgugucuaaugcucaaaggcgucaaggaggaccaaaccaaauuucugaagauuaaaacagugucaagugagcuuucuugccgcgaaggucagagcuacuggacuggguccuucucacccaaguguuugagcucuagaaggugccaucuggugggcgagugucacgucaaucggugccucuccuggcgagauaacgaaaccagugccgaguuuagcuucguuggagaaucuacaaccaugcgcgagaauaaaugcuuugagcaguguggcggguggggaugcgguuguuucaacgugaauccuuccugccuguuugugcauacuuaucuucagucaguaagaaaggaagcucugagggucuucaacuguauagacugggugcacaaguugacgcucgagaucacagacuuugauggcaguguuagcaccauugaccugggggcaucguccucucgguucacuaauuggggaagcgugucauuaagucuggaugccgaaggcaucuccgguucuaacagcuuuuccuucaucgagucaccagggaaaggcuacgcuauugucgacgagcccuucagcgaaauaccucgccaaggauuucuaggcgagaucagaugcaauagugaaucuuccgugcucagcgcccacgagucgugucugagggcaccaaaccuuguuucauauaagcccaugauugaucaguuggaaugcaccacaaaucugaucgacccguucgugguauuugagcgugggucucucccucagacccggaacgagaaaacuuucgcggccaguaagggaaaucgaggcguccaggcuuuuuccaaagguagcauucaagccgaucugacauuaauguucgacaacuuugaaguggauuucgugggggcagcugucucuugugacgccgcauuucugaaucuuacgggaugcuacagcuguaacgccggcgcuagaguuugcuuguccaucaccucaacugguacaggcacccucagugcgcauaacaaggaugggagccugcacauagugcuaccaucugagaauggaacaaaggaccagugccagauccugcauuucacuguacccgaaguggaggaagaguuuauguauuccugugauggcgacgagaggccucuccuggucaaagggacccuuauugccaucgaccccuucgaugaccgccgggaagcaggaggcgagucaacggugguuaacccaaagagugguagcuggaacuuuuucgauugguucuccggguugaugucuugguuuggaggcccucugaaaaccauuuuacucaucugccuguacguggcucuuucgauaggucuguucuuuuugcucauuuaccugggcagaacagggcuaagcaagauguggcuggccgccacuaaaaaggcuucauga

SEQ ID NO: 11271 - RNA, 3204 nt, Artificial Sequence
  derived and/or modified CDS sequence (opt3) from RVFV(ZC-3349)__DQ380207.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucaggcagugucuagcaaaauagucgcccauugcccuccccaggacccaugucuggugcacgggugcauugucugcgcucauggcuuaaucaauuaucaaugucacacagcccugucagcauucgugguuguguucguauuuaguuccauugccaucaucugccucgcuauucuuuaccgcguccugaaguguuugaaaauagccccuagaaaggugcuaaacccccugauguggaucaccgcauucauuagguggaucuauaaaaagaugguugcgcggguggcugauaauauaaaccacgucaaucgcgaaauuggauggauggagggcgggcagcucgugcugggaaacccagcccccaucccucgacaugcaccaaucccgagauacagcacuuaccuuaugcuguugcucauuguaucuuaugccucagcuugcagugaacugauccaggccagcuccaggauuacaaccuguucuacggagggugugaacaccaagugccgguuaucgggcacagcacugauacgugcugggagcguuggagccgaagcgugucuaaugcucaaaggcgucaaggaggaccagacuaaauuucugaagaucaaaaccguguccucagagcuuaguugccgcgaaggucaaucuuacuggacagggagcuucucccccaaguguuugucaagcagaaggugccaccuggugggcgagugucaugucaaucggugccucucuuggcgagauaacgaaacuuccgccgaguuuaguuucguuggagaaagcaccacaaugcgcgagaauaaaugcuuugagcaguguggcggguggggaugcgguuguuucaacgugaauccuucuugccuguuugugcacaccuaucuucaguccguaagaaaggaagcucugagggucuucaacuguauugacugggugcacaaguugacucucgagaucacggacuuugauggcucaguuaguacaaucgaccugggggcaagcucgucccgguucaccaauuggggaucugugagcuuaucacuggaugccgaaggcauuagugguuccaacucuuuuagcuucauagaguccccagggaaaggcuacgcuaucgucgacgagcccuucucagaaauuccucgccagggauuucuaggcgagaucagaugcaauagcgaaaguucugugcucuccgcccaugagagcugucugaaggcaccaaaccuuauuucguauaaacccaugaucgaucaauuggaaugcacuaccaaucugauagacccguucguuguguuugagagggggucacucccucagacacguaacgauaagaccuucgcggccucuaaaggaaaucggggcguacaggcuuuuaguaaggguuccguccaggccgaccugacuuuaauguucgauaacuuugagguggacuucgugggggcagcugucagcugugaugccgcauuucugaaucuuacaggaugcuacucuuguaacgccggcgcucgaguuugcuugagcaucacguccaccgguacuggcucacucagugcgcacaacaaggacgggagccugcauauugugcuaccaucugaaaauggaacaaaagaucaaugccagauccugcacuucaccguacccgagguggaagaggaauuuauguauuccugugacggcgacgagagaccucuccuggucaaggggacacuuauugccaucgaucccuucgacgauaggcgcgaggcaggaggcgaaucaacugugguuaacccaaaaagugguagcuggaacuuuuucgacugguucuccggguugaugucuugguuuggaggcccucugaagaccauauuacucauuugccuguacguggcucuuucgaucggucuguucuuuuugcucauuuaccugggccggacggggcuaagcaaaauguggcuggccgccaccaagaaggcuucauga

SEQ ID NO: 11272 - RNA, 3204 nt, Artificial Sequence
  derived and/or modified CDS sequence (opt3) from RVFV(Kenya 9800523)__DQ380196.1__Gn-Gc
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuuuuguucccacgcuaacgggucaggaauugugcaaauccaggucagcggcguuuggaaaaagccacuuugcgugggcuacgaacguguaguggucaaaagagagcugagugccaagcccauacagaggguggaaccuuguacaacuugcaucaccaaaugugagccacacggguugguugugcggucuacaggauucaagauuuccagcgcagucgccugcgcuucggguguguguguaaccggcucucaaucccccucaacggagaucacucucaaguauccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaccaaugucacacagcucugagugccuucgugguuguguuuguauucuccagcauugcaaucaucugccucgccauucuuuaucgcguccugaaguguuugaaaauagcuccuagaaaggugcuaaacccccugauguggaucaccgccuuuauuagguggguuuacaaaaagaugguggcacgggucgcggauaauaucaaccaggugaaucgcgaaauaggauggauggagggcgggcagcucguacugggaaacccagcucccauuccucgacacgccccaaucccgagauauucuacuuaccuuaugcuguugcucaucgugucauacgcaagugccugcagcgaacugauucaggcuuccucuaggaucacaaccuguucgacggaggguguuaacaccaagugccgguuaagcggcacagcccugauucgugcaggguccgucggagcugaagccugucuaaugcucaaaggcgugaaggaggaccaaacuaaauuccugaagauaaaaaccgugucaagugagcuuucuugccgcgaaggucagagcuauuggacaggguccuuuucacccaaguguuugagcucuagaaggugccaucuggucggcgagugucacguuaaucggugccucuccuggcgagauaacgaaacaagugcggaguucagcuuugugggagaaucuaccacaaugcgcgagaauaaaugcuucgagcaguguggcggguggggaugcgguuguuuuaacgugaauccuuccugccuguucguacauaccuaccuucagucagucagaaaggaagcccugaggguguuuaacuguaucgacuggguucacaaguugacucucgagauuacggacuucgauggcagugugagcacaaucgaccugggggcuucguccucucgguuuaccaauuggggaagcgucucauuaagucuggaugcagaaggcaucuccgguucuaacagcuucuccuucauugagucaccagggaaaggcuaugccauaguggacgagcccuuuagcgaaaucccucgccaaggauuccuaggcgagauuagaugcaauagugaaucuuccguucucaacgcucacgagagcugucugagggccccaaaucuuaucucguacaagcccaugauugaucaguuggaaugcacuaccaaccugaucgacccguuugugguauucgagcgugggucacucccucagacacggaaugauaaaaccuuugcagcgucuaagggaaaccgaggcguccaggccuucaguaaagguuccgugcaagcugaccugacuuuaauguuugauaauuucgagguggacuuugucggggccgcaguuagcugugaugcugccuuccugaaccuuacaggaugcuauucuuguaacgcaggcgccagagugugcuugagcauaacguccaccgguacuggcacacucucagcucauaauaaggaagggagucugcacaucguacuaccaagcgagaacggaaccaaggaccagugccagauucugcauuuuacagugcccgaagucgaggaagaguucauguacucuugugauggcgacgagaggccucuccuggugaaagggacucuuaucgcgauugaccccuuugaugaccgccgggaagccggaggcgaguccaccguugugaauccaaagucagguaguuggaacuucuucgauugguuuagcggguugauguccugguucggaggcccucugaaaacgaucuuacucauaugccuguaugucgcacuuucuauuggucuguuuuucuugcucaucuaccugggcagaaccgggcuaucgaagauguggcuggcugccacuaaaaaggccagcuga

SEQ ID NO: 11273 - RNA, 3204 nt, Artificial Sequence
  derived and/or modified CDS sequence (opt3) from RVFV(Entebbe)__DQ380191.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagauuaaacgagaacugaagucauuugauaucagucagugcccuaaaauugggggacauggcagcaagaagugcacgggugacgccgcguucuguucugccuacgagugcacugcacaguaugcuaaugccuacuguucccacgcuaacgggucaggaaucgugcaaauacaggucagcggcguuuggaaaaagccacuuugcgugggcuaugaacguguaguggucaaaagagagcugagugccaagcccauccagaggguggaaccuuguaccacaugcauuacuaaaugugagccacacggguugguugugcggucuaccggauuuaagaucuccagcgcagucgccugcgcuucggguguguguguaacaggcucucaaucccccucaaccgagauuacgcucaaguacccggggaucagucagagcuccggaggcgauauagguguucauauggcgcacgacgaucagucugugagcucaaaaauugucgcacauugcccuccccaggacccaugucuggugcacgggugcaucgucugcgcccauggcuuaauuaauuaucaaugucacacugcucugagugccuucgugguuguguucguauuuuccagcgucgcaaucaucugccucgccauucuuuacaaggugcugaaauguuugaagauagcuccucgcaaaguucuaaacccccugauguggaucacagccuucauuagauggguguauaagaagauggucgcaaggguggcggauaauaucaaccagguaaaucgggaaauaggauggauggagggcgggcagcucgugcugggaaacccagcucccauuccucgccacgccccaaucccgcgauacucuaccuaccuuaugcuguugcucaucguuucauaugcaagugccugcagcgaacugauucaggcuuccucuagaaucacuacauguucgaccgagggugucaacacgaaaugcagguuaagcggcaccgcccugauucgggcaggguccgugggagcugaagccugucuaaugcucaagggcgugaaagaggaccaaacaaaguuucugaaaauaaagacugucucaagugagcuuucuugccgugaaggucagagcuacuggaccggguccuucucacccaaauguuugagcucucgcagaugccaucugguuggcgagugucacgugaauaggugccucuccuggcgggauaacgaaacaagugcggaguuuagcuucgugggagaaucuacuaccaugcgagagaauaagugcuuugagcaguguggcggguggggaugcgguuguuucaacguaaauccuuccugccuguuuguccauacauaucuucagucagugcgcaaggaagcccugagaguuuucaacuguaucgacugggugcacaaauugacccucgagauuacugacuuugauggcagugucagcacgguggaccugggggcuucguccucuagguucacaaauuggggaagcguuucauuaagucuggaugcagaaggcaucuccgguucuaacagcuuuuccuucaucgagucaccagggaagggcuacgccauuguggacgagcccuucagcgaaauaccucggcaaggauuucuaggcgagauccgcugcaauagugaaucuuccguacucagcgcucacgagucgugucugagagccccaaaccuuauuucauauaaacccaugaucgaucaguuggaaugcaccacuaaucugauugacccguucgucguguuugagagggggucucucccucagacccguaacgauaagacauucgcagcgaguaaaggaaaucggggcgugcaggccuuuuccaaggguagcguccaagcugaccugaccuuaauguucgauaacuuugagguugacuucgugggggccgcaguaucuugugaugcugccuuucugaaucuuacuggaugcuacagcuguaacgcaggcgcccgagugugcuuguccaucacaucaacggguaccggcacucucagugcucauaacaaggacgggagccugcacauaguccuaccaucugaaaauggaacaaaagaucagugccagauccugcauuucaccgugcccgagguugaagaggaauuuauguauuccugugacggcgacgagagaccucuccuggugaaggggacacuuauugcgaucgaucccuucgacgauaggcgcgaggccggaggcgaaucaacugucgugaacccaaaaagugguagcuggaacuuuuucgacugguucuccggguugaugucuugguuuggaggcccucugaagaccauuuuacucaucugccuguacguugcacuuucgauaggucuguucuuuuugcucauuuaccugggccggacggggcuaagcaaaauguggcuggcugccaccaagaaggccucauga

SEQ ID NO: 11274 - RNA, 3204 nt, Artificial Sequence
  derived and/or modified CDS sequence (opt3) from RVFV(25010-24)__KM210509.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugauuguucggucuacaggauuuaagaucuccagcgcaguggccugcgcuucgggugucugugugaccggcucucaaucccccucaacggagauuacucucaaguacccggggaucagucagagcuccggaggcgauauagguguacauauggcgcacgacgaucagucuguuagcucaaaaauuguggcacauugcccuccccaggacccaugucugguccacgggugcaucgugugcgcccauggcuuaauuaauuaucaaugucacacagcucugagugccuucgucgugguuuucguguuuuccagcguagcaaucaucugccucgccauucuuuacaagguccugaaauguuugaagauagcuccuaaaaaggugcuaaacccccugauguggaucaccgccuucauucgcuggguuuauaagaaaaugguggcaagagucgcggauaauaucaaccaggugaauagggaaauaggauggauggagggcgggcagcucgcucugggaaacccagcccccauuccucggcacgcaccaaucccgcgcuacucuacuuaccuuaugcuguugcucaucguaucauaugccagugcuugcagcgaacugauucaggccuccucucgaaucacaaccuguucgacggagggugugaacaccaagugcagauuaagcggcacagcacugauuagggcuggguccguuggagccgaagcgugucuaaugcucaaaggcgucaaggacgaucaaacuaaauuucugaagauaaaaaccgugucaagugagcuuucuugccgggagggucagagcuacuggacaggguccuucucacccaaguguuugagcucucgucgcugccaucuggugggcgaaugucacgucaauagaugccucuccuggagggacaacgagacuucagccgaauuuagcuucguuggagagucuaccacaaugcgggaaaauaagugcuuugagcaguguggcggguggggaugcgguuguuucaacgugaauccuuccugccuguuugugcauaccuaucuucagucaguacgaaaagaggcucugcgcgucuucaacuguaucgacugggugcacaaguugacucucgaaauuacggauuuugacggcaguguuagcacaaucgaucugggggcaucguccucuagauucaccaauuggggaagcgugucauuaagucuggacgccgagggcaucuccgguucuaacagcuuuuccuucauugaaucaccagggaaaggcuacgcuauagucgaugagcccuucagcgagaucccuaggcaaggauuucuaggcgaaauucggugcaauagugagucuuccgugcucagcgcccacgaaucgugucugcgcgcaccaaaccuuaucucauauaagcccaugauugaccaguuggagugcacuaccaaucugaucgauccguucguuguguuugaaagagggucucucccucagacaaggaacgacaaaaccuucgcggccaguaagggaaaucguggcguacaggcuuuuuccaaggguagcguccaagccgaucugacuuuaauguucgacaacuuugagguggauuucgugggggcagcugucucuugugacgccgcauuucugaaucuuacaggaugcuacagcuguaacgccggcgcucggguuugcuuguccauaacgucaaccgguacuggcacacucagugcgcauaacaaagaugggagccugcacaucgugcuaccaucugagaauggaaccaaggaccagugccagauucugcauuucacaguacccgaaguggaggaagaguuuauguauuccugugacggcgaugaacgaccucuccuggucaaagggacucuuaucgccauugaccccuucgaugacagaagggaggcaggaggcgagucaaccgugguuaacccaaagagugguagcuggaacuuuuucgauugguucuccggguugaugucuugguuuggaggcccucugaaaacgaucuuacucauaugccuguacguggcucuuucgauuggucuguucuuuuugcucaucuaccugggccgcaccgggcuaagcaagauguggcuggccgccacaaagaaagcuaguuga

SEQ ID NO: 11275 - RNA, 3204 nt, Artificial Sequence
  derived and/or modified CDS sequence (opt3) from RVFV(763/70)__DQ380188.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugguuugaccgaagauugcaacuuuugucgccagaugacaggggcuucucucaagaaaggaucguacccacugcaagaccuguucugccagucaagcgaggaugacggcaguaagcucaagaccaaaaugaagggcgugugugaggucggggugcaggccuuaaagaagugcgauggacagcuguccacugcacaugaaguaguuccguuugcuguguucaaaaauucuaagaaagucuaucuugacaaguuggaccugaagacagaggaaaaccuacuccccgauagcuuuguguguuucgagcacaaaggucaauacaagggcaccauggacuccgggcagacgaaacgagagcugaagucauuugauauuagucagugcccuaaaaucggaggccaugguagcaagaagugcacuggggacgccgcguucuguucugccuacgaaugcaccgcacaguaugcuaaugccuacuguucccacgcuaacggaucaggcauugugcaaauccaggucagcggcguuuggaaaaagccacuuugcgugggguaugagcguguaguggucaaaagagaacugagugccaagcccauacagaggguggagccuuguacaacuugcaucaccaaaugugaaccacacggauugguugugcggucuacagguuuuaagauuuccagcgcagucgccugcgcuucgggcguguguguaaccgggucucaaucccccucaacggagaucacucucaaguacccgggaauuagucagagcuccggcggugauaucgggguucauauggcgcacgacgaucagucugugagcucaaaaauagucgcacauugcccuccccaggacccaugucuggugcacggcugcauugucugcgcccauggauuaaucaauuaucaaugucacacagcucugagugccuucgugguuguguucguauuuuccagcgucgcaauuaucugccucgccauccuuuacaaggugcugaaauguuugaagauugcuccucgcaaaguucuaaacccccugauguggauaaccgccuucaucagauggguguauaagaagauggucgcaaggguggcggauaauauuaaccagguaaaucgggagaucggcuggauggaagggggacagcucgcucuggguaacccagcccccauaccucgccacgcaccaauuccgcgauacucuacuuaccuuaugcuguugcucaucgugucauaugccagugcuugcagcgagcugauccaggccuccucuagaauuacaaccuguucgacggaaggcguuaacaccaaaugcagguuaagcgggacagcacugauccgggcuggauccgucggcgccgaggcgugucuaaugcucaagggugugaaagaagaccaaacuaaguuucugaaaauuaagaccgugucaagugagcuuucuugccgugaggggcagagcuacuggacaggcuccuucucacccaaauguuugagcucucgcagaugccaucuggucggagaaugucacguuaauaggugccucuccuggcgggauaacgagaccagugccgaauuuagcuucgugggcgagucuacuacaaugcgagaaaauaagugcuuugagcagugugggggaugggguugcggcuguuucaacgugaauccuuccugccuguuuguacauaccuaucuucagucaguccgcaaggaggcucugagaguguucaacuguauagacuggguucacaaauugacucucgaaaucacggacuuugaugggagugugagcacaauugaccugggagcaucguccucuagguucaccaauuggggcagcgucucauuaagucuggaugccgaggguaucuccgggucuaacagcuuuuccuucaucgaaucaccaggcaagggauacgcuauuguggacgagcccuucagcgagauaccucggcaaggcuuucuaggggaaauccgcugcaauagugagucuuccguucucagcgcccacgaaucgugucugagagcaccaaaccuuauuucauauaaacccaugaucgaucaguuggagugcacuaccaaucugauugacccguucgugguauuugaaaggggaucucucccucagacacguaacgauaagaccuucgcggccaguaaaggcaaucgggguguccaggcuuuuuccaaggggagcgugcaagccgaccugacuuuaauguucgauaacuuugagguggacuucgucggagcagcuguuucuugugaugccgcauuucugaaucuuacaggcugcuacagcuguaacgccggugcucgagugugcuuguccaucacgucaaccggcacugggacacucagugcgcauaacaaggacggaagccugcacauaguacuaccaucugagaauggcaccaaagaucagugccagauccugcauuucacagugcccgaagucgaggaagaguuuauguauuccugugacggggacgaaagaccucuccuggugaagggaacucuuauugccaucgaucccuucgacgauaggcgcgaggcaggcggugagucaaccguugugaacccaaaaagugggagcuggaacuuuuucgacugguucuccggauugaugucuugguuuggcgguccucugaagacgauuuuacucaucugccuguacgucgcucuuucgauaggccuguucuuuuugcucauuuaccuggggcggaccggacuaagcaaaauguggcuggccgccacaaagaaggcuucauga

SEQ ID NO: 11276 - RNA, 3204 nt, Artificial Sequence
  derived and/or modified CDS sequence (opt3) from RVFV(OS-1)__DQ380186.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggagugguccaaauucagguuagcggcguguggaaaaagccacuuugcguaggcuaugaacguguggucgugaaaagagagcugagugccaagcccauccagaggguugaaccuuguacaacuugcauaaccaaaugugagccacacggguuggugguccggucuacaggauuuaagaucuccagcgcaguggccugcgcuucggguguauguguuaccggcucucaaucccccucaacggagauuacucucaaguacccggggaucagucagagcuccggaggcgauauuggugugcauauggcgcacgacgaucagucugucagcucaaaaaucguggcacauugcccuccccaggacccaugucugguccacgggugcauagugugcgcccauggcuuaauuaauuaucaaugucacacagcucugagugccuucguugugguauucgucuuuuccagcguggcaaucauuugccucgccauccuuuacaagguucugaaauguuugaagaucgcuccucgcaaagugcuaaacccccugauguggauuaccgccuucauaagaugggucuauaagaagaugguggcaaggguagcggauaauaucaaccaggugaaucgggaaauuggauggauggagggcgggcagcucgcucugggaaacccagcccccaucccucgccacgcaccaauaccgcgauacucuacuuaccuuaugcuguugcucauuguuucauaugccagugcuugcagcgaacugauccaggccuccucuagaaucacaaccuguucgacggagggugucaacaccaaaugcagguuaagcggcacagcacugauucgggcuggguccgugggagccgaagcgugucuaaugcucaagggcgugaaagaggaccaaacuaaguuucugaaaaucaagaccgucucaagugagcuuucuugccgugaaggucagagcuacuggacaggguccuucucacccaaauguuugagcucucgcagaugccaucugguuggcgagugucacgugaauaggugccucuccuggcgggauaacgaaacuucagccgaguuuagcuucgugggagaaucuaccacaaugcgagagaauaagugcuuugagcaguguggcggguggggaugcgguuguuucaacguaaauccuuccugccuguuuguccauaccuaucuucagucagugcgcaaggaagcucugaaaguuuucaacuguauugacugggugcacaaguugacucucgagauaacggacuuugauggcagugucagcacaaucgaccugggggcaucguccucuagauucaccaauuggggaagcgugucauuaagucuggaugccgaaggcauuuccgguucuaacagcuuuuccuucaucgagucaccagggaaaggcuacgcuaucguugacgagcccuucagcgaaauuccuaggcaaggauuucuaggcgagauacggugcaauagugaaucuuccgugcucagcgcccacgagucgugucugcgcgcaccaaaccuuaucucauauaagcccaugauugaucaguuggaaugcacuaccaaucugaucgacccguucguagucuuugagagagggucucucccucagacaaggaacgauaaaaccuucgcggccaguaagggaaaucguggcgugcaggcuuuuuccaaggguagcgugcaagccgaccugacuuuaauguucgauaacuuugaggucgacuucguuggggcagcugugucuugugaugccgcauuucugaaucuuacaggaugcuacagcuguaacgccggcgcucggguaugcuuguccauuacgucaaccgguacuggcacacucagugcgcauaacaaagacgggagccugcacaucgugcuaccaucugaaaauggaaccaaggaucagugccagauacugcauuucacaguccccgagguggaagaggaauuuauguauuccugugacggcgacgagcgaccucuccugguuaaagggacucuuaucgccauugaucccuucgacgauagaagggaggcaggaggcgaaucaaccguggucaacccaaagagugguagcuggaacuuuuucgacugguucuccggguugaugucuugguuuggaggcccucugaaaacgaucuuacucauuugccuguacguggcucuuucgaucggucuguucuuuuugcucauauaccugggccgcaccgggcuaagcaagauguggcuggccgccacaaagaaagcuaguuga

SEQ ID NO: 11277 - RNA, 3204 nt, Artificial Sequence
  derived and/or modified CDS sequence (opt3) from RVFV(BIME-01)__KX609032.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcgucgcaauuaucugccucgccauccuuuacaaggugcugcgcuguuugaaaauugcuccuaagaaaguucuaaacccccugauguggauaaccgccuucaucagauggguguauaagaagauggucgcaaggguggcggauaauauuaaccagguaaaucgggaaaucggauggauggagggcgggcagcucgcucugggaaacccagcccccauaccucgccacgcaccaauuccgcgauacucuacuuaccuuaugcuguugcucaucaucucauaugccagugcuugcagcgaacugauucaggccuccucuagaaucacaaccuguucgacggagggugugaacaccaaaugcagguuaagcggcacagcacugauucgggcuggguccguuggagccgaagcgugucuaaugcucaagggcgucaaagaggaccaaacuaaguuucugaaaauaaagaccgugucaagugagcuuucuugccgugaaggucagagcuacuggacaggguccuucucacccaaauguuugagcucucgcagaugccaucuggugggcgagugucacgucaauaggugccucuccuggcgggauaacgaaaccagugccgaguuuagcuucguuggagaaucuacuacaaugcgagagaauaagugcuuugagcaguguggcggguggggaugcgguuguuucaacgugaauccuuccugccuguuugugcauaccuaucuucagucaguacgcaaggaagcucugagagucuucaacuguaucgacugggugcacaaauugacucucgagauuacggacuuugauggcaguguuagcacaaucgaccugggggcaucguccucuagguucaccaauuggggaagcgugucauuaagucuggaugccgaaggcaucuccgguucuaacagcuuuuccuucauugagucaccagggaagggcuacgcuauagucgacgagcccuucagcgaaaucccucggcaaggauuucuaggcgagauucgcugcaauagugaaucuuccgugcucagcgcccacgagucgugucugagagcaccaaaccuuaucucauauaaacccaugauugaucaguuggaaugcacuaccaaucugaucgacccguucguuguguuugagagggggucucucccucagacacguaacgauaagaccuucgcggccaguaaaggaaaucggggcguacaggcuuuuuccaaggguagcguccaagccgaccugacuuuaauguucgauaacuuugagguggacuucgugggggcagcugucucuugugaugccgcauuucugaaucuuacaggaugcuacagcuguaacgccggcgcucgaguuugcuuguccauaacgucaaccgguacuggcacacucagugcgcauaacaaggacgggagccugcacaucgugcuaccaucugaaaauggaaccaaagaucagugccagauucugcauuucacaguacccgagguggaagaggaauuuauguauuccugugacggcgacgagagaccucuccuggucaaggggacucuuaucgccauugaucccuucgacgauaggcgcgaggcaggaggcgaaucaaccgugguuaacccaaaaagugguagcuggaacuuuuucgacugguucuccggguugaugucuugguuuggaggcccucugaagacgaucuuacucauaugccuguacguggcucuuucgauuggucuguucuuuuugcucaucuaccugggccggaccgggcuaagcaaaauguggcuggccgccacaaagaaggcuucauga

SEQ ID NO: 11278 - RNA, 3204 nt, Artificial Sequence
  derived and/or modified CDS sequence (opt3) from RVFV(73HB1449)__DQ380211.1__Gn-Gc
auggccggcaucgcuaugacagugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaaaucccuccacggagaucacucucaaguacccggggauuucacagaguagcggaggcgauaucgguguucauauggcgcacgacgaucaguccgugucuagcaaaauagucgcacauugcccuccccaggacccaugucuggugcacgggugcauugucugcgcccauggcuuaaucaacuaucaaugucacacagcucugucagccuucgugguuguguucguauuuaguuccauugcaaucaucugccucgccauucuuuaccgcguccugaaguguuugaaaauagcuccuagaaaggugcuaaauccccugauguggaucaccgccuucauuagguggguuuauaaaaagaugguggcacgggucgcggauaacaucaaucaggugaaccgcgaaauaggauggauggagggcgggcagcucguacugggaaacccagcucccauuccucgacacgccccaaucccgagauacagcacuuaccuuaugcuguugcucaucgugucuuaugcaucagccugcagugaacugauucaggcuagcuccaggaucacaaccuguucuacggaggguguuaauaccaagugccgguuaucgggcacagcccugauucgugcagggagcgucggagcugaagccugucuaaugcucaaaggcgugaaggacgaucaaacuaaauuucugaagauaaaaaccguguccucagagcuuaguugccgcgagggucagucuuacuggacagggagcuucucccccaaguguuugucaagcagaaggugccaucuggucggcgaaugucacguuaaccggugccucucuuggcgagacaaugagacuuccgcggaauuuaguuucgugggagagagcaccacaaugcgcgaaaacaaaugcuuugagcaguguggcggguggggaugcgguuguuucaaugugaacccuucuugccuguuuguacauaccuaucuucaguccgucagaaaggaggcccugaggguguucaauuguaucgacuggguucacaaguugacucucgaaauuacggauuuugacggcucagugaguacaaucgaucugggggcuagcucgucccgguucaccaacuggggaucugucagcuuaucacuggacgcagagggcaucagugguuccaauucuuuuagcuucauugaauccccagggaaaggcuacgccauaguggaugagcccuucucagagaucccucgccaaggauuucuaggcgaaauuagaugcaacagcgagaguucuguucucuccgcucacgaaagcugucugagggccccaaaucuuaucucguauaagcccaugauugaccaguuggagugcacuaccaaccugaucgauccguucgugguauuugaacgugggucacucccucagacacggaaugagaaaaccuucgcagcgucuaagggaaaccgaggcguccaggccuuuaguaaagguuccgugcaagcugaccugacuuuaauguucgauaauuuugagguggacuucgucggggccgcaguuagcugugaugcugccuuucugaaccuuacaggaugcuacucuuguaacgcaggcgccagagugugcuugagcauaacguccaccgguacuggcacacucucagcucauaauaaggacgggagucugcacaucguacuaccaagcgaaaacggaaccaaggaucagugccagauucugcauuucacagugcccgaggucgaagaggaauuuauguauucuugugacggcgacgagaggccucuccuggugaaagggacucuuaucgcgauugaucccuucgacgaucgccgggaggccggaggcgaauccaccguugugaauccaaagucagguaguuggaacuuuuucgacugguucagcggguugauguccugguuuggaggcccucugaaaacgaucuuacucauaugccuguacgucgcacuuucuauuggucuguucuuuuugcucaucuaccugggcagaaccgggcuaucgaagauguggcuggcugccaccaaaaaggccagcuga

SEQ ID NO: 11279 - RNA, 3204 nt, Artificial Sequence
  derived and/or modified CDS sequence (opt3) from RVFV(SA01-1322)__KX096942.1__Gn-Gc
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuuuuguucccacgcuaacgggucaggaauugugcaaauccaggucagcggcguuuggaaaaagccacuuugcgugggcuacgaacguguaguggucaaaagagagcugagugccaagcccauacagaggguggaaccuuguacaacuugcaucaccaaaugugagccacacggguugguugugcggucuacaggauucaagauuuccagcgcagucgccugcgcuucggguguguguguaaccggcucucaaucccccucaacggagaucacucucaaguauccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaccaaugucacacagcucugagugccuucgugguuguguuuguauucuccagcauugcaaucaucugccucgccauucuuuaucgcguccugaaguguuugaaaauagcuccuagaaaggugcuaaacccccugauguggaucaccgccuuuauuagguggguuuacaaaaagaugguggcacgggucgcggauaauaucaaccaggugaaucgcgaaauaggauggauggagggcgggcagcucguacugggagacccagcucccauuccucgacacgccccaaucccgagauauucuacuuaccuuaugcuguugcucaucauuucauacgcaagugccugcagcgaacugauccaggcuuccucuaggauuacaaccuguucgacggagggugugaacaccaagugccgguuaagcggcacagcccugauacgugcaggguccguuggagcugaagccugucuaaugcucaaaggcgucaaggaggaucaaacuaaauuccugaagaucaaaaccgugucaagugagcuuucuugccgcgaaggucagagcuauuggacaggguccuuuucacccaaguguuugagcucuagaaggugccaucuggugggcgagugucacgucaaccggugccucuccuggcgagacaaugaaacaagugcggaguucagcuuuguuggagaaucuaccacaaugcgcgagaacaaaugcuucgagcaguguggcggguggggaugcgguuguuuuaaugugaacccuuccugccuguucgugcauaccuaccuucagucaguaagaaaggaagcccugagggucuuuaauuguauugacugggugcacaaguugacucucgagaucacggauuucgacggcaguguuagcacaaucgaucugggggcuucguccucucgguuuaccaacuggggaagcgugucauuaagucuggacgcagaaggcauuuccgguucuaauagcuucuccuucauagagucaccagggaaaggcuaugccaucgucgaugagcccuuuagcgaaauuccucgccaaggauuccuaggcgagaucagaugcaacagugaaucuuccgugcucagcgcucacgagucgugucugagggccccaaaucuuauuucauacaagcccaugaucgaccaguuggaaugcacuaccaaccugauagauccguuuguuguguucgagcgugggucucucccucagacacggaaugagaaaaccuuugcagcgaguaagggaaaccgaggcguacaggccuucuccaaagguagcguccaagcugaccugacuuuaauguuugauaauuucgaaguggacuuugugggggccgcagucucuugugaugcugccuuccugaaccuuacaggaugcuauagcuguaaugcaggcgccagaguuugcuuguccaucacgucaaccgguacuggcacacucagugcucauaacaaggacgggagccugcacauugugcuaccaucugagaacggaaccaaggaucagugccagauccugcauuuuacaguacccgaaguggaggaagaguucauguacuccugugacggcgacgagaggccucuccuggucaaagggacucuuauugcgaucgaucccuuugacgaucgccgggaagccggaggcgagucaaccgugguuaauccaaagagugguagcuggaacuucuucgacugguuuuccggguugaugucuugguucggaggcccucugaaaacgauauuacucauuugccuguauguggcacuuucgaucggucuguuuuucuugcucauuuaccugggcagaaccgggcuaagcaagauguggcuggcugccacuaaaaaggccucauga

SEQ ID NO: 11280 - RNA, 3204 nt, Artificial Sequence
  derived and/or modified CDS sequence (opt3) from RVFV(Sudan 2V-2007)__JQ820490.1__Gn-Gc
auggccggcaucgcuaugacagugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccauguagugugcacgggugcauugucugcgcccauggccugaucaauuaucaaugucacacagcuuuauccgccuucgugguuguguucguauuuagcucuauugcaaucaucugccuggccauucucuaccgcguccuuaagugucugaaaauagcuccuagaaagguguugaacccccuaauguggaucaccgccuucauuagguggguuuauaaaaagaugguggcacgggucgcggauaauaucaaccaggugaaucgcgaaauaggauggauggagggcgggcagcugguacucggaaacccagcucccauuccucgacacgccccaaucccgagauacucaacuuaccugaugcuucuguugaucgugagucaugcaagcgccugcuccgaacucauucaggcuucuucgaggaucacaaccuguagcacggaggguguuaacaccaagugccggcuguccggcacagccuuaauucgugcagggucagucggagcugaagccugucugaugcuaaaaggcgugaaggaggaccaaacuaaauuucucaagauaaaaaccgugaguucugagcugagcugccgcgaaggucaguccuauuggacagggucauucagccccaagugucuuucuuccagaaggugccacuuggucggcgagugucauguuaaucggugccugaguuggcgagauaacgaaacuagcgcggaguuuucuuucgugggagaauccaccacaaugcgcgagaauaaaugcuuugagcaguguggcggguggggaugcgguuguuucaacgugaauccuucaugccucuuuguacacaccuaccugcagagugucagaaaggaagcccuuaggguguucaacuguaucgacuggguucacaagcugacuuuggagauuacggacuuugauggcagcgugucgacaaucgaccucggggcuuccucuagccgguucaccaauuggggaucagucagucuguccuuagaugcagaaggcaucucugguagcaacuccuuuucauucauugagagcccagggaaaggcuaugccauaguggacgagcccuucagugaaaucccucgccaaggauuucugggcgagauuagaugcaauucugaauccagcguucuaucggcucaugagucaugucucagggccccaaaccugaucucuuacaagcccaugauugaucagcuugaaugcacuaccaauuugaucgacccguucgugguauuugagcgugggagucugccucagacacggaacgauaaaaccuucgcagcguccaagggaaaucgaggcguccaggccuuuagcaaagguucugugcaagcugaccucacucugauguucgauaacuuugagguggacuucgucggggccgcaguuagcugugaugcugccuuuuuaaaucugacaggaugcuauuccuguaacgcaggcgccagagugugccuuucaauaacgaguaccgguacuggcacauugagcgcucacaacaaggacgggucucuccauaucguacugccauccgaaaauggaaccaaggaucagugccagauucuacacuucacagugcccgaggucgaagaggaauuuauguacucaugugacggcgacgagaggccucugcucgugaaagggacucugauggcgaucgaucccuucgacgaucgccgggaggccggaggcgaaaguaccguugugaacccaaagagcgguuccuggaacuuuuucgacugguucucugggcuuaugucgugguuuggaggcccuuugaaaacgauucuguuaaucugccucuaugucgcacugagcauaggucuuuucuuucuguugauuuaccucggcagaaccgggcugucaaagauguggcuagcugccaccaaaaaggccuccuga

SEQ ID NO: 11281 - RNA, 3204 nt, Artificial Sequence
  derived and/or modified CDS sequence (opt3) from RVFV(35/74)__JF784387.1__Gn-Gc
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggagugguccaaauucagguuagcggcguguggaaaaagccacuuugcguaggcuaugaacguguggucgugaaaagagagcugagugccaagcccauccagaggguugaaccuuguacaacuugcauaaccaaaugugagccacacggguuggugguccggucuacaggauuuaagaucuccagcgcaguggccugcgcuucggguguauguguuaccggcucucaaucccccucaacggagauuacucucaaguacccggggaucagucagagcuccggaggcgauauuggugugcauauggcgcacgacgaucagucugucagcucaaaaaucguggcacauugcccuccccaggacccaugucugguccacgggugcauagugugcgcccauggcuuaauuaauuaucaaugucacacagcucugagugccuucguugugguauucgucuuuuccagcguggcaaucauuugccucgccauccuuuacaagguucugaaauguuugaagaucgcuccucgcaaagugcuagauccccugauguggauuaccgucuucauaagauggguguauaagaagaugguagccaggguggcagacaacaucaaucagguuaaccgggaaauuggauggauggagggcgggcagcucgcgcugggaaauccagcucccaucccucgccacgccccaauaccgcgauacucuacuuaccuuaugcuguugcucauugucucauaugcaagugccugcagcgaacugauccaggcuuccucuagaaucacaaccuguucgacggagggugugaacaccaaaugcagguuaagcggcacagcccugauucgggcaggguccgugggagcugaagccugucuaaugcucaagggcgucaaagaggaucaaacuaaguuucugaaaaucaagaccguuucaagugagcuuucuugccgugaaggucagagcuacuggacaggguccuucucacccaaauguuugagcucucgcagaugccaucuggugggcgagugucacgugaacaggugccucuccuggcgggacaaugaaaccagugcggaguuuagcuucguaggagaaucuacuacaaugcgagagaacaagugcuuugagcaguguggcggguggggaugcgguuguuucaaugucaacccuuccugccuguuugugcauaccuaucuucagucaguucgcaaggaagcccugagaguguucaauuguauugacuggguccacaaauugacucucgagauaacggauuuugacggcagugugagcacaaucgaucugggggcuucguccucuagguucaccaacuggggaagcguuucauuaagucuggacgcagaaggcauuuccgguucuaauagcuuuuccuucaucgagucaccagggaagggcuacgccaucguggaugagcccuucagcgaaauuccucggcaaggauuucuaggcgagauacgcugcaacagugaaucuuccguacucagcgcucacgagucgugucugagagccccaaaucuuaucucauauaaacccaugauugaccaguuggaaugcacuaccaaccugaucgauccguucgucguguuugagagggggucucucccucagacacguaaugacaagaccuucgcagcgaguaaaggaaaccggggcgugcaggccuuuuccaaggguagcguccaagcugaucugacuuuaauguucgacaauuuugagguugauuucgugggggccgcaguaucuugugacgcugccuuucugaaccuuacaggaugcuacagcuguaaugcaggcgcccgagugugcuuguccauuacgucaaccgguacuggcacacucagugcucauaacaaggaugggagccugcacaucguccuaccaucugaaaacggaaccaaagaccagugccagauacugcauuucacagugcccgagguugaagaggaauuuauguauuccugugacggcgaugagagaccucuccuggugaaggggacucuuaucgcgauugaccccuucgaugacaggcgcgaggccggaggcgaaucaaccgucgugaauccaaaaagugguagcuggaacuuuuucgauugguucuccggguugaugucuugguuuggaggcccucugaagacgaucuuacucauuugccuguacguugcacuuucgaucggucuguucuuuuugcucauauaccugggccggaccgggcuaagcaaaauguggcuggcugccacaaagaaggccucauga

SEQ ID NO: 11282 - RNA, 3204 nt, Artificial Sequence
  derived and/or modified CDS sequence (opt3) from RVFV(200803169)__JF311384.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuauuuucguguuuuccagcaccgcaaucaucugccucgccguacuuuaccgcguccugaaguguuugaaaauugcuccuagaaaggugcuaaacccccugauguggauaacugccuucaucagguggguuuauaaaaagaugguggcacgggucgcggauaauauuaaccaggugaaucgcgaaaucggauggauggagggcgggcagcucgcucugggaaacccagcccccauaccucgacacgcaccaauuccgagauacucuacauaccuuaugcuguugcucaucguaucauaugccagugcuugcagcgaacugauccaggccuccucuaggauuaccacguguucgaccgagggugugaacacaaagugccgguuaagcggcacugcacugauccgugcuggguccguuggagccgaagcgugucuaaugcucaaaggcgucaagguggaccaaaccaaauuucugaagauuaaaacagugucaagugagcuuucuugccgcgagggucagagcuacuggacuggguccuucucacccaaguguuugagcucuagaaggugccaucuggucggcgaaugucacguuaaucggugccucuccuggcgagauaacgagaccagugccgaauuuagcuucgugggagagucuacaaccaugcgcgaaaauaaaugcuuugagcaguguggcggguggggaugcgguuguuucaacgugaauccuuccugccuguuuguacauacuuaucuucagucagucagaaaggaggcucugaggguguucaacuguauagacuggguucacaaguugacgcucgaaaucacagacuuugauggcagugugagcaccauugaccugggggcaucguccucucgguucacuaauuggggaagcgucucauuaagucuggaugccgagggcaucuccgguucuaacagcuuuuccuucaucgaaucaccagggaaaggcuacgcuauuguggacgagcccuucagcgagauaccucgccaaggauuucuaggcgaaguuagaugcaauagugagucuuccgugcucagcgcccacgaaucgugucugagggcaccaaaccuuguaucauauaagcccaugaucgaucaguuggagugcaccacaaaucugauugacccguucgucguguuugaacgugggucucucccucagacccggaacgauaaaacuuucgcggccaguaagggaaaucgaggcgugcaggcuuuuuccaaagguagcguccaagccgaccugacauuaauguucgauaacuuugagguugacuucgugggggcagcuguaucuugugaugccgcauuucugaaucuuacgggaugcuacagcuguaacgccggcgcuagagugugcuuguccaucaccucaacugguacaggcacccucagugcgcauaacaaggacgggagccugcacauuguccuaccaucugagaauggaacaaaggaucagugccagauccugcauuucacugugcccgaaguugaggaagaguuuauguauuccugugacggcgacgaaaggccucuccuggugaaagggacccuuauagccaucgaucccuucgacgaucgccgggaggcaggaggcgagucaacggucgugaacccaaagagugguagcuggaacuuuuucgacugguucuccggguugaugucuugguuuggaggcccucugaaaaccauuuuacucaucugccuguacguugcucuuucgauuggucuguucuuuuugcucaucuaccugggcagaacagggcuaagcaagauguggcuggccgccacuaaaaaggcuucauga

SEQ ID NO: 11283 - RNA, 3204 nt, Artificial Sequence
  derived and/or modified CDS sequence (opt3) from RVFV(2269/74)__DQ380222.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaacauaaggguaccauggacuccggccagacgaaacgagaacugaagucauuugauauuagucagugcccuaaaaucgggggacacggcagcaagaagugcacuggugacgccgcguucuguucugccuacgagugcaccgcacaguacgcuaaugccuauuguucccacgcuaacgggucaggaauugugcaaauccaggucagcggcguuuggaaaaagccacuuugcgugggcuacgaacguguaguggucaaaagagagcugagugccaagcccauacagaggguggaaccuuguacaacuugcaucaccaaaugugagccacauggguugguugugcggucuacaggauuuaagauuuccagcgcagucgccugcgcuucggguguguguguaaccggcucucaaucccccucaacggagaucacucucaaguauccggggauuagucagagcuccggaggcgauaucgguguucacauggcgcaugacgaucagucugugagcucaaaaauagucgcacacugcccuccccaggacccaugucuggugcaugggugcauugucugcgcccacggcuuaaucaauuaccaaugucacacagcucugagugccuucgugguuguguucguauuuuccagcgucgcaauuaucugccucgccauccuuuauaaggugcugaaauguuugaagauugcuccuaaaaagguucuaaacccccugauguggauaaccgccuucauccgcuggguguacaagaaaauggucgcaagaguggcggauaauauuaaccagguaaauagggaaaucggauggauggagggcgggcagcucgcucugggaaacccagcccccauaccucggcaugcaccaauuccgcgcuauucuacuuaccuuaugcuguugcucaucgugucauacgccagugcuugcagcgaacugauccaggccuccucucgaauuacaaccuguucgacggaggguguuaacaccaagugcagauuaagcggcacagcacugaucagggcuggguccgucggagccgaagcgugucuaaugcucaaaggcgugaaggaggaccaaacuaaauuucugaagauuaaaaccgugucaagugagcuuucuugccgggaaggucagagcuauuggacaggguccuucucacccaaguguuugagcucucgucgcugccaccuggucggcgagugucauguuaauagaugccucuccuggagggauaacgaaacuucagccgaguuuagcuucgugggagaaucuaccacaaugcgggagaauaagugcuuugagcaguguggcggguggggaugcgguuguuucaacgugaauccuuccugccuguuuguacacaccuaccuucagucaguccgaaaagaagcucugcgcguguucaacuguauagacuggguucacaaguugacucucgagaucacggacuuugauggcagugugagcacaauugaccugggggcaucguccucuagauucaccaauuggggaagcgucucauuaagucuggaugccgaaggcaucuccgguucuaacagcuuuuccuucaucgagucaccagggaaaggcuaugcuauuguggacgagcccuucagcgaaauaccuaggcaaggauuucuaggcgagauccggugcaauagugaaucuuccguucucagcgcccaugagucgugucugcgcgcaccaaaccuuauuucauacaagcccaugaucgaucaguuggaaugcacuaccaaucugauugacccguucgugguauuugagagagggucucucccucagacaaggaacgauaaaaccuucgcggccaguaagggaaaucguggcguccaggcuuuuuccaaggguagcgugcaagccgaccugacuuuaauguucgauaacuuugagguggacuucgucggggcagcuguuucuugugaugccgcauuucugaaucuuacaggaugcuauagcuguaacgccggcgcucgggugugcuuguccaucacgucaaccgguacuggcacacucagugcgcacaacaaagacgggagccugcauauaguacuaccaucugaaaauggaaccaaggaucagugccagauccugcacuucacagugcccgaggucgaagaggaauuuauguacuccugugacggcgacgagcgaccucuccuggugaaagggacucuuauugccaucgaucccuucgacgauagaagggaggcaggaggcgaaucaaccguugugaacccaaagagugguagcuggaacuuuuucgacugguucuccggguugaugucuugguuuggaggcccucugaaaacgauuuuacucaucugccuguaugucgcucuuucgauaggucuguucuuuuugcucauuuaccugggccgcaccgggcuaagcaagauguggcuggccgccacaaagaaagcuaguuga

SEQ ID NO: 11284 - RNA, 3204 nt, Artificial Sequence
  derived and/or modified CDS sequence (opt3) from RVFV(SA-51 (Van Wyck))__DQ380195.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacguggcagcaagaagugcacuggugacgccgcguucuguucugccuacgagugcaccgcacaguaugcuaaugccuacuguucccaugcuaacgggucaggaauugugcaaauccaggucagcggcguuuggaaaaagccacuuugcgugggcuaugaaagaguaguggucaaaagggagcugagugccaagcccauacagcggguggaaccuuguacaacuugcaucaccaaaugugagccacacggguugguugugcgcucuacaggauuuaagauuuccagcgcagucgccugcgcuucggguguguguguaaccggcucucaaucccccucaacggagaucacucucaaguacccggggauuagucagagcuccggaggcgauaucgguguucacauggcgcaugacgaucagucugugagcucaaaaauagucgcacacugcccuccccaggacccaugucuggugcaugggugcauugucugcgcccacggcuuaaucaauuaucaaugucauacagcucugagugccuucgugguuguguucguauuuuccagcgucgcaauuaucugccucgccauccuuuacaaggugcugaaauguuugaagauugcuccuagaaaaguucuaaacccccugauguggauaaccgccuucaucagguggguguauaagaagauggucgcacggguggcggauaauauuaaccagguaaaucgcgaaaucggauggauggagggcgggcagcucgcucugggaaacccagcccccauaccucgacacgcaccaauuccgagauacucuacuuaccuuaugcuguugcucaucgugucauaugccagugcuugcagcgaacugauccaggccuccucuaggauuacaaccuguucgacggaggguguuaacaccaaaugccgguuaagcggcacagcacugauccgugcuggguccgucggagccgaagcgugucuaaugcucaagggcgugaaagaggaccaaacuaaguuucugaaaauuaagaccgugucaagugagcuuucuugccgcgaaggucagagcuacuggacaggguccuucucacccaaauguuugagcucuagaaggugccaccuggucggcgagugucauguuaaucggugccucuccuggcgagauaacgaaaccagugccgaguuuagcuucgugggagaaucuacuacaaugcgcgagaauaagugcuuugagcaguguggcggguggggaugcgguuguuucaacgugaauccuuccugccuguuuguacacaccuaucuucagucagucagaaaggaagcucugaggguguucaacuguauagacuggguucauaaauugacucucgaggugacggacuuugauggcagugucagcacaaucgaccugggggcaucguccucucgguucaccaauuggggaagcgugucauuaagucuggaugccgaaggcauuuccgguucuaacagcuuuuccuucaucgagucaccagggaagggcuacgcuaucguugacgagcccuucagcgaaauuccucgccaaggauuucuaggcgagauaagaugcaauagugaaucuuccgugcucagcgcccacgagucgugucugagggcaccaaaccuuaucucauauaaacccaugauugaucaguuggaaugcacuaccaaucugaucgacccguucguagucuuugagcgugggucucucccucagacacggaacgauaagaccuucgcggccaguaaaggaaaucgaggcgugcaggcuuuuuccaaggguagcgugcaagccgaccugacuuuaauguucgauaacuuugaggucgacuucguuggggcagcugugucuugugaugccgcauuucugaaucuuacaggaugcuacagcuguaacgccggcgcuagaguaugcuuguccauuacgucaaccgguacuggcacacucagugcgcacaacaaggacgggagccugcauaucgugcuaccaucugaaaauggaaccaaagaucagugccagauacugcacuucacaguccccgagguggaagaggaauuuauguauuccugugacggcgacgagaggccucuccugguuaaggggacucuuaucgccauugaucccuucgacgaucgccgggaggcaggaggcgaaucaaccguggucaacccaaaaagugguagcuggaacuuuuucgacugguucuccggguugaugucuugguuuggaggcccucugaagacgaucuuacucauuugccuguacguggcucuuucgaucggucuguucuuuuugcucauauaccugggcagaaccgggcuaagcaaaauguggcuggccgccacaaagaaggcuucauga

SEQ ID NO: 11285 - RNA, 3204 nt, Artificial Sequence
  derived and/or modified CDS sequence (opt3) from RVFV(OS-8)__DQ380185.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggagugguccaaauucagguuagcggcguguggaaaaagccacuuugcguaggcuaugaacguguggucgugaaaagagagcugagugccaagcccauccagaggguugaaccuuguacaacuugcauaaccaaaugugagccacacggguuggugguccggucuacaggauuuaagaucuccagcgcaguggccugcgcuucggguguauguguuaccggcucucaaucccccucaacggagauuacucucaaguacccggggaucagucagagcuccggaggcgauauuggugugcauauggcgcacgacgaucagucugucagcucaaaaaucguggcacauugcccuccccaggacccaugucugguccacgggugcauagugugcgcccauggcuuaauuaauuaucaaugucacacagcucugagugccuucguugugguauucgucuuuuccagcguggcaaucauuugccucgccauccuuuacaagguucugaaauguuugaagaucgcuccucgcaaagugcuaaacccccugauguggauuaccgccuucauaagaugggucuauaagaagaugguggcaaggguagcggauaauaucaaccaggugaaucgggaaauuggauggauggagggcgggcagcucgcucugggaaacccagcccccaucccucgccacgcaccaauaccgcgauacucuacuuaccuuaugcuguugcucauuguuucauaugccagugcuugcagcgaacugauccaggccuccucuagaaucacaaccuguucgacggagggugucaacaccaaaugcagguuaagcggcacagcacugauucgggcuggguccgugggagccgaagcgugucuaaugcucaagggcgugaaagaggaccaaacuaaguuucugcguaucaaaaccgucucaagugagcuuucuugccgcgaaggucagagcuacuggacaggguccuucucacccaaguguuugagcucuagaaggugccaucugguuggcgagugucacgugaaucggugccucuccuggcgagauaacgaaaccagugccgaguuuagcuucgugggagaaucuacuacaaugcgcgagaauaaaugcuuugagcaguguggcggguggggaugcgguuguuucaacguaaauccuuccugccuguuuguccauaccuaucuucagucagugagaaaggaagcucugaggguuuucaacuguauugacugggugcacaaguugacucucgagauaacggacuuugauggcagugucagcacaaucgaccugggggcaucguccucucgguucaccaauuggggaagcgugucauuaagucuggaugccgaaggcauuuccgguucuaacagcuuuuccuucaucgagucaccagggaaaggcuacgcuaucguugacgagcccuucagcgaaauuccucgccaaggauuucuaggcgagauaagaugcaauagugaaucuuccgugcucagcgcccacgagucgugucugagggcaccaaaccuuaucucauauaagcccaugauugaucaguuggaaugcacuaccaaucugaucgacccguucguagucuuugagcgugggucucucccucagacacggaacgauaaaaccuucgcggccaguaagggaaaucgaggcgugcaggcuuuuuccaaagguagcgugcaagccgaccugacuuuaauguucgauaacuuugaggucgacuucguuggggcagcugugucuugugaugccgcauuucugaaucuuagcggaugcuacuccuguaacgccggcgcuagaguaugcuugucaauuacaaguacggguaccggcacucucagcgcgcauaacaaggacgggucucugcacaucgugcuaccauccgaaaauggaacaaaggaucagugccagauacugcauuucaccguccccgagguggaagaggaauuuauguauucaugugacggcgacgagaggccucuccugguuaaagggacacuuaucgccauugaucccuucgacgaucgccgggaggcaggaggcgaaaguacuguggucaacccaaagagcgguuccuggaacuuuuucgacugguucucuggguugaugucgugguuuggaggcccucugaaaaccaucuuacucauuugccuguacguggcucuuagcaucggucuguucuuuuugcucauauaccugggcagaacggggcuaucaaagauguggcuggccgccaccaaaaaggcuuccuga

SEQ ID NO: 11286 - RNA, 3204 nt, Artificial Sequence
  derived and/or modified CDS sequence (opt3) from RVFV(KEN07-KUR340)__EF460404.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggcccugaaaaagugcgaugggcaguuauccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuauuuucguguuuuccagcaccgcaaucaucugccucgccguacuuuaccgcaugcugaaguguuugaaaauugcuccuagaauaguccuaaacccccugauguggaucacugccuucauuagguggguguauaagaaaaugguugcacggguggcggauaauaucaaccaggucaaucgcgaaauaggauggauggagggcgggcagcucgcucugggaaacccagcccccauuccucgacacgcaccaaucccgagauacucuacauaccuuaugcuguugcucaucgugucauaugccagugcuugcagcgaacugauucaggccuccucuaggaucaccacguguucgaccgaggguguaaacacaaagugccgguuaagcggcacugcacugauucgugcuggguccgugggagccgaagcgugucuaaugcucaagggcguuaaagaggaccaaaccaaguuucugaaaauaaagacagucucaagugagcuuucuugccgcgaaggucagagcuacuggacuggguccuucucacccaaauguuugagcucuagaaggugccaucuggugggcgagugucacgugaaucggugccucuccuggcgagauaacgaaaccagugccgaguuuagcuucgucggagaaucuacaaccaugcgcgagaauaagugcuuugagcaguguggcggguggggaugcgguuguuucaacguuaauccuuccugccuguuugugcauacuuaucuucagucagugagaaaagaagcucugaggguauucaacuguaucgacuggguccacaaguugacgcucgagauuacagacuuugauggcagugugagcaccaucgaccugggggcaucguccucucgguucacuaauuggggaagcguuucauuaagucuggaugccgaaggcaucuccgguucuaacagcuuuuccuucauugagucaccagggaagggcuacgcuauaguggacgagcccuucagcgaaaucccucgccaaggauuucuaggcgagauuagaugcaauagugaaucuuccguccucagcgcccacgagucgugucugagggcaccaaaccuugugucauauaaacccaugaucgaucaguuggaaugcaccacaaaucugauugacccguucguuguguuugagcgugggucucucccucagacccggaacgauaagacuuucgcggccaguaaaggaaaucgaggcguacaggcuuuuuccaaggguagcguccaagccgaccugacauuaauguucgauaacuuugagguggacuucgugggggcagcugucucuugugaugccgcauuucugaaucuuacgggaugcuacagcuguaacgccggcgcuagaguuugcuuguccaucaccucaacugguacaggcacccucagugcgcauaacaaagacgggagccugcacauagugcuaccaucugaaaauggaacaaaggaucagugccagauccugcauuucacuguacccgagguggaagaggaauuuauguauuccugugacggcgacgagaggccucuccuggucaaggggacccuuauugccaucgaucccuucgacgaucgccgggaggcaggaggcgaaucaacggugguuaacccaaaaagugguagcuggaacuuuuucgacugguucuccggguugaugucuugguuuggaggcccucugaagaccauuuuacucaucugccuguacguggcucuuucgauaggucuguucuuuuugcucauuuaccugggcagaacagggcuaagcaaaauguggcuggccgccacuaagaaggcuucauga

SEQ ID NO: 11287 - RNA, 3204 nt, Artificial Sequence
  derived and/or modified CDS sequence (opt3) from RVFV(ANK-3837)__DQ380215.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaaacuggacuccggccagaccaagcgagaacuuaaaucauuugauauuagucagugcccuaagaucgggggacauggcagcaagaaaugcacgggugacgccgcguucuguucugccuacgagugcacugcacaguaugcuaaugccuacuguucccacgcuaacgggucaggaauugugcaaauccaggucagcggcguuuggaagaaaccacugugcgugggcuaugaacguguaguggucaagagagaguugagugccaaacccauacagaggguggaaccuuguaccacaugcaucacuaagugugagccacacgggcucguugugcggucuaccggauuuaagauuuccagcgcagucgccugcgcuucggguguguguguaacaggcucucaaucccccucaaccgagaucacgcugaaauacccggggauuagucagagcuccggaggcgauaucgguguucauauggcgcacgacgaucagucugugagcucaaagauagucgcacauugcccuccccaggacccauguuuagugcacgggugcauugucugcgcccauggccugaucaauuaucaaugucacacugcucucagugccuucgugguuguguucguauuuuccagcauugcaaucaucugccuugccauucuguaccgcgucuugaaaugucuaaagauagcuccuagaaaagugcugaacccccucauguggaucacagccuucauuagguggguuuaucggaagaugguggcacgcgucgcggauaauaucaaccaggugaaucgagaaauaggauggauggagggcgggcagcugguacuuggaaacccagcucccauuccuagacacgugccaaucccgagguacucuaccuaccugauguugcuccugaucguuucauaugccagugcaugcagcgaauuaauucaggccuccucucggaucacuacauguucgaccgagggugucaacacgaagugccgucugagcggcaccgcucuaauucgcgccggguccgugggagcagaggcuugucucaugcugaaaggcgugaaggaagaccaaacaaaauuucuuaagauaaaaacugucucaagugaguugucuugcagagaaggucagagcuacuggaccggguccuucucacccaagugucugagcucuaggcggugccaucucguuggcgagugucacgugaaucgaugccuguccuggcgcgauaacgaaacaagugccgaguuuagcuucgugggagaaucuacuaccaugagagagaauaaaugcuuugagcaguguggcggguggggaugcgguuguuucaacguaaauccuuccugccuuuuuguccauacauaucugcagucagugaggaaggaagcguugcggguuuucaacuguaucgacugggugcacaagcucacccuggagauuacugacuuugauggcagugucagcacgaucgacuuaggggccucguccucucgcuucacaaauuggggaagcgugucacugagucuagaugcugaaggcaucuccgguucuaacagcuuuuccuucauugagucaccagggaaaggcuacgcaauaguugacgagcccuucagcgaaaucccuagacaaggauuucucggcgagauuaggugcaauagugaaucuuccgugcugagcgcccacgagucgugucuucgugcuccaaacuugaucucauauaagcccaugauugaucagcuggaaugcaccacuaaucucaucgacccguucguagucuuugagcgggggucucugccucagacccgaaacgauaaaacauucgccgcaaguaagggaaauagaggcgugcaggcguuuuccaaagguagcgugcaagccgacuuaacccugauguucgauaacuuugaggucgacuucguuggggcugccgugucuugugaugcagcuuuucuuaauuugacuggaugcuacagcuguaacgccggcgcaaggguaugccucuccauaacaucaacggguaccggcacucugagugcccauaacaaggacgggagccuacacaucgugcugccaucugaaaauggaacaaaggaucagugccagauucuccauuucaccguccccgagguggaagaggaauuuauguauuccugugacggcgacgagcgcccucugcuuguucgggggacauugaucgcuauugaucccuucgacgauagaagggaggcgggaggcgaaucaacuguggucaacccaaaaagugguagcuggaacuuuuucgacugguucuccgggcugaugucuugguuuggaggcccuuuaaagaccauccuccugauaugccuuuacguggcccugucgauugguuuguucuuucuccugaucuaccuaggccgcacggggcugagcaaaauguggcucgcagcuaccaagaaagccucauga

SEQ ID NO: 11288 - RNA, 3204 nt, Artificial Sequence
  derived and/or modified CDS sequence (opt3) from RVFV(Lunyo)__KU167026.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccaugguguccggccagacgaaacgagaacugaagucauuugacauuagucagugcccuaaaaucgggggacauggcagcaagaagugcacuggugaugccgcguucuguucugccuacgagugcaccgcacaguaugcuaaugccuacuguucccacgcuaacgggucaggaauuguccaaauccagguuagcggcguguggaaaaagccacuuugcguaggcuaugaacguguggucgugaaaagagagcugagugccaagcccauacagaggguugaaccuuguacaacuugcaucaccaaaugugagccacacggguuggugguccggucuacaggauuuaagauuuccagcgcaguggccugcgcuucggguguauguguuaccggcucucaaucccccucaacggagaucacucucaaguacccggggauuagucagagcuccggaggcgacaucggugugcauauggcgcacgaugaccagucugucagcucaaaaauaguggcacauugcccuccccaggauccaugucugguccacgggugcauugugugcgcccauggcuuaaucaauuaucaaugucacacagcucugagugccuucguugugguauucgucuuuuccagcguggcaauuaucugccucgccauccuuuacaagguucugaaauguuugaagauugcuccucgcaaagugcuaaacccccugauguggauaaccgccuucaucagaugggucuauaagaagaugguggcaaggguagcggacaauauuaaccaggugaaucgggaaaucggauggauggagggcgggcagcucgcucugggaaacccagcccccauaccucgccacgcaccaauuccgcgauacucuacuuaccuuaugcuguugcucaucguuucauaugccagugcuugcagcgaacugauccaggccuccucuagaauuacaaccuguucgacggagggugucaacaccaggugccgguuaagcggcacagcacugauccgugcuggguccgugggagccgaagcgugucuaaugcucaaaggcgugaaggaggaucaaacuaaauuucugaagauuaaaaccgucucaagugagcuuucuugccgcgaaggucagagcuacuggacaggguccuucucacccaaguguuugagcucuagaaggugccaucugguuggcgagugucacgugaaucggugccucuccuggcgagacaacgaaacaagugccgaguuuagcuucgugggagaaucuaccacaaugcgcgagaauaaaugcuuugagcaguguggcggguggggaugcgguuguuucaacguaaauccuuccugccuguuuguccauaccuaucuucagucagugagaaaggaagcucugaggguuuucaacuguauagauugggugcacaaguugacucucgagaucacggacuuugacggcagugucagcacaauugaucugggggcaucguccucucgguucaccaauuggggaagcgugucauuaagucuggacgccgaaggcaucuccgguucuaacagcuuuuccuucaucgagucaccagggaaaggcuacgcuauuguugaugagcccuucagcgaaauaccucgccaaggauuucuaggcgagaucagaugcaauagugaaucuuccgugcucagcgcccacgagucgugucugagggcaccaaaccuuauuucauauaagcccaugaucgaccaguuggaaugcacuaccaaucugauugauccguucguagucuuugagcgugggucucucccucagacacggaacgacaaaaccuucgcggccaguaagggaaaucgaggcgugcaggcuuuuuccaaagguagcgugcaagccgaucugacuuuaauguucgacaacuuugaggucgauuucguuggggcagcugugucuugugacgccgcauuucugaaucuuacaggaugcuacagcuguaacgccggcgcuagaguaugcuuguccaucacgucaaccgguacuggcacacucagugcgcauaacaaggaugggagccugcacauagugcuaccaucugaaaauggaaccaaggaccagugccagauccugcauuucacaguccccgagguggaagaggaauuuauguauuccugugauggcgacgagaggccucuccugguuaaagggacucuuauugccaucgaccccuucgaugaccgccgggaggcaggaggcgaaucaaccguggucaacccaaagagugguagcuggaacuuuuucgauugguucuccggguugaugucuugguuuggaggcccucugaaaacgauuuuacucaucugccuguacguggcucuuucgauaggucuguucuuuuugcucauuuaccugggcagaaccgggcuaagcaagauguggcuggccgccacuaaaaaggcuucauga

SEQ ID NO: 11289 - RNA, 3204 nt, Artificial Sequence
  derived and/or modified CDS sequence (opt3) from RVFV(200803167)__JF311382.1__Gn-Gc
auggccggcaucgcuaugaccgugcugcccgcacucgccgucuucgcgcuugcuccuguuguguuugccgaggaccugcacuugagaaauaggccagggaagggacauaauuacauugaugguaugacacaggaagacgcaacuugcaaaccgguaacguaugccggcgcuuguagcuccuucgauguguuacuggagaaggggaaauuuccccuauuccaaucuuacgcacaccaucggacccuccuggaagccguccacgacacaauaaucgcuaaggccgauccuccaucaugcgaccuucagagugcgcauggaaaccccuguaugaaagagaagcuggugaugaagacucacugcccuaaugauuaucagagcgcacacuacuugaacaaugacggcaaaauggccuccguuaaguguccacccaaauaugaacucaccgaggauugcaacuuuugucgccagaugacaggugcuucucugaagaaagggucguacccucugcaagaccucuucugccagucaagcgaggaugacggaaguaaguuaaagaccaaaaugaagggcgugugugaagucggcgugcaggcccugaaaaagugcgaugggcagcuuuccacugcacaugagguaguuccauuugcuguguucaaaaauucuaagaaagucuauuuggacaagcuggaccuaaagacagaagagaaccuccugccggauagcuuuguguguuucgagcacaaaggacaauacaaggguaccauggacuccggccagacgaaacgagaacuuaagucauuugauauuagucagugccccaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccucugugcgugggcuaugaacguguaguggucaaaagagaguugagugccaagccaauacagaggguggaacccuguacaacuugcaucaccaaaugugagccucacgggcucguugugcggucuacaggauuuaagauuuccagcgcagucgccugcgcuucggguguguguguaaccggcucucaauccccaucaacggagaucgcgcugaaguaccccgggauuagucagagcuccggaggcgauaucgguguucauauggcacacgacgaucagucugugagcucaaaaauagucgcccauugcccgccucaggaccccuguuuagugcacgggugcauugucugcgcucauggccugaucaauuaucaaugucacacugcccucagugcauucgugguuguguucguauuuuccagcauugccaucaucugccuugcuauucuguaccgcgucuugaagugucuaaaaauagccccaagaaaggugcugaacccucucauguggaucacagcauucauuagguggguuuauaaaaagaugguggcgcgggucgcugauaauaucaaccaggugaaucgcgaaauaggauggauggagggcgggcagcugguacuuggaaaccccgccccaauuccccgacacgcaccuaucccaagauacucuaccuaccugauguugcuccugaucgugucauaugccagugcuugcagcgaauuaauucaggccuccucuaggaucacuacauguucgaccgaggguguuaacacgaagugccggcugagcggcaccgcacuaauucgugcuggguccgucggagccgaagcgugucucaugcugaaaggcgugaaggaggaccaaacaaaauuucuuaagauaaaaacugugucaagugaguugucuugccgcgaaggucagagcuacuggaccggguccuucucaccgaagugucugagcucuagaaggugccaucucgucggcgagugucacguuaaucggugccuguccuggcgagauaacgaaacaagugccgaguuuagcuucgugggagaaucuacuaccaugcgcgagaauaaaugcuuugagcaguguggcggguggggaugcgguuguuucaacgugaaucccuccugccuuuuuguacauacauaucugcagucagucagaaaggaggcuuugaggguguucaacuguaucgacuggguucacaagcucacccuggaaauuacugacuuugauggcagugugagcacgaucgacuuaggggcaucguccucucgguucacaaauuggggaagcgucucacugagucuagaugccgaaggcaucuccgguucuaacagcuuuuccuucauugagucaccugggaaaggcuacgcuauaguggacgagccauucagcgaaaucccccgccaaggauuucucggcgagauuagaugcaauagugaaucuuccguucugagcgcccacgagucgugucuuagggcaccuaacuugaucucauauaagccaaugauugaucagcuggaaugcaccacuaaucucaucgaccccuucgugguauuugagcgugggucucugccgcagacccggaacgauaaaacauucgcggccaguaagggaaaucgaggcguccaggcuuuuuccaaagguagcgugcaagccgacuuaacccugauguucgauaacuuugagguggacuucgucggggcagcuguuucuugugaugccgcauuucuuaauuugacuggaugcuacagcuguaacgccggcgcuagagugugccucuccauaacaucaacggguaccggcacucugagugcgcauaacaaggacgggagccuacacaucguacugccuucugaaaauggaacaaaggaucagugccagauucuccauuucaccgugccagaggucgaagaggaauuuauguauuccugugacggcgacgagaggccccugcuugugaaagggacauugaucgccauugauccuuucgacgaucgccgggaggcaggaggcgaaucaacuguugugaaccccaagagugguagcuggaacuuuuucgacugguucuccgggcugaugucuugguuuggaggcccauuaaaaaccaugcuccugaucugccuuuacgucgcucugucgauagguuuguucuuucuccugauuuaccuaggcagaacggggcugagcaagauguggcucgccgccaccaaaaaggcuucauga

SEQ ID NO: 11290 - RNA, 3204 nt, Artificial Sequence
  derived and/or modified CDS sequence (opt3) from RVFV(2373/74)__DQ380194.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauggucgcacauugcccuccccaggacccaugucuggugcacgggugcauagucugcgcccauggcuuaauuaauuaucaaugucacacagcucugagugccuucgugguuguguucguauuuuccagcgucgcaaucauuugccucgccauccuuuacaaggugcugaaauguuugaagaucgcuccucgcaaaguucuaaacccccugauguggauuaccgccuucauaagauggguguauaagaagauggucgcaaggguggcggauaauaucaaccagguaaaucgggaaauuggauggauggagggcgggcagcucgcucugggaaacccagcccccaucccucgccacgcaccaauaccgcgauacucuacuuaccuuaugcuguugcucauugugucauaugccagugcuugcagcgaacugauccaggccuccucuagaaucacaaccuguucgacggaggguguuaacaccaaaugcagguuaagcggcacagcacugauucgggcuggguccgucggagccgaagcgugucuaaugcucaagggcgugaaagaggaccaaacuaaguuucugaaaaucaagaccgugucaagugagcuuucuugccgugaaggucagagcuacuggacaggguccuucucacccaaauguuugagcucucgcagaugccaucuggucggcgagugucacguuaauaggugccucuccuggcgggauaacgaaaccagugccgaguuuagcuucgugggagaaucuacuacaaugcgagagaauaagugcuuugagcaguguggcggguggggaugcgguuguuucaacgugaauccuuccugccuguuuguacauaccuaucuucagucaguccgcaaggaagcucugagaguguucaacuguauugacuggguucacaaauugacucucgagauaacggacuuugauggcagugugagcacacuggacuuaggggcaucguccucuagguucaccaauuggggaagcgucucacugagucuagaugccgaaggcaucuccgguucuaacagcuuuuccuucauugagucaccagggaagggcuacgcuaucguggacgagcccuucagcgaaaucccucggcaaggauuucucggcgagauucgcugcaauagugaaucuuccguucugagcgcccacgagucgugucuuagagcaccaaacuugauaucauauaaacccaugaucgaucagcuggaaugcacuaccaaucucauugacccguucgugguauuugagagggggucucugccucagacacguaacgagaagaccuucgcggccaguaaaggaaaucggggcguccaggcuuuuuccaaggguagcgugcaagccgauuuaacucugauguucgacaacuuugaaguggauuucgucggggcagcuguuucuugugacgccgcauuucuuaauuugacaggaugcuacagcuguaacgccggcgcucgagugugccucuccaucacgucaaccgguacuggcacacugagugcgcauaacaaggaugggagccuacacauuguacugccaucugagaauggaaccaaagaccagugccagauccuccauuucacagugcccgaagucgaggaagaguuuauguauuccugugauggcgacgagagaccucugcuugugaaggggacuuugauagccaucgaccccuucgaugacaggcgcgaagcaggaggcgagucaaccguugugaacccaaaaagugguagcuggaacuuuuucgauugguucuccgggcugaugucuugguuuggaggcccuuuaaagacgauucuccugaucugccuuuacgucgcucugucgauugguuuguucuuucuccugaucuaccuaggccggaccgggcugagcaaaauguggcucgccgccacaaagaaggcuucauga

SEQ ID NO: 11291 - RNA, 3204 nt, Artificial Sequence
  derived and/or modified CDS sequence (opt3) from RVFV(Kenya 57 (Rintoul))__DQ380192.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagauuaaacgagaacugaagucauuugauaucagucagugcccuaaaauugggggacauggcagcaagaagugcacgggugacgccgcguucuguucugccuacgagugcacugcacaguaugcuaaugccuacuguucccacgcuaacgggucaggaaucgugcaaauacaggucagcggcguuuggaaaaagccacuuugcgugggcuaugaacguguaguggucaaaagagagcugagugccaagcccauccagaggguggaaccuuguaccacaugcauuacuaaaugugagccacacggguugguugugcggucuaccggauuuaagaucuccagcgcagucgccugcgcuucggguguguguguaacaggcucucaaucccccucaaccgagauuacgcucaaguacccggggaucagucagagcuccggaggcgauauagguguucauauggcgcacgacgaucagucugugagcucaaaaauugucgcacauugcccuccccaggacccaugucuggugcacgggugcaucgucugcgcccauggcuuaauuaauuaucaaugucacacugcucugagugccuucgugguuguguucguauuuuccagcgucgcaaucaucugccucgccauucuuuacaaggugcugaaauguuugaagauagcuccucgcaaaguucuaaacccccugauguggaucacagccuucauuagauggguguauaagaagauggucgcaaggguggcggauaauaucaaccagguaaaucgggaaauaggauggauggagggcgggcagcucgugcugggaaacccagcucccauuccucgccacgccccaaucccgcgauacucuaccuaccuuaugcuguugcucaucguuucauaugcaagugccugcagcgaacugauucaggcuuccucuagaaucacuacauguucgaccgagggugucaacacgaaaugcagguuaagcggcaccgcccugauucgggcaggguccgugggagcugaagccugucuaaugcucaagggcgugaaagaggaccaaacaaaguuucugaaaauaaagacugucucaagugagcuuucuugccgugaaggucagagcuacuggaccggguccuucucacccaaauguuugagcucucgcagaugccaucugguuggcgagugucacgugaauaggugccucuccuggcgggauaacgaaacaagugcggaguuuagcuucgugggagaaucuacuaccaugcgagagaauaagugcuuugagcaguguggcggguggggaugcgguuguuucaacguaaauccuuccugccuguuuguccauacauaucuucagucagugcgcaaggaagcccugagaguuuucaacuguaucgacugggugcacaaauugacccucgagauuacugacuuugauggcagugucagcacgguggaccugggggcuucguccucuagguucacaaauuggggaagcguuucauuaagucuggaugcagaaggcaucuccgguucuaacagcuuuuccuucaucgagucaccagggaagggcuacgccauuguggacgagcccuucagcgaaauaagucggcaaggauuucuaggcgagauccgcugcaauucugaauccagcguacucucggcucacgagucaugucugagagccccuaaccuuauuucuuauaaaccaaugaucgaucaguuggaaugcaccacuaaucugauugaccccuucgucguguuugagagggggagucucccgcagacccguaacgauaagacauucgcagcguccaaaggaaaucggggcgugcaggccuuuagcaaggguucuguccaagcugaccugaccuuaauguucgauaacuuugagguugacuucgugggggccgcaguaagcugugaugcugccuuucugaaucuuacuggaugcuacuccuguaacgcaggcgcccgagugugcuugucaaucacaaguacggguaccggcacucucagcgcucauaacaaggacgggucucugcacauaguccuaccuuccgaaaauggaacaaaagaucagugccagauccugcauuucaccgugccagagguugaagaggaauuuauguauucaugugacggcgacgagagaccccuccuggugaaggggacacuuauugcgaucgauccuuucgacgauaggcgcgaggccggaggcgaaaguacugucgugaaccccaaaagcgguuccuggaacuuuuucgacugguucucuggguugaugucgugguuuggaggcccacugaagaccauuuuacucaucugccuguacguugcacuuagcauaggucuguucuuuuugcucauuuaccugggccggacggggcuaucaaaaauguggcuggcugccaccaagaaggccuccuga

SEQ ID NO: 11292 - RNA, 3204 nt, Artificial Sequence
  derived and/or modified CDS sequence (opt3) from RVFV(RVFBJ01/2016)__KX785331.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaacaugaauugaccgaggauugcaacuuuugucgccagaugacaggugcuucucucaagaaagggucguauccacugcaagaccuguucugccagucaagcgaggaugacggaaguaagcucaagaccaaaaugaagggcgugugugaagucggcgugcaggccuuaaagaagugcgaugggcagcuguccacugcacacgagguaguuccguuugcuguguucaaaaauucuaagaaagucuaccuugacaaguuggaccugaagacagaagagaaccuacuccccgauagcuuuguguguuucgagcauaaaggacaauauaaggguaccauggacuccggccagacgaaacgagaacugaagucauuugauauuagucagugcccuaaaaucgggggacacggcagcaagaagugcacuggugacgccgcguucuguucugccuacgagugcaccgcacaguacgcuaaugccuauuguucccacgcuaacgggucaggaauugugcaaauccaggucagcggcguuuggaaaaagccacuuugcgugggcuacgaacguguaguggucaaaagagagcugagugccaagcccauacagaggguggaaccuuguacaacuugcaucaccaaaugugagccacauggguugguugugcggucuacaggauuuaagauuuccagcgcagucgccugcgcuucggguguguguguaaccggcucucaaucccccucaacggagaucacucucaaguauccggggauuagucagagcuccggaggcgauaucgguguucacauggcgcaugacgaucagucugugagcucaaaaauagucgcacacugcccuccccaggacccaugucuggugcaugggugcauugucugcgcccacggcuuaaucaauuaccaaugucacacagcucugagugccuucgugguuguguucguauuuuccagcgucgcaauuaucugccucgccauccuuuauaaggugcugcgcuguuugaaaauugcuccuaagaaaguucuaaacccccugauguggauaaccgccuucaucagauggguguacaagaagauggucgcaaggguggcggauaauauuaaccagguaaaucgggaaaucggauggauggagggcgggcagcucgcucugggaaacccagcccccauaccucgccaugcaccaauuccgcgauauucuacuuaccuuaugcuguugcucaucaucucauacgccagugcuugcagcgaacugauucaggccuccucuagaaucacaaccuguucgacggagggugugaacaccaaaugcagguuaagcggcacagcacugauucgggcuggguccguuggagccgaagcgugucuaaugcucaagggcgucaaagaggaccaaacuaaguuucugaaaauaaagaccgugucaagugagcuuucuugccgugaaggucagagcuauuggacaggguccuucucacccaaauguuugagcucucgcagaugccaccuggugggcgagugucaugucaauaggugccucuccuggcgggauaacgaaaccagugccgaguuuagcuucguuggagaaucuacuacaaugcgagagaauaagugcuuugagcaguguggcggguggggaugcgguuguuucaacgugaauccuuccugccuguuugugcacaccuaccuucagucaguacgcaaggaagcucugagagucuucaacuguaucgacugggugcacaaauugacucucgagauuacggacuuugauggcaguguuagcacaaucgaccugggggcaucguccucuagguucaccaauuggggaagcgugucauuaagucuggaugccgaaggcaucuccgguucuaacagcuuuuccuucauugagucaccagggaagggcuaugcuauagucgacgagcccuucagcgaaaucccucggcaaggauuucuaggcgagauucgcugcaauagugaaucuuccgugcucagcgcccaugagucgugucugagagcaccaaaccuuaucucauacaaacccaugauugaucaguuggaaugcacuaccaaucugaucgacccguucguuguguuugagagggggucucucccucagacacguaacgauaagaccuucgcggccaguaaaggaaaucggggcguacaggcuuuuuccaaggguagcguccaagccgaccugacuuuaauguucgauaacuuugagguggacuucgugggggcagcugucucuugugaugccgcauuucugaaucuuacaggaugcuauagcuguaacgccggcgcucgaguuugcuuguccauaacgucaaccgguacuggcacacucagugcgcacaacaaggacgggagccugcauaucgugcuaccaucugaaaauggaaccaaagaucagugccagauucugcacuucacaguacccgagguggaagaggaauuuauguacuccugugacggcgacgagagaccucuccuggucaaggggacucuuaucgccauugaucccuucgacgauaggcgcgaggcaggaggcgaaucaaccgugguuaacccaaaaagugguagcuggaacuuuuucgacugguucuccggguugaugucuugguuuggaggcccucugaagacgaucuuacucauaugccuguauguggcucuuucgauuggucuguucuuuuugcucaucuaccugggccggaccgggcuaagcaaaauguggcuggccgccacaaagaaggcuucauga

SEQ ID NO: 11293 - RNA, 3204 nt, Artificial Sequence
  derived and/or modified CDS sequence (opt3) from RVFV(clone 13)__DQ380213.1__Gn-Gc
auggccggcaucgcuaugacagugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaacaugaauugaccgaggauugcaacuuuugucgccagaugacaggugcuucucucaagaaagggucguauccacugcaagaccuguucugccagucaagcgaggaugacggaaguaagcucaagaccaaaaugaagggcgugugugaagucggcgugcaggccuuaaagaagugcgaugggcagcuguccacugcacacgagguaguuccguuugcuguguucaaaaauucuaagaaagucuaccuugacaaguuggaccugaagacagaagagaaccuacuccccgauagcuuuguguguuucgagcauaaaggacaauauaaggguaccauggacuccggccagacgaaacgagaacugaagucauuugauauuagucagugcccuaaaaucgggggacacggcagcaagaagugcacuggugacgccgcguucuguucugccuacgagugcaccgcacaguacgcuaaugccuauuguucccacgcuaacgggucaggaauugugcaaauccaggucagcggcguuuggaaaaagccacuuugcgugggcuacgaacguguaguggucaaaagagagcugagugccaagcccauacagaggguggaaccuuguacaacuugcaucaccaaaugugagccacauggguugguugugcggucuacaggauuuaagauuuccagcgcagucgccugcgcuucggguguguguguaaccggcucucaaaaucccuccacggagaucacucucaaguauccggggauuucacagaguagcggaggcgauaucgguguucacauggcgcaugacgaucaguccgugucuagcaaaauagucgcacacugcccuccccaggacccaugucuggugcaugggugcauugucugcgcccacggcuuaaucaacuaccaaugucacacagcucugucagccuucgugguuguguucguauuuaguuccauugcaaucaucugccucgccauucuuuaucgcguccugaaguguuugaaaauagcuccuagaaaggugcuaaauccccugauguggaucaccgccuucauuagguggguuuacaaaaagaugguggcacgggucgcggauaacaucaaucaggugaaccgcgaaauaggauggauggagggcgggcagcucguacugggaaacccagcucccauuccucgacaugccccaaucccgagauauagcacuuaccuuaugcuguugcucaucgugucuuacgcaucagccugcagugaacugauucaggcuagcuccaggaucacaaccuguucuacggaggguguuaauaccaagugccgguuaucgggcacagcccugauucgugcagggagcgucggagcugaagccugucuaaugcucaaaggcgugaaggacgaucaaacuaaauuucugaagauaaaaaccguguccucagagcuuaguugccgcgagggucagucuuauuggacagggagcuucucccccaaguguuugucaagcagaaggugccaccuggucggcgaaugucauguuaaccggugccucucuuggcgagacaaugagacuuccgcggaauuuaguuucgugggagagagcaccacaaugcgcgaaaacaaaugcuuugagcaguguggcggguggggaugcgguuguuucaaugugaacccuucuugccuguuuguacacaccuaccuucaguccgucagaaaggaggcccugaggguguucaauuguaucgacuggguucacaaguugacucucgaaauuacggauuuugacggcucagugaguacaaucgaucugggggcuagcucgucccgguucaccaacuggggaucugucagcuuaucacuggacgcagagggcaucagugguuccaauucuuuuagcuucauugaauccccagggaaaggcuaugccauaguggaugagcccuucucagagaucccucgccaaggauuucuaggcgaaauuagaugcaacagcgagaguucuguucucuccgcucaugaaagcugucugagggccccaaaucuuaucucguacaagcccaugauugaccaguuggagugcacuaccaaccugaucgauccguucgugguauuugaacgugggucacucccucagacacggaaugagaaaaccuucgcagcgucuaagggaaaccgaggcguccaggccuuuaguaaagguuccgugcaagcugaccugacuuuaauguucgauaauuuugagguggacuucgucggggccgcaguuagcugugaugcugccuuucugaaccuuacaggaugcuauucuuguaacgcaggcgccagagugugcuugagcauaacguccaccgguacuggcacacucucagcucacaauaaggacgggagucugcauaucguacuaccaagcgaaaacggaaccaaggaucagugccagauucugcacuucacagugcccgaggucgaagaggaauuuauguacucuugugacggcgacgagaggccucuccuggugaaagggacucuuaucgcgauugaucccuucgacgaucgccgggaggccggaggcgaauccaccguugugaauccaaagucagguaguuggaacuuuuucgacugguucagcggguugauguccugguuuggaggcccucugaaaacgaucuuacucauaugccuguaugucgcacuuucuauuggucuguucuuuuugcucaucuaccugggcagaaccgggcuaucgaagauguggcuggcugccaccaaaaaggccagcuga

SEQ ID NO: 11294 - RNA, 3204 nt, Artificial Sequence
  derived and/or modified CDS sequence (opt3) from RVFV__JQ068143.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauugacuccggccagacgaaacgagaacugaagucauuugauaucagucagugcccuaaaauugggggacauggcagcaagaagugcacuggugacgccgcguucuguucugccuacgagugcaccgcacaguaugcuaaugccuacuguucccacgcuaacgggucaggaaucgugcaaauacaggucagcggcguuuggaaaaagccacuuugcgugggcuaugaacguguaguggucaaaagagagcugagugccaagcccauccagaggguggaaccuuguacaacuugcauuaccaaaugugagccacacggguugguugugcggucuacaggauuuaagaucuccagcgcagucgccugcgcuucggguguguguguaaccggcucucaaucccccucaacggagauuacucucaaguacccggggaucagucagagcuccggaggcgauauagguguucauauggcgcacgacgaucagucugugagcucaaaaauugucgcacauugcccuccccaggacccaugucuggugcacgggugcaucgucugcgcccauggcuuaauuaauuaucaaugucacacagcucugagugccuucgugguuguguucguauuuuccagcgucgcaaucaucugccucgccauucuuuacaaggugcugcgcuguuugaaaauagcuccuaagaaaguucuaaacccccugauguggaucaccgccuucauuagauggguguauaagaagauggucgcaaggguggcggauaauaucaaccagguaaaucgggaaauaggauggauggagggcgggcagcucgcucugggaaacccagcccccauuccucgccacgcaccaaucccgcgauacucuacuuaccuuaugcuguugcucaucauuucauaugccagugcuugcagcgaacugauccaggccuccucuagaauuacaaccuguucgacggagggugugaacaccaaaugcagguuaagcggcacagcacugauacgggcuggguccguuggagccgaagcgugucuaaugcucaagggcgucaaagaggaccaaacuaaguuucugaaaaucaagaccgugucaagugagcuuucuugccgugaaggucagagcuacuggacaggguccuucucacccaaauguuugagcucucgcagaugccaucuggugggcgagugucacgucaauaggugccucuccuggcgggauaacgaaaccagugccgaguuuagcuucguuggagaaucuacuacaaugcgagagaauaagugcuuugagcaguguggcggguggggaugcgguuguuucaacgugaauccuuccugccuguuugugcauaccuaucuucagucaguacgcaaggaagcucugagagucuucaacuguauugacugggugcacaaauugacucucgagaucacggacuuugauggcaguguuagcacaaucgaccugggggcaucguccucuagguucaccaauuggggaagcgugucauuaagucuggaugccgaaggcauuuccgguucuaacagcuuuuccuucauagagucaccagggaagggcuacgcuaucgucgacgagcccuucagcgaaauuccucggcaaggauuucuaggcgagauccgcugcaauagugaaucuuccgugcucagcgcccacgagucgugucugagagcaccaaaccuuauuucauauaaacccaugaucgaucaguuggaaugcacuaccaaucugauagacccguucguuguguuugagagggggucucucccucagacacguaacgauaagaccuucgcggccaguaaaggaaaucggggcguacaggcuuuuuccaaggguagcguccaagccgaccugacuuuaauguucgauaacuuugagguggacuucgugggggcagcugucucuugugaugccgcauuucugaaucuuacaggaugcuacagcuguaacgccggcgcucgaguuugcuuguccaucacgucaaccgguacuggcacacucagugcgcauaacaaggacgggagccugcacauugugcuaccaucugaaaauggaaccaaagaucagugccagauccugcauuucacaguacccgagguggaagaggaauuuauguauuccugugacggcgacgagagaccucuccuggucaaggggacucuuauugccaucgaucccuucgacgauaggcgcgaggcaggaggcgaaucaaccgugguuaacccaaaaagugguagcuggaacuuuuucgacugguucuccggguugaugucuugguuuggaggcccucugaagacgauauuacucauuugccuguacguggcucuuucgaucggucuguucuuuuugcucauuuaccugggccggaccgggcuaagcaaaauguggcuggccgccacaaagaaggcuucauga

SEQ ID NO: 11295 - RNA, 3204 nt, Artificial Sequence
  derived and/or modified CDS sequence (opt3) from RVFV(SA-75)__DQ380189.1__Gn-Gc
auggccagaaucgcuaugaccgugcugcccgcacucgccgucuucgcgcuugcuccuguuguguuugccgaggacccacaccugaggaaucggccgggcaaggggcauaauuacauugauggaaugacacaggaagacgcaacuugcaaacccguaacguaugccggugcuuguagcuccuucgauguguuguuagagaagggcaaauuuccucuguuccaaucuuacgcacaccaucgcacccuacucgaagccguccacgacacaauaaucgcuaaggccgauccacccucaugcgaccugcagagugcgcaugggaacccuuguaugaaagagaaacuugugaugaagacucacugcccaaaugauuaucagagcgcacacuaccugaacaaugacggaaaaauggccuccguuaagugucccccuaaauaugaauugaccgaggauugcaacuuuugucgacagaugacaggcgcuucucucaagaaagguucguacccacugcaagaccuguucugccagucaagcgaggaugacgggaguaagcucaagaccaaaaugaagggagugugugaagucggcgugcaggccuuaaagaagugcgauggccagcuguccacugcacaugagguaguuccguuugcuguguucaaaaauucuaagaaagucuaucuugacaaguuggaccugaagacagaagagaaccuacuccccgauagcuuuguguguuucgagcacaaagggcaauacaagggaaccauggacuccggucagacgaaacgugaacugaagucauuugauauuagucagugcccuaaaaucggcgggcauggaagcaagaagugcacuggcgacgccgcguucuguucugccuacgagugcaccgcacaguaugcuaaugccuacuguucccacgcuaacgguucaggggugguccaaauucagguuagcggaguguggaaaaagccacuuugcguaggcuaugaaagaguggucgugaaaagggagcugagugccaagcccauccagcggguugaaccuuguacaacuugcauaaccaaaugugagccacacggcuuggugguccgcucuacaggguuuaagaucuccagcgcaguggccugcgcuucgggaguauguguuaccgguucucaaucccccucaacggagauuacucucaaguacccgggcaucagucagagcuccgggggagauauuggcgugcauauggcgcacgacgaucagucugucagcucaaaaaucguggcacauugcccuccccaggacccaugucugguccacgguugcauagugugcgcccauggguuaauuaauuaucaaugucacacagcucugagugccuucguugugguauucgucuuuuccagcguggcaaucauuugccucgccauccuuuacaagguucugaaauguuugaagaucgcuccuagaaaagugcuaaacccccugauguggauuaccgucuucauaagguggguguauaagaagaugguagcccggguggcagauaauaucaaccagguuaaucgcgaaauuggcuggauggagggaggccagcucgcgcuggggaacccagcucccaucccucgacacgccccaauaccgagauacucuacuuaccuuaugcuguugcucauugucucauaugcaagugccugcagcgaacugauccaggcuuccucuaggaucacaaccuguucgacggagggagugaacaccaaaugccgguuaagcgguacagcccugauucgugcaggcuccgugggggcugaagccugucuaaugcucaagggagucaaagaggaccaaacuaaguuucugaaaaucaagaccguuucaagugagcuuucuugccgcgaaggccagagcuacuggacagguuccuucucacccaaauguuugagcucuagaaggugccaucuggugggggagugucacgugaaucggugccucuccuggcgagauaacgaaaccagugcggaguuuagcuucguaggcgaaucuacuacaaugcgcgagaauaagugcuuugagcaguguggaggcugggggugcggauguuucaacgucaauccuuccugccuguuugugcauaccuaucuucagucaguuagaaaggaagcccugaggguguucaacuguauugacuggguccacaaauugacucucgagauaacggacuuugaugguagugugagcacaaucgaccugggcgcuucguccucucgguucaccaauugggggagcguuucauuaagucuggaugcagaaggaauuuccggcucuaacagcuuuuccuucaucgagucaccagguaagggguacgccaucguggacgagcccuucagcgaaauuccucgccaaggcuuucuaggagagauaagaugcaauagugaaucuuccguacucagcgcucacgagucgugucugagggccccaaaccuuaucucauauaaacccaugauugaucaguuggaaugcacuaccaaucugaucgacccguucgucguguuugagcguggcucucucccucagacacggaacgauaagaccuucgcagcgaguaaagggaaucgaggagugcaggccuuuuccaagggcagcguccaagcugaccugacuuuaauguucgauaacuuugagguugacuucgugggugccgcaguaucuugugaugcugccuuucugaaucuuacagggugcuacagcuguaacgcaggagccagagugugcuuguccauuacgucaaccggcacugguacacucagugcucauaacaaggacggcagccugcacaucguccuaccaucugaaaaugggaccaaagaucagugccagauacugcauuucacagugcccgagguugaagaggaauuuauguauuccugugacggagacgagaggccucuccuggugaagggcacucuuaucgcgauugaucccuucgacgaucgccgggaggccgggggagaaucaaccgucgugaacccaaaaaguggcagcuggaacuuuuucgacugguucuccgguuugaugucuugguuugggggaccucugaagacgaucuuacucauuugccuguacguugcacuuucgaucggccuguucuuuuugcucauauaccuggguagaaccggccuaagcaaaauguggcuggcugccacaaagaaggccucauga

SEQ ID NO: 11296 - RNA, 3204 nt, Artificial Sequence
  derived and/or modified CDS sequence (opt3) from RVFV(ANK-6087)__DQ380216.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaaacuggacuccggccagaccaagcgagaacuuaaaucauuugauauuagucagugcccuaagaucgggggacauggcagcaagaaaugcacgggugacgccgcguucuguucugccuacgagugcacugcacaguaugcuaaugccuacuguucccacgcuaacgggucaggaauugugcaaauccaggucagcggcguuuggaagaaaccacugugcgugggcuaugaacguguaguggucaagagagaguugagugccaaacccauacagaggguggaaccuuguaccacaugcaucacuaagugugagccacacgggcucguugugcggucuaccggauuuaagauuuccagcgcagucgccugcgcuucggguguguguguaacaggcucucaaucccccucaaccgagaucacgcugaaauacccggggauuagucagagcuccggaggcgauaucgguguucauauggcgcacgacgaucagucugugagcucaaagauagucgcacauugcccuccccaggacccauguuuagugcacgggugcauugucugcgcccauggccugaucaauuaucaaugucacacugcucucagugccuucgugguuguguucguauuuuccagcauugcaaucaucugccuugccauucuguaccgcgucuugaaaugucuaaagauagcuccuagaaaagugcugaacccccucauguggaucacagccuucauuagguggguuuaucggaagaugguggcacgcgucgcggauaauaucaaccaggugaaucgagaaauaggauggauggagggcgggcagcugguacuuggaaacccagcucccauuccuagacacgugccaaucccgagguacucuaccuaccugauguugcuccugaucguuucauaugccagugcaugcagcgaauuaauucaggccuccucucggaucacuacauguucgaccgagggugucaacacgaagugccgucugagcggcaccgcucuaauucgcgccggguccgugggagcagaggcuugucucaugcugaaaggcgugaaggaagaccaaacaaaauuucuuaagauaaaaacugucucaagugaguugucuugcagagaaggucagagcuacuggaccggguccuucucacccaagugucugagcucuaggcggugccaucucguuggcgagugucacgugaaucgaugccuguccuggcgcgauaacgaaacaagugccgaguuuagcuucgugggagaaucuacuaccaugagagagaauaaaugcuuugagcaguguggcggguggggaugcgguuguuucaacguaaauccuuccugccuuuuuguccauacauaucugcagucagugaggaaggaagcguugcggguuuucaacuguaucgacugggugcacaagcucacccuggagauuacugacuuugauggcagugucagcacgaucgacuuaggggccucguccucucgcuucacaaauuggggaagcgugucacugagucuagaugcugaaggcaucuccgguucuaacagcuuuuccuucauugagucaccagggaaaggcuacgcaauaguugacgagcccuucagcgaaaucccuagacaaggauuucucggcgagauuaggugcaauagugaaucuuccgugcugagcgcccacgagucgugucuucgugcuccaaacuugaucucauauaagcccaugauugaucagcuggaaugcucuaccaaucucaucgacccguucguagucuuuaaacgggggagucugccucagacucgaaacgauaagaccuucgccgcauccaaaggaaauagaggcgugcaggcguuuagcaaggguucugugcaagccgacuuaacacugauguucgauaacuuugaggucgacuucguuggggcugccgugagcugugaugcagcuuuucuuaauuugaccggaugcuacuccuguaacgccggcgcaaggguaugccucucaauaacaaguacugguacgggcacccugagcgcccauaacaaggacgggucucuacacaucgugcugccauccgagaauggaacuaaagaucagugccagauucuccauuucacaguccccgaaguggaggaagaguuuauguauucaugugacggcgacgaacgcccucugcuuguucgggggaccuugaucgcuauugaucccuucgacgauagaagggaggcgggaggcgagaguacaguggucaacccaaagagcgguuccuggaacuuuuucgacugguucucugggcugaugucgugguuuggaggcccuuuaaaaacuauccuccugauaugccuuuacguggcccugagcauugguuuguucuuucuccugaucuaccuaggccgcaccgggcugucaaagauguggcucgcagcuacgaaaaaggccuccuga

SEQ ID NO: 11297 - RNA, 3204 nt, Artificial Sequence
  derived and/or modified CDS sequence (opt3) from RVFV(KEN/Kil-006/07)__HM586966.1__Gn-Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcggauggaaacaaauguaugaaggagaaacuugugaugaagacucauugcccuaaugacuaucagagcgcacacuaccugaacaaugauggcaagauggccuccguuaaauguccacccaaguaugaauugaccgaggacugcaacuuuugucgccagaugacaggugcuucucucaaaaaggggucguacccucugcaagaucuguucugccagucaagcgaggacgauggaaguaagcucaaaaccaagaugaaaggcgugugugaagucggcgugcaggccuuaaagaaaugcgacgggcagcuguccacugcacacgagguaguuccauuugcuguguucaaaaauucuaagaaggucuaucuugacaaguuggaucugaaaacagaagagaaccuacucccggacagcuuuguguguuucgagcauaagggacaauacaaagguaccauggauuccggccagacgaagcgagaacugaaaucauuugacauuagucagugccccaagaucgggggacacggcagcaagaaaugcacuggugaugccgcguucuguucugccuacgagugcaccgcacaguaugcuaaugccuacuguucccaugcuaacgggucaggaauugugcaaauccaggucagcggcguuuggaagaaaccucuuugcgugggcuaugaacguguaguggucaagagagagcugagugccaaaccaauacagaggguggaacccuguacaacuugcaucaccaagugugagccucacggguugguugugcggucuacaggauuuaagauuuccagcgcagucgccugcgcuucggguguguguguaaccggcucucaauccccaucaacggagaucacucucaaauaccccgggauuagucagagcuccggaggcgacaucgguguucacauggcgcaugaugaccagucugugagcucaaagauagucgcacacugcccgccucaggaucccugucuggugcaugggugcauugucugcgcccacggcuuaaucaauuaucaaugucauacagcucugagugccuucgugguuauuuucguguuuuccagcaccgcaaucaucugccucgccguacuuuaccgcguccugaaauguuugaagauugcuccaagaaaagugcuaaacccucugauguggauaacugccuucaucagguggguuuauaagaagaugguggcacgggucgcggacaauauuaaccaggugaaucgcgaaaucggauggauggagggcgggcagcucgcucugggaaaccccgccccaauaccccgacacgcaccuauuccaagauacucuacauaccuuaugcuguugcucaucguaucauaugccagugcuugcagcgaacugauccaggccuccucuaggauuaccacguguucgaccgagggugugaacacaaaaugccgguuaagcggcacugcacugauccgugcuggguccguuggagccgaagcgugucuaaugcucaagggcgucaaagaggaucaaaccaaguuucugaaaauuaagacagugucaagugagcuuucuugccgcgaaggucagagcuacuggacuggguccuucucaccgaaauguuugagcucuagaaggugccaccuggugggcgagugucaugucaaucggugccucuccuggcgagacaacgaaaccagugccgaguuuagcuucguuggagaaucuacaaccaugcgcgagaauaagugcuuugagcaguguggcggguggggaugcgguuguuucaacgugaaucccuccugccuguuugugcacacuuaucuucagucaguaagaaaggaagcucugagggucuucaacuguauagacugggugcauaaauugacgcucgagaucacagauuuugacggcaguguuagcaccauugaucugggggcaucguccucucgguucacuaauuggggaagcgugucauuaagucuggacgccgaaggcaucuccgguucuaacagcuuuuccuucaucgagucaccugggaagggcuacgcuauugucgaugagccauucagcgaaauaccccgccaaggauuucuaggcgagaucagaugcaauagugaaucuuccgugcucagcgcccacgagucgugucugagggcaccuaaccuuguuucauauaaaccaaugauugaccaguuggaaugcaccacaaaucugaucgaucccuucgugguauuugagcgugggucucucccgcagacccggaacgacaagacuuucgcggccaguaaaggaaaucgaggcguccaggcuuuuuccaaggguagcgugcaagccgaucugacauuaauguucgacaacuuugagguggauuucgucggggcagcuguuucuugugacgccgcauuucugaaucuuacgggaugcuacagcuguaacgccggcgcuagagugugcuuguccauuaccucaacugguacaggcacccucagugcgcacaacaaggaugggagccugcauaucguacuaccuucugaaaauggaacaaaagaccagugccagauacugcacuucacugugccagaggucgaagaggaauuuauguauuccugugacggcgaugagaggccccuccuggugaaggggacccuuaucgccauugacccuuucgaugaccgccgggaggcaggaggcgaaucaacgguugugaaccccaaaagugguagcuggaacuuuuucgauugguucuccggguugaugucuugguuuggaggcccacugaagaccaucuuacucauuugccuguacgucgcucuuucgaucggucuguucuuuuugcucauauaccugggcagaacagggcuaagcaaaauguggcuggccgccacuaagaaggcuucauga

SEQ ID NO: 11298 - RNA, 3204 nt, Artificial Sequence
  derived and/or modified CDS sequence (opt3) from RVFV(MgH824)__DQ380210.1__Gn-Gc
auggccggcaucgcuaugacagugcugcccgcacucgccgucuucgcgcuugcuccuguuguguuugccgaggacccacaccugagaaacaggccggggaagggauacaauuauauugaugguaugacacaggaagacgcaacuugcaaacccguaacguacgccggcgcuuguagcuccuucgauguguuguuagagaaggggaaauuuccucuguuccaaucuuaugcacaucaccggacccuacucgaagccguccaugacacaauaaucgcuaaggccgauccacccucaugcgaccugcagagugcgcacggaaacccuuguaugaaagagaaacuugugaugaagacucauugcccaaaugauuaccagagcgcacacuaucugaacaaugacggcaaaauggccuccguuaagugucccccuaaauacgaauugaccgaggauugcaacuuuugucgccagaugacaggugcuucucucaagaaagggucguauccacugcaagaccuguucugccagucaagcgaggaugacggaaguaagcucaagaccaaaaugaagggcgugugugaagucggcgugcaggccuuaaagaagugcgaugggcagcuguccacugcacacgagguaguuccguuugcuguguucaaaaauucuaagaaagucuaccuugacaaguuggaccugaagacagaagagaaccuacuccccgauagcuuuguguguuucgagcgaaaaggacaauacaaggguaccauggacuccggccagacgaaacgugaacugaagucauuugauauuagucagugcccuaaaaucgggggacauggcagcaagaagugcacuggugacgccgcguucuguucugccuaugagugcaccacacaguacgcaaaugcuuauuguucccacgccaacgggucaggagugguccaaauucagguuagcggcguguggaaaaagccacuuugcguaggcuacgaaagaguggucgugaaaagggagcugagugcuaagcccauccagcggguugaaccuuguacuaccugcauaacaaaaugugagccacauggguuggugguccgcucuaccggauuuaagaucuccagcgccguggcaugcgccucggguguauguguuacgggcucucaaucccccucaacugagauuacacucaaguauccggggaucagucagagcuccggaggcgauauuggugugcacauggcucacgacgaucagucugucagcucaaaaaucguggcgcauugcccuccccaggacccaugucugguccacgggugcauagugugcgcacauggcuuaauuaauuaccaaugucacaccgcccugagugcuuucguugugguauucgucuuuuccagcaucgccauuaucugccucgcaauccuuuauagagugcugaaguguuugaaaauugccccuaggaagguucuaaacccccugauguggauaacugcuuucauccgguggauuuacaaaaagaugguggcccgcgucgcagauaauaucaaccaggugaaucgagaaauaggauggauggagggcgggcagcucguacugggaaacccagcgcccauuccuagacaugcuccaaucccgagguacucuacauaucuuaugcuguugcucaucgugucauacgccagugcaugcagcgaacugauucaggccuccucucggaucaccacguguucgaccgaggguguugacacaaagugccguuuaagcggcacugcucugauucgcgccggguccgucggagcagaggcuugucuaaugcucaaaggcgugaaggaagaucaaaccaaauuucugaagauaaaaacagugucaagugagcuuucuugcagagaaggucagagcuauuggacuggguccuucucacccaaguguuugagcucuaggcggugccaccuggucggcgagugucacguuaaccgaugccucuccuggcgcgacaaugaaaccagugccgaguuuagcuucgugggagaaucuacaaccaugagagagaacaaaugcuuugagcaguguggcggguggggaugcgguuguuucaaugugaacccuuccugccuguuuguacauacuuaccuucagucagucaggaaggaagcgcugcggguguucaauuguaucgacuggguucacaaguugacgcucgagauuacagauuuugacggcagugugagcaccaucgaucugggggccucguccucucgcuucacuaacuggggaagcgucucauuaagucuggacgcugaaggcaucuccgguucuaauagcuuuuccuucauugagucaccagggaaaggcuaugcaauaguggaugagcccuucccugaaaucccaagacaaggauuucuaggcgagauuaggugcaacagcgaaaguucuguucucuccgcccaugagagcugucugcgugcucccaaucuuaucucguacaagccgaugauugaccaguuggaaugcaccacaaaccugaucgauccuuucgugguauuugagcgggggucacucccacagacccgaaaugacaaaacuuucgccgcaucuaagggaaacagaggcguccaggcguuuaguaaagguuccgugcaagccgaucugacauuaauguucgacaauuuugagguggauuucgucggggcugccguuagcugugacgcagcuuuucugaaccuuacgggaugcuauucuuguaaugccggcgcaagggugugcuugagcauaaccuccacugguacaggcucacucagugcccacaacaaggaugggagccugcacaucguacuacccucugaaaacggaaccaaggaccagugccagauucugcauuucacagugccugaggucgaagaggaauuuauguacuccugugacggcgaugagcgcccccuccuggugaaagggacucuuaucgcuauugacccauucgaugaccggagagaggcgggaggcgaaucaaccguugugaauccuaagagugguagcuggaacuuuuucgauugguucuccggguugaugucuugguuuggaggcccccugaaaacgaucuuacucauaugccuguacgucgcccuuucgauuggucuguucuuuuugcucaucuaucugggcaggaccgggcuaagcaagauguggcuggcagcuaccaaaaaggccucauga

SEQ ID NO: 11299 - RNA, 3204 nt, Artificial Sequence
  derived and/or modified CDS sequence (opt3) from RVFV(KEN/Mal-032/07)__HM586967.1__Gn-Gc
auggccggcaucgcuaugaccgugcugcccgcacucgccgucuucgcgcuugcuccuguuguguuugccgaggacccacaccugagaaauaggccggggaagggacauaauuacauugauggucgguugcaggaagacgcaacaugcaaacccguaacuuaugccggcgcuuguagcuccuucgauguguuacuggagaaggggaaauuuccucuauuccaaucuuacgcacaccaucgcacgcuccuggaagccguccacgacaccauaaucgcuaaggccgauccacccucaugcgaccuucagagugcggauggaaacaaauguaugaaggagaagcuggugaugaaaacacauugcccuaaugacuaucagagcgcacacuacuugaacaaugauggcaagauggccuccguuaaauguccacccaaguaugaacucacugaggacugcaacuuuugucgacagaugaccggugcuucucugaaaaaggggucguacccucugcaagaucucuucugccagucaagcgaggacgauggaaguaaguuaaaaacaaagaugaaaggcgugugugaagucggcgugcaggcccugaagaaaugcgacgggcagcuuuccaccgcacacgagguaguuccauuugcuguguucaagaauaguaaaaaggucuauuuggacaagcuggaucuaaaaacugaagagaaccuccugccggacagcuuuguguguuucgagcauaagggacaauacaaagguacaauggauuccggccagaccaagcgugaacuuaaaucauuugacauuagucagugccccaagaucgggggacacggcagcaagaaaugcacgggugaugccgcguucuguucugccuacgagugcacugcacaguaugcuaaugccuacuguucccaugcuaacgggucaggaauugugcaaauccaggucagcggcguuuggaagaaaccucugugcgugggcuaugaaagaguaguggucaagagggaguugagugccaaaccaauacagcggguggaacccuguaccacaugcaucacuaagugugagccucacgggcucguugugcgcucuaccggauuuaagauuuccagcgcagucgccugcgcuucggguguguguguaacaggcucucaauccccaucaaccgagaucacgcugaaauaccccgggauuagucagagcuccggaggcgacaucgguguucacauggcgcaugaugaccagucugugagcucaaagauagucgcacacugcccgccucaggaucccuguuuagugcaugggugcauugucugcgcccacggccugaucaauuaucaaugucauacugcucucagugccuucgugguuauuuucguguuuuccagcacagcaaucaucugccuugccguacuguacagagucuugaaaugucuaaagauugcuccaaggaaagugcugaacccucucauguggauaaccgccuucauccgguggguuuauaagaagaugguggcacgcgucgcggacaauauuaaccaggugaaucgagaaaucggauggauggagggcgggcagcuggcucuuggaaaccccgccccaauacccagacacgcaccuauuccaagguacucuacuuaccugauguugcuccugaucguaucauaugccagugcuugcagcgaauuaauccaggccuccucucggauuacaaccuguucgacggagggugugaacaccaaaugccgucugagcggcacagcacuaauccgcgcuggguccguuggagccgaagcgugucucaugcugaagggcgucaaagaggaucaaacuaaguuucuuaaaauuaagaccgugucaagugaguugucuugcagagaaggucagagcuacuggacaggguccuucucaccgaaaugucugagcucuaggcggugccaccucgugggcgagugucaugucaaucgaugccuguccuggcgcgacaacgaaacuucugccgaguuuagcuucguuggagaaucuaccacaaugagagagaauaagugcuuugagcaguguggcggguggggaugcgguuguuucaacgugaaucccuccugccuuuuugugcacaccuaucugcagucaguaaggaaggaggcuuugcgggucuucaacuguauagacugggugcauaaacucacucuggaaaucacggauuuugacggcaguguuagcacaauugauuuaggggcaucguccucucgcuucaccaauuggggaagcgugucacugagucuagacgccgaaggcaucuccgguucuaacagcuuuuccuucaucgagucaccugggaagggcuacgcuauugucgaugagccauucagcgaaauacccagacaaggauuucucggcgagaucaggugcaauagugaaucuuccgugcugagcgcccacgagucgugucuucgugcaccuaacuugguuucauauaaaccaaugauugaccagcuggaaugcacuaccaaucucaucgaucccuucgugguauuugagcgggggucucugccgcagacacgaaacgacaagaccuucgcggccaguaaaggaaauagaggcguccaggcuuuuuccaaggguagcgugcaagccgauuuaacucugauguucgacaacuuugagguggauuucgucggggcagcuguuucuugugacgccgcauuucuuaauuugacaggaugcuacagcuguaacgccggcgcuagggugugccucuccauuacgucaaccgguacuggcacacugagugcgcacaacaaggaugggagccuacauaucguacugccuucugaaaauggaaccaaagaccagugccagauacuccacuucacagugccagaggucgaagaggaauuuauguauuccugugacggcgaugagcgcccccugcuugugaaggggacuuugaucgccauugacccuuucgaugaccggagagaggcaggaggcgaaucaaccguugugaaccccaaaagugguagcuggaacuuuuucgauugguucuccgggcugaugucuugguuuggaggcccauuaaagacgauccuccugauuugccuuuacgucgcucugucgaucgguuuguucuuucuccugauauaccuaggcaggaccgggcugagcaaaauguggcucgccgccacaaagaaggcuucauga

SEQ ID NO: 11300 - RNA, 3204 nt, Artificial Sequence
  derived and/or modified CDS sequence (opt3) from RVFV(Kenya 56 (IB8))__DQ380190.1__Gn-Gc
auggccggcaucgcuaugaccgugcugcccgcacucgccgucuucgcgcuugcuccuguuguguuugccgaggacccacaccugagaaacaggccggggaagggacauaauuacauugaugguaugacacagggcgacgcaacuugcaaacccguaacguaugccggggcuuguagcuccuucgauguguuguuagaaaagggaaaauuuccucuguuccaaucuuacgcacaccaucggacccuacucgaggccguccacgacacaauaaucgcuaaggccgauccacccucaugcgaccugcagagugcgcauggcaacccuuguaugaaagaaaaacuugugaugaagacucacugcccaaaggauuaucagagcgcacacuaccugaauaacgacgguaagauggccuccguuaaaugucccccuaaguaugaguugaccgaagauugcaauuuuugucgccagaugacaggggcuucucucaaaaagggaucguacccacugcaagaccuguucugccagucaagcgaggaugacggcaguaagcucaaaaccaagaugaaaggcgugugugaggucggggugcaggccuuaaagaaaugcgauggacagcuguccacugcacaugaaguaguuccguuugcuguguucaagaacucuaaaaaggucuaucuugacaaguuggaccugaaaacagaggaaaaucuacuccccgauagcuuuguguguuucgagcacaagggucaauacaaaggcaccauggacuccgggcagacgaagcgagagcugaaaucauuugauauuagucagugcccuaagaucggaggccaugguagcaagaaaugcacuggggacgccgcguucuguucugccuacgaaugcaccgcacaguaugcuaacgccuacuguucccacgcuaauggaucaggcauugugcaaauccaggucagcggcguuuggaagcguccacuuugcgugggguaugagagaguaguggucaaaagggaacugagugccaagcccauacagcggguggagccuuguacaacuugcaucaccaaaugugaaccacacggauugguugugcgcucuacagguuuuaagauuuccagcgcagucgccugcgcuucgggcguguguguaaccgggucucaaucccccucaacggagaucacucucaaguacccgggaaugagucagagcuccggcggugauauugggguucauauggcgcacgacgaucagucugugagcucaaaaaucgucgcacauugcccuccccaggacccaugucuggugcacggcugcauagucugcgcccauggauuaauuaacuaucaaugucacacagcucugagugccuucgugguuguguucguauuuuccagcgucgcaaucauuugccucgccauccuuuacaaggugcugaaauguuugaagaucgcuccuagaaaaguucuaaauccccugauguggauuaccgccuucauaagguggguguauaagaagauggucgcacggguggcggauaacaucaaucagguaaaccgcgagauuggcuggauggaagggggacagccagcucucgguaaucccgccccuaucccacgacacgcaccgauacccagauacucuacuuaccugaugcuucuguugauugugucauaugccagugcuugcagcgagcucauccaggccuccucuaggaucacaaccuguucgacggaaggcguuaacaccaaaugccggcugagcgggacagcauuaauucgugcuggauccgucggcgccgaggcgugucugaugcuaaagggugugaaagaagaccaaacuaaguuucucaaaaucaagaccgugucaagugagcugucuugccgcgaggggcagagcuacuggacaggcuccuucucaccuaaaugucuuagcucuagaaggugccauuuggucggagaaugucacguuaaccggugccuguccuggcgagauaaugagaccagugccgaauuuagcuucgugggcgagucuacuacaaugcgcgaaaacaagugcuuugagcagugugggggaugggguugcggcuguuucaaugugaacccauccugccucuuuguacauaccuaucugcagucagucagaaaggaggcucuuaggguguucaauuguauugacuggguucacaaacugacuuuggaaauaacggacuuugaugggagugugagcacaaucgaccucggagcaucguccucucgguucaccaacuggggcagcgucucacugaguuuagaugccgaggguauuuccgggucuaauagcuuuuccuucaucgaaucacccggcaagggauacgcuaucguggacgagccuuucagcgagauuccacgccaaggcuuucugggggaaauaagaugcaacagugagucuuccguucuaagcgcccacgaaucgugucucagggcacccaaucugaucucauauaaaccgaugauugaucagcuugagugcacuaccaacuugaucgacccuuucguggcguuugaacguggaucucugccacagacacggaaugauaagaccuucgccgcuaguaaaggcaaccgagguguacaggccuuuuccaaggggagcguccaagcagaccucacucugauguucgauaauuuugagguggacuucgugggagcugccgucucuugugaugcagccuuuuuaaaccugacaggcugcuacagcuguaaugcuggugcgagaguuugccuuuccauuacgucaaccggcacugggacauugagugcccauaacaaggacggaagccuccacaucgugcugcccucugagaacggcaccaaagaucagugccagauacuacauuucacaguaccugaaguggaggaagaguuuauguauuccugugacggggacgaaaggccccugcucgucaagggaacucugaucgcaauugauccauucgacgaucgccgggaggcuggcggugagucaaccgugguuaauccuaaaagugggagcuggaacuuuuucgacugguucuccggacuuaugucuugguuuggcggucccuugaagacgauccuguuaauuugccucuacguggcccugucgaucggccuuuucuuucuguugauauaccucgggagaaccggacugagcaaaauguggcuagccgcuacaaagaaggcaucauga

SEQ ID NO: 11301 - RNA, 3204 nt, Artificial Sequence
  derived and/or modified CDS sequence (opt3) from RVFV(KEN/Gar-008/06)__HM586965.1__Gn-Gc
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagccguguuuggaaaaagccacuuugcgugggcuaugaaagaguaguggucaaaagggagcugagugccaagcccauacagcggguggaaccuuguacaacuugcaucaccaaaugugagccacacggcuugguugugcgcucuacaggguuuaagauuuccagcgcagucgccugcgcuucgggaguguguguaaccgguucucaaucccccucaacggagaucacucucaaguacccgggcauuagucagagcuccgggggagauaucggcguucauauggcgcacgacgaucagucugugagcucaaaaauagucgcacauugcccuccccaggacccaugucuggugcacgguugcauugucugcgcccauggguuaaucaauuaucaaugucacacagcucugagugccuucgugguuauuuucguguuuuccagcaccgcaaucaucugccucgccguacuuuacagaguccugaaguguuugaaaauugcuccuaggaaggugcuaaacccccugauguggauaacugccuucauccgguggguuuauaaaaagaugguggcacgcgucgcggauaauauuaaccaggugaaucgagaaaucggcuggauggagggaggccagcucgcucuggggaacccagcccccauaccuagacacgcaccaauuccgagguacucuacauaccuuaugcuguugcucaucguaucauaugccagugcuugcagcgaacugauccaggccuccucucggauuaccacguguucgaccgagggagugaacacaaagugccguuuaagcgguacugcacugauccgcgcuggcuccguuggggccgaagcgugucuaaugcucaaaggagucaaggaggaccaaaccaaauuucugaagauuaaaacagugucaagugagcuuucuugcagagaaggccagagcuacuggacugguuccuucucacccaaguguuugagcucuaggcggugccaucuggugggggagugucacgucaaucgaugccucuccuggcgcgauaacgaaaccagugccgaguuuagcuucguuggcgaaucuacaaccaugagagagaauaaaugcuuugagcaguguggaggcugggggugcggauguuucaacgugaauccuuccugccuguuugugcauacuuaucuucagucaguaaggaaggaagcucugcgggucuucaacuguauagacugggugcacaaguugacgcucgagaucacagacuuugaugguaguguuagcaccauugaccugggcgcaucguccucucgcuucacuaauugggggagcgugucauuaagucuggaugccgaaggaaucuccggcucuaacagcuuuuccuucaucgagucaccagguaaaggguacgcuauugucgacgagcccuucagcgaaauaccuagacaaggcuuucuaggagagaucaggugcaauagugaaucuuccgugcucagcgcccacgagucgugucugcgugcaccaaaccuuguuucauauaagcccaugauugaucaguuggaaugcaccacaaaucugaucgacccguucgugguauuugagcggggcucucucccucagacccgaaacgauaaaacuuucgcggccaguaaggggaauagaggaguccaggcuuuuuccaaaggcagcgugcaagccgaccugacauuaauguucgauaaccugaagguggacuuugucggugcagcuguuucuugugaugccgcauuccuuaauuugacggggugcuacagcuguaacgccggagcuagggugugccucuccauuaccucaacuggcacagguacccugagugcgcauaacaaggacggcagccuacacaucguacugccaucugagaaugggacaaaagaucagugccagauacuccauuuuacugugcccgaagucaaggaggaguucauguauuccugugacggagacgaacgcgcccugcuuaugaaaggcaccuugaucgcaauugauccuuuugacgaucggagagaagcugggggagagucaacggugguuaaccccaagaguggcagcuggaauuucuuugacugguucuccggucugaugucuugguucgggggaccauuaaaaaccauccuccugauuugccuuuacguggcccugucgaucggcuuguuuuuccuccugauauaccuagguaggacaggccugagcaagauguggcucgccgcuacuaagaaagcaucauga

SEQ ID NO: 11302 - RNA, 3204 nt, Artificial Sequence
  derived and/or modified CDS sequence (opt3) from RVFV(KEN/Bar-035/07)__HM586969.1__Gn-Gc
auggccggcaucgcuaugaccgugcugcccgcacucgccgucuucgcgcuugcuccuguuguguuugccgaggacccacaccugagaaauaggccggggaagggacauaauuacauugauggucgguugcaggaagacgcaacaugcaaacccguaacuuaugccggcgcuuguagcuccuucgauguguuacuggagaaggggaaauuuccucuauuccaaucuuacgcacaccaucgcacgcuccuggaagccguccacgacaccauaaucgcuaaggccgauccacccucaugcgaccuucagagugcggauggaaacaaauguaugaaggagaagcuggugaugaaaacacauugcccuaaugacuaucagagcgcacacuacuugaacaaugauggcaagauggccuccguuaaauguccacccaaguaugaacucacugaggacugcaacuuuugucgacagaugaccggugcuucucugaaaaaggggucguacccucugcaagaucucuucugccagucaagcgaggacgauggaaguaaguuaaaaacaaagaugaaaggcgugugugaagucggcgugcaggcccugaagaaaugcgacgggcagcuuuccaccgcacacgagguaguuccauuugcuguguucaagaauaguaaaaaggucuauuuggacaagcuggaucuaaaaacugaagagaaccuccugccggacagcuuuguguguuucgagcauaagggacaauacaaagguacaauggauuccggccagaccaagcgugaacuuaaaucauuugacauuagucagugccccaagaucgggggacacggcagcaagaaaugcacgggugaugccgcguucuguucugccuacgagugcacugcacaguaugcuaaugccuacuguucccaugcuaacgggucaggaauugugcaaauccaggucagcggcguuuggaagaaaccucugugcgugggcuaugaaagaguaguggucaagagggaguugagugccaaaccaauacagcggguggaacccuguaccacaugcaucacuaagugugagccucacgggcucguugugcgcucuaccggauuuaagauuuccagcgcagucgccugcgcuucggguguguguguaacaggcucucaauccccaucaaccgagaucacgcugaaauaccccgggauuagucagagcuccggaggcgacaucgguguucacauggcgcaugaugaccagucugugagcucaaagauagucgcacacugcccgccucaggaucccuguuuagugcaugggugcauugucugcgcccacggccugaucaauuaucaaugucauacugcucucagugccuucgugguuauuuucguguuuuccagcacagcaaucaucugccuugccguacuguacagagucuugaaaugucuaaagauugcuccaaggaaagugcugaacccucucauguggauaaccgccuucauccgguggguuuauaagaagaugguggcacgcgucgcggacaauauuaaccaggugaaucgagaaaucggauggauggagggcgggcagcuggcucuuggaaaccccgccccaauacccagacacgcaccuauuccaagguacucuacuuaccugauguugcuccugaucguaucauaugccagugcuugcagcgaauuaauccaggccuccucucggauuacaaccuguucgacggagggugugaacaccaaaugccgucugagcggcacagcacuaauccgcgcuagauccguuggggccgaagcgugucucaugcugaagggagucaaagaggaucaaacuaaguuucuuaaaauuaagaccgugucaagugaguugucuugcagggaaggccagagcuacuggacagguuccuucucaccgaaaugucugagcucucggcgaugccaccucgugggggagugucaugucaaucgcugccuguccuggagagacaacgaaacuucugccgaguuuagcuucguuggcgaaucuaccacaaugagggagaauaagugcuuugagcaguguggaggcugggggugcggauguuucaacgugaaucccuccugccuuuuugugcacaccuaucugcagucaguacggaaggaggcuuugcgcgucuucaacuguauagacugggugcauaaacucacucuggaaaucacggauuuugacgguaguguuagcacaauugauuuaggcgcaucguccucuagauucaccaauugggggagcgugucacugagucuagacgccgaaggaaucuccggcucuaacagcuuuuccuucaucgagucaccugguaagggguacgcuauugucgaugagccauucagcgaaauacccaggcaaggcuuucucggagagauccguugcaauagugaaucuuccgugcugagcgcccacgagucgugucuucgggcaccuaacuugguuucauauaaaccaaugauugaccagcuggaaugcacuaccaaucucaucgaucccuucgugguauuugagcgaggcucucugccgcagacaagaaacgacaagaccuucgcggccaguaaagggaauaggggaguccaggcuuuuuccaagggcagcgugcaagccgauuuaacucugauguucgacaacuuugagguggauuucgucggugcagcuguuucuugugacgccgcauuucuuaauuugacagggugcuacagcuguaacgccggagcucgcgugugccucuccauuacgucaaccggcacugguacacugagugcgcacaacaaggauggcagccuacauaucguacugccuucugaaaaugggaccaaagaccagugccagauacuccacuucacagugccagaggucgaagaggaauuuauguauuccugugacggagaugagcggccccugcuugugaagggcacuuugaucgccauugacccuuucgaugacagaagggaggcagggggagaaucaaccguugugaaccccaaaaguggcagcuggaacuuuuucgauugguucuccggucugaugucuugguuugggggaccauuaaagacgauccuccugauuugccuuuacgucgcucugucgaucggcuuguucuuucuccugauauaccuaggucgcaccggccugagcaaaauguggcucgccgccacaaagaaggcuucauga

SEQ ID NO: 11303 - RNA, 3204 nt, Artificial Sequence
  derived and/or modified CDS sequence (opt3) from RVFV(Smithburn)__DQ380193.1__Gn-Gc
auggccggcaucgcuaugaccguguuccccgcacuggucguuuuugcccucgcgccugugguauucgcugaggacccacaccuuagaaacaggccggggaagggacauaauuacauugaugguaugacacaggaagacgccacuugcaaacccgugacguaugcaggcgccuguagcuccuuugauguccuguuggagaaggggaaauucccuuuauuucaaucuuacgcucaccaucggacccugcuagaagcagugcacgacauaaucauugccaaggcugauccacccucaugcaaccuccagagugcccauggaaauccuuguaugaaagagaagcugguuaugaagacauauugcccaaacgacuaccagagcgcgcacuaucuuaauaacgauggcaaaauggcauccgugaagugucccccuaaacacgaacugacugaggacugcaauuucugucgccagaugaccggugccucuuugaaggaggggucguacccacuccaagaucuguuuugccagucaagcgaagacgauggaaguaaacugaagacaaagaugaaaggcgucugugaggugggcguacagguucucaagaaaugcgacgggcaguuauccaccgcucaugaaguggucccguucgccguguuuaagaacucuaaaaagguguaucuggauaaacuugacuugaagacugaggagaaucugcuacccgacagcuucgucuguuuugaacacaagggacaauacaaagguacaauggauuccggccagaucaagcgagagcucaaaucauucgacauuagucagugcccuaagaucgggggacauggcagcaaaaagugcaccggugaugcagcuuuuuguucugccuacgaaugcacggcgcaguaugccaacgcauacuguucccacgcuaaugggucaggaauaguucaaauccaggugagcggcguauggaagaaaccacugugcgugggcuaugagcgugucgugguuaagagagaacuuagugccaaacccauucagaggguggagccuuguacuaccugcaucacaaagugugagccacacgggcuggucgugcggucuacuggauucaaaauuuccagcgcuguagccugcgcaucggguguuugugugaccggcucucaaucccccucaacagaaaucaccuugaaguacccggggauaagucagagcuccggaggcgacauugguguccauauggcccacgaugaccagucugugagcucaaagaucgucgcucauugcccuccccaggauccaugucucgugcacgggugcauuguuugcgcgcauggccugaucaacuaucaaugucacacggcauucagugccuuugugguagucuucguguuuuccagcguugugaucauuugcuuagcuauacuguacaaaguccucaagugucuuaaaaucgccccucgcaaggugcugaaucccuugauguggauuacugcauucaucagauggguauauaaaaagaugguggccaggguugcugacaacauaaaucaggucaaccgggagauuggauggauggaaggcgggcagcuagugcugggaaacccagcccccaucccucgccacgcaccaaucccgcgauacucuacauaccucaugcugcuucugauugugucauaugcgagugcuugcagcgaguugauccaggccuccucuagaauuaccacuuguucgacagaaggugucaauaccaagugcaggcucagcggcacggcacugauacgggccggguccguuggagcugaggccuguuuaaugcugaaaggcgugaaggaggaucaaaccaaauuucuaaagaucaaaacagugucaagugaacucucuugccgugagggucagagcuacuggacuggguccuucucacccaagugucugagcucucgcagaugccaucuuguaggcgaaugucacgucaacaggugcuuguccuggcgggacaaugagaccagugcagaauuuagcuucgugggagagucuacaacuaugcgagagaacaaaugcuuugaacaguguggcggguggggaugcgguuguuucaauguuaacccuuccugccuguuugugcauaccuaucuccagucaguccgcaaggaggcucugagaguguucaauuguauugauuggguucacaaacuuacacuggaaaucaccgacuuugacggcagugugagcacuguagauuugggggccucguccucuagguucacgaacuggggaagcgucucacucagucuggacgcggagggcaucuccgguucuaauagcuucuccuuuauugagucaccagggaagggcuacgccauaguggaugaacccuucagcgagaucccucggcaaggauuuuuaggcgaaauucgcugcaacagugagucuuccgugcugagcgcucacgaaucgugucuaagagcaccaaaucucaucucauauaagcccaugauugaccagcuggagugcacaaccaaccuuaucgauccguucgucguuuuugagagggggucuuugccucagacucguaaugacaaaaccuucgccgcuaguaagggaaaccggggcgugcaggccuuuuccaaagguagcguacaagcagaucugacacucauguucgacaauuuugaaguggauuucgucggggcggccgugucuugugacgcugccuuucugaacuuaaccggaugcuacagcuguaacgcaggcgcucgaguuugccuguccauaacuucaacagguacgggcacccuuagugcccauaauaaggaugggagcuugcacaucgugcucccaucugagaacggaacuaaggaccagugccagauucugcauuucacaguccccgaaguggaggaagaguuuauguauuccugugauggcgacgagagaccucuacugguuaaagggacccucaucgcaauugaccccuucgaugacaggcgcgaagccggaggcgagucaacaguggucaauccaaagagugguagcuggaacuucuuugauugguucuccgggcugaugucuugguuuggaggcccucuuaaaacuaucuugcugauaugcuuauacguagcucucucgauuggucuguucuuuuuccuuaucuaccugggccggaccggguugagcaagauguggcucgcggccacgaaaaaggcaucauga

SEQ ID NO: 11304 - RNA, 3204 nt, Artificial Sequence
  derived and/or modified CDS sequence (opt3) from RVFV(Beijing-01)__KX611606.1__Gn-Gc
auggccggcaucgcuaugaccgugcugcccgcacucgccgucuucgcgcuugcuccuguuguguuugccgaggacccacaccugagaaacaggccggggaagggacauaauuacauugaugguguaacacaggaagacgcaacuugcaaacccgugacguaugccggcgcuuguagcuccuucgaugucuuguuagagaaggggaaauuuccucuguuccaaucuuacgcacaccaucggacccuacucgaagccgugcacgacacaauaaucgcuaaggccgauccacccucaugcgaccugcagagugcgcauggaaacccuuguaugaaagagaaacuuguuaugaagacucacugcccaaaugauuaucagagcgcacacuaccugaacaaugacggcaaaauggccuccgugaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgucugugaagugggcguacaggccuuaaagaagugcgaugggcgacuguccacugcacaugagguugugccguuugcugucuucaaaaauucuaagaaaguguaucuugacaaguuggaccugaagacagaagagaaccuacuccccgauagcuuuguguguuucgagcacaaaggacaguacaaggguaccauggacuccggccaaacgaaacgugaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauuguccagauccaaguuagcggcguguggaaaaagccacuuugcguaggcuaugaaagaguggucgugaaaagggagcugagugccaagcccauacagcggguugaaccuuguacaacuugcaucaccaaaugugagccacacggguuggugguccgcucuacaggauuuaagauuuccagcgcaguggccugcgcuucggguguauguguuaccggcucucagucccccucaacggagaucacucucaaguacccggggauuagucaaagcuccggaggcgauaucggugugcauauggcgcacgacgaucagucugucagcucaaaaauaguguucgacugcccuccccaggauccaugucugguccaugggugcauugugugcgcacacggcuuaaucaauuaucagugucauacagcccugagugcuuucguugugguauuugucuucuccagcguggccauuaucugccucgcaauccuuuacaagguucugagauguuugaaaauugccccuaagaaagugcuaaacccccugauguggauaaccgcuuuuaucaggugggucuauaagaagaugguggcccggguagcagacaauauuaaccaagugaaucgcgaaaucggauggauggagggcgggcagcucgcgcugggaaacccagcucccauaccucgacacgccccaauuccgagauacucuacuuaccuuaugcuguugcucaucaucucauaugcaagugccugcagcgaacugauucaggcuuccucuaggaucacaaccuguucgacggaggguguuaacaccaaaugccgguuaagcggcacagcccugauucgugcaggguccgucggagcugaagccugucuaauguucgagggcgugaaggaggaucagacuaaauuucucaagauaaaaaccgugucaagugaacugucuugccgcgagggucaaagcuacuggacaggguccuucucacccaagugucuuagcucuagaaggugccacuuggucggcgaaugucauguuaaucggugccuguccuggcgagacaacgagacaagugcggaauuuagcuucgugggagagucuaccacaaugcgcgagaauaaaugcuuugaacaguguggcggguggggaugcgguuguuucaacgugaauccuuccugccucuuuguacacaccuaucugcagucagucagaaaggaggcccuuaggguguucaacuguaucgacuggguucauaagcugacuuuggaaauuacggauuuugacggcagugugagcacaaucgaucucggggcuucguccucucgguucaccaauuggggaagcgucucacugaguuuagacgcagagggcaucuccgguucuaacagcuucuccuuuauugagucaccagggaaaggcuacgccauaguggaugaacccuucagcgagaucccucgccagggauuucugggcgaaauuagaugcaauagugagucuuccguucuaagcgcucacgaaucgugucucagggccccaaaccugaucucauauaagcccaugauugaccaacuugagugcacuaccaauuugaucgauccguucgugguauuugagcgugggucucugccucagacacggaacgacaaaaccuucgcagcgaguaagggaaaucgaggcguccaggccuuuuccaaagguagcgugcaggcugaucucacucugauguucgacaacuuugaaguggauuucgucggggccgcaguuucuugugacgcugccuuuuuaaaucugacaggaugcuacagcuguaacgcaggcgccagagugugccuuuccauaacgucaaccgguacuggcacauugagugcucacaacaaggaugggagccuccauaucguacugccaucugagaauggaaccaaggaccaaugccagauucuacacuucacagugcccgaagucgaggaagaguuuauguauuccugugacggcgaugagaggccucugcucgugaaagggacucugaucgcgauugaccccuucgaugaccgccgggaagccggaggcgagucaaccguugugaacccaaagagugguagcuggaauuucuuugauugguucuccgggcuuaugucuugguuuggaggcccuuugaaaacgauccuguuaauaugccucuacgucgcacugucgauuggucuuuucuuucuguugaucuaccucggcagaaccgggcugagcaagauguggcuagcugccacuaaaaaggccucauga

SEQ ID NO: 11305 - RNA, 3204 nt, Artificial Sequence
  derived and/or modified CDS sequence (opt3) from RVFV(KEN/Bar-032/07)__HM586968.1__Gn-Gc
auggccggcaucgcuaugaccgugcugcccgcacucgccgucuucgcgcuugcuccuguuguguuugccgaggacccacaccugagaaauaggccggggaagggacauaauuacauugauggucgguugcaggaagacgcaacaugcaaacccguaacuuaugccggcgcuuguagcuccuucgauguguuacuggagaaggggaaauuuccucuauuccaaucuuacgcacaccaucgcacgcuccuggaagccguccacgacaccauaaucgcuaaggccgauccacccucaugcgaccuucagagugcggauggaaacaaauguaugaaggagaagcuggugaugaaaacacauugcccuaaugacuaucagagcgcacacuacuugaacaaugauggcaagauggccuccguuaaauguccacccaaguaugaacucacugaggacugcaacuuuugucgacagaugaccggugcuucucugaaaaaggggucguacccucugcaagaucucuucugccagucaagcgaggacgauggaaguaaguuaaaaacaaagaugaaaggcgugugugaagucggcgugcaggcccugaagaaaugcgacgggcagcuuuccaccgcacacgagguaguuccauuugcuguguucaagaauaguaaaaaggucuauuuggacaagcuggaucuaaaaacugaagagaaccuccugccggacagcuuuguguguuucgagcauaagggacaauacaaagguacaauggauuccggccagaccaagcgugaacuuaaaucauuugacauuagucagugccccaagaucgggggacacggcagcaagaaaugcacgggugaugccgcguucuguucugccuacgagugcacugcacaguaugcuaaugccuacuguucccaugcuaacgggucaggaauugugcaaauccaggucagcggcguuuggaagaaaccucugugcgugggcuaugaaagaguaguggucaagagggaguugagugccaaaccaauacagcggguggaacccuguaccacaugcaucacuaagugugagccucacgggcucguugugcgcucuaccggauuuaagauuuccagcgcagucgccugcgcuucggguguguguguaacaggcucucaauccccaucaaccgagaucacgcugaaauaccccgggauuagucagagcuccguuggagacaucggcgugcacauggcgcaugaugaccagucugucagcucaaagauaguggcacacugcccgccucaggaucccuguuuaguccaugguugcauugugugcgcccacgggcugaucaauuaucaaugucauacugcucucagugccuucguugugauuuucguauuuuccagcacagcaaucaucugccuugccguccuguacagaguguugaaaugucuaaagauugcuccaaggaaaguucugaacccucucauguggauaaccgccuucauccgguggguguauaagaagauggucgcacgcguggcggacaauauuaaccagguaaaucgagaaaucggcuggauggagggaggccagcuggcucuugggaaccccgccccaauacccagacacgcaccuauuccaagguacucuacuuaccugauguugcuccugaucgugucauaugccagugcuugcagcgaauuaauccaggccuccucucggauuacaaccuguucgacggagggaguuaacaccaaaugccgucugagccacacagcacuaauccgcgcugguuccgucggcgccgaagcgugucucaugcugaagggggugaaagaggaucaaacuaaguuucuuaaaauuaagaccgugucaagugaguugucuugcagagaaggacagagcuacuggacaggcuccuucucaccgaaaugucugagcucuaggcggugccaucucgucggugagugucacguuaaucgaugccuguccuggcgcgacaacgaaacuucugccgaguuuagcuucgugggggaaucuaccacaaugagagagaauaagugcuuugagcaguguggcggauggggcugcggguguuucaacgugaaucccuccugccuuuuuguacauaccuaucugcagucagucaggaaggaggcuuugcggguguucaacuguauagacuggguucacaaacucacucuggaaaucacggauuuugacggaagugugagcacaauugauuuaggugcaucguccucucgcuucaccaauuggggcagcgucucacugagucuagacgccgaagggaucuccggaucuaacagcuuuuccuucaucgagucaccuggcaaggguuacgcuauuguggaugagccauucagcgaaauacccagacaaggguuucucggcgagaucaggugcaauagugaaucuuccguucugagcgcccacgagucgugucuucgugcaccuaacuuggugucauauaaaccaaugauugaccagcuggaaugcacuaccaaucucaucgaucccuucguagucuuugagcggggaucucugccgcagacacgaaacgacaagaccuucgcggccaguaaaggcaauagaggggugcaggcuuuuuccaagggaagcgugcaagccgauuuaacucugagguucgacaacuuugaggucgauuucguuggcgcagcugugucuugugacgccgcauuucuuaauuugacagguugcuacagcuguaacgccggggcucgcguaugccucuccauuacgucaaccggaacuggcacacugagugcgcauaacaaggaugguagccuacacaucgugcugccuucugaaaauggcaccaaagaccagugccagauacuccauuucacagucccagagguggaagaggaauuuauguauuccugugacggggaugagcggccccugcuuguuaagggaacuuugaucgccauugacccuuucgaugacagaagggaggcaggcggggaaucaaccguggucaaccccaaaaguggaagcuggaacuuuuucgauugguucuccggccugaugucuugguuuggugggccauuaaagacgauccuccugauuugccuuuacguggcucugucgaucggauuguucuuucuccugauauaccuaggccgcaccggucugagcaaaauguggcucgccgccacaaagaaggcuucauga

SEQ ID NO: 11306 - RNA, 3204 nt, Artificial Sequence
  derived and/or modified CDS sequence (opt3) from RVFV(TAN/Dod-002/07)__HM586971.1__Gn-Gc
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggccguaagaagugcacuggugacgccgcguucuguagcgccuacgagugcaccgcacaguaugcuaaugccuacuguucucacgcuaacggguccggaauugugcaaauccaggucucaggcguuuggaaaaagccacuuugcgugggcuaugaaagaguaguggucaaaagggagcugagcgccaagcccauacagcggguggaaccuuguacaacuugcaucaccaaaugugagccacacggguugguugugcgcaguacaggauuuaagauuucuuccgcagucgccugcgcuagcgguguguguguaaccggcucgcaaucucccuccacggagaucacucucaaguacccggggauuucacagaguagcggaggcgauaucgguguucauauggcgcacgacgaucaguccgugucuagcaaaauagucgcacauugcccuccccaggacccaugucuggugcacgggugcauugucugcgcccaggcuuggaucauuucacaauggcauacagccuuaagugcauucgugguuaucuucguguuuuccagcaccgccaucauuugucuggcuguacucuauagaguccuuaagugccugaaaauagccccuaggaagguguugaauccccuaauguggaucacugcauucauucgguggguuuacaaaaagaugguggcgcgcgucgcugauaacaucaaucaggugaaccgagaaauaggcuggauggagggaggccagcuggcccucgggaauccagcacccauuccuagacacgccccaaucccgagguauucuacauaccugaugcuucuguugaucguaucauacgcuagugccuguagcgaacucauucaagcauccucucggaucaccacgugcucgaccgagggagugaacacaaagugucgucugagcgguacugcuuuaauucgcgccggcuccguuggggcggaagccugccugaugcuaaaaggagucaaggaggaccagaccaaauuucucaagauaaaaacagugucaagugagcugucuuguagagaaggccagagcuauuggacugguuccuucucacccaagugccuuagcucuaggcggugucacuuggugggggagugccaugucaaccgaugucuguccuggcgcgauaaugaaaccagugcugaguuuagcuucguuggcgaaucuacaaccaugagagagaacaaaugcuuugagcagugcggaggcuggggguguggaugcuucaaugugaacccuuccugucucuuugugcacacuuaccugcaaucaguaaggaaggaagcacuucgggucuucaauugcaucgacugggugcauaagcugacguuggagauuacagacuuugaugguaguguuagcaccaucgaccucggcgccucguccucucgcuucacuaacugggggagcgugucacugaguuuagaugcugaaggaaucuccggcucuaauagcuuuuccuucauugagucaccagguaaaggguaugccauagucgacgagcccuucagcgaaaucccuagacagggcuuucugggagagauuagguguaacagugaaucuuccgugcuaagcgcacacgagucgugccuccgugcgccaaaucugguuucauacaagcccaugaucgaucagcuugaauguaccacaaacuugauugacccguucgugguauuugagcggggcucucugccucagacccgaaaugauaaaacuuucgccgcuaguaaggggaacagaggaguccaagccuuuuccaaaggcagcgugcaggcagaccucacacugauguucgauaauuuugagguggacuucgucggugcugccguuucuugcgaugcagccuuuuuaaaccugacgggguguuauagcugcaaugcuggagcgagggugugucuuuccaucaccucaacuggcacagguaccuugagugcccacaacaaggacggcagccuccauauaguacugccaucugaaaacgggacaaaggaucagugccaaauccuacacuucacugugcccgaggucgaagaggaauuuauguacuccugcgacggagacgagcgcccucugcucgugaaaggcacccugauugcaaucgaucccuucgacgaucggagagaggcugggggagaaucaacgguugugaauccaaagaguggcagcuggaacuuuuucgacugguucuccggucuuaugucuugguuugggggaccuuugaaaaccauucuguuaaucugucucuaugucgcccugucgauaggccuuuucuuucuguugauuuaccucgguaggacaggccugagcaagauguggcuagccgcuacuaaaaaggcaucauga

SEQ ID NO: 11307 - RNA, 3204 nt, Artificial Sequence
  derived and/or modified CDS sequence (opt3) from RVFV(KEN/Gar-004/06)__HM586964.1__Gn-Gc
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggcccugaaaaagugcgaugggcaguuauccacugcacaugagguaguuccguuugcuguguucaaaaauucucaaaaggucuaucuugacaaauuggaccugaagacagaagagaaccuacuccccgauagcuuuguguguuucgagcacaagggacaguacaaagguaccauggacuccggccagacgaagcgagaacugaaaucauuugauauuagucagugcccuaagaucgggggacauggccguaaaaagagaacuggugacgccgcguucugcagcgccuacgaguguaccgcacaauaugcuaaugccuacugcucuagggcuaacggguccggaauugugcagauccaggucucacggguuuggaagaaaccacuuugugugggcuaugaacgcguaguggucaagagagagcugagcgccaaacccauacaaaggguggaaccuugcacaacuuguaucaccaagugcgagccacacggcuugguugugcggaguacaggguuuaaaauuucuuccgcagucgccugugcuagcggagugugcguaaccgguucgcagucucccuccacggagaucacucucaaguacccgggcauuucacagaguagcgggggagauaucggcguucacauggcgcaugacgaucaguccgugucuagcaagauagucgcacacuguccuccccaagacccaugccuggugcaugguuguauugucugcgcccacggguuaaucaauaaccagucacauagugcucuguccgccuucgugguuauuuucguguuuagcucuacagcaaucaucugccucgccguacuuuaucgcguccugaaauguuugaagauugcuccucgaaaagugcuaaauccccugauguggauaaccgccuucaucagauggguuuacaagaaaaugguggcaagggucgcggauaacauuaaucaggugaaccgggaaaucggcuggauggagggaggccagcucgcucuggggaacccagcccccauaccucgucacgcaccaauuccgcgcuauucaacuuaccuuaugcuguugcucaucguaaguuacgccagcgcuugcuccgaacugauccaagccucuucgagaauuacaaccuguagcacggagggagugaauaccaagugcagguuauccgguacagcacugauccgggcuggcucaguuggggccgaagcgugucuaaugcucaagggagucaaagaggaccagacuaaguuucugaaaauuaagaccgugaguucugagcuuagcugccgagaaggccaguccuauuggacagguucauucagccccaaauguuugucuucccgcagaugccaccuggugggggagugucaugucaacaggugccucaguuggcgggauaaugaaacuagcgccgaguuuucuuucguuggcgaauccaccacaaugcgcgagaacaaguguuuugagcagugcggaggcugggggugcggauguuucaaugugaacccuucaugccuguuugugcacaccuaccuucaaaguguaagaaaagaagcucugagggucuucaauuguauagacugggugcauaaguugacucucgagaucacggacuuugaugguagcguuucgacaauugaccugggcgcauccucuagccguuucaccaacugggggucagugaguuuaucccuggaugccgaaggaaucucuggcagcaauuccuuuucauucaucgagagcccagguaagggguaugcuauugucgacgagcccuucagugaaauaccucggcagggcuuucuaggagagauccgaugcaacucugaauccagcgugcucucggcccacgagucaugucugagagcaccaaaucuuguuucuuacaaacccaugauugaucaguuggaaugcacuaccaaccugaucgacccguucgugguauuugagaggggcagucucccucagacacgcaaugauaagaccuucgcggccuccaaagggaaccggggaguccaggcuuuuagcaagggcucugugcaagccgaccugacuuuaagauucgauaauuuugagguggacuucgucggugcagcuguuagcugugaugccgcauuucugaaccuuacagggugcuauuccuguaacgccggagcuagggugugcuugucaauuacgaguaccggcacugguacacucagcgcgcacaauaaagacggcucucugcauaucguacuaccauccgaaaacgggaccaaggaucagugucaaauacugcacuucacagugcccgaggucgaagaggaauuuauguacucaugcgacggagacgagcgcccucuccuggugaagggcacucuuaucgccauugaucccuucgacgaucgacgggaggcagggggagaaaguaccguugugaauccaaaaagcggcuccuggaacuuuuucgacugguucucugguuugaugucgugguuugggggaccucugaagacgaucuuacucauuugccuguaugucgcucuuagcaucggccuguucuuuuugcucauauaccugggucguaccggccuaucaaaaauguggcuggccgccacaaagaaggcuuccuga

SEQ ID NO: 11308 - RNA, 1680 nt, Artificial Sequence
  derived and/or modified CDS sequence (opt3) from RVFV(ZH-548)__DQ380206.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcuuagugcgcauggaaacccuuguaugaaagagaagcuggugaugaagacucacugcccaaaugauuaucagagcgcacacuacuugaacaaugacggcaaaauggccuccguuaagugucccccuaaauaugaacucaccgaggauugcaacuuuugucgccagaugacaggugcuucucugaagaaagggucguacccacugcaggaccucuucugccaaucaagcgaggaugacggaaguaaguuaaagaccaaaaugaagggcgugugugaagucggcgugcaggcccugaaaaagugcgaugggcagcuuuccacugcacaugagguaguuccguuugcuguguucaaaaauucuaagaaagucuauuuggacaagcuggaccuaaagacagaagagaaccuccugcccgauagcuuuguguguuucgagcacaaaggacaguacaaggguaccauggacuccggccaaacgaaacgagaacuuaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcagauccaagucagcggcguuuggaaaaagccacugugcgugggcuaugaacguguaguggucaaaagagaguugagugccaagcccauacagaggguggaaccuuguacaacuugcaucaccaaaugugagccacacgggcucguugugcggucuacaggauuuaagauuuccagcgcagucgccugcgcuucggguguguguguaaccggcucucagucccccucaacggagaucacucugaaguacccggggauuagucaaagcuccggaggcgauaucgguguucauauggcgcacgacgaucagucugugagcucaaaaauagucgcacauugcccuccccaggacccauguuuagugcacgauugcauugucugcgcccaugggcugaucaauuaucagugucacacagcucucagugccuucgugguuguguucguauuuuccagcauugcaaucaucugccuugccauucuguaccgcgucuugaagugucuaaaaauagcuccuagaaaggugcugaacccccucauguggaucaccgccuucauuagguggaucuauaaaaagaugguugcacggguggcggacaauauaaaccaagucaaucgcgaaauuggcuggauggagggaggccagcuggugcuugggaacccagcucccaucccucgacacgccccaaucccgagauacucuacuuaccugauguugcuccugauuguaucauaugcaagugcc

SEQ ID NO: 11309 - RNA, 1680 nt, Artificial Sequence
  derived and/or modified CDS sequence (opt3) from RVFV(MP-12)__DQ380208.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcuuagugcgcauggaaacccuuguaugaaagagaagcuggugaugaagacucacugcccaaaugauuaucagagcgcacaccauuugaacaaugacggcaaaauggccuccguuaagugucccccuaaauacgaacucaccgaggauugcaacuuuugucgccagaugacaggugcuucucugaagaaagggucguauccacugcaggaccucuucugccaaucaagcgaggaugacggaaguaaguuaaagaccaaaaugaagggcgugugugaagucggcgugcaggcccugaaaaagugcgaugggcagcuuuccacugcacacgagguaguuccguuugcuguguucaaaaauucuaagaaagucuacuuggacaagcuggaccuaaagacagaagagaaccuccugcccgauagcuuuguguguuucgagcauaaaggacaguauaaggguaccauggacuccggccaaacgaaacgagaacuuaagucauuugauauuagucagugcccuaaaaucgggggacacggcagcaagaagugcacuggugacgccgcguucuguucugccuacgagugcaccgcacaguacgcuaaugccuauuguucccacgcuaacgggucaggaauugugcagauccaagucagcggcguuuggaaaaagccacugugcgugggcuacgaacguguaguggucaaaagagaguugagugccaagcccauacagaggguggaaccuuguacaacuugcaucaccaaaugugagccacaugggcucguugugcggucuacaggauuuaagauuuccagcgcagucgccugcgcuucggguguguguguaaccggcucucagucccccucaacggagaucacucugaaguauccggggauuagucaaagcuccggaggcgauaucgguguucacauggcgcaugacgaucagucugugagcucaaaaauagucgcacacugcccuccccaggacccauguuuagugcaugauugcauugucugcgcccacgggcugaucaauuaccagugucacacagcucucagugccuucgugguuguguucguauuuuccagcauugcaaucaucugccuugccauucuguaucgcgucuugaagugucuaaaaauagcuccuagaaaggugcugaacccccucauguggaucaccgccuucauuagguggaucuacaaaaagaugguugcacggguggcggacaauauaaaccaagucaaucgcgaaauuggcuggauggagggaggccagcuggugcuugggaacccagcucccaucccucgacaugccccaaucccgagauauucuacuuaccugauguugcuccugauuguaucauacgcaagugcc

SEQ ID NO: 11310 - RNA, 1680 nt, Artificial Sequence
  derived and/or modified CDS sequence (opt3) from RVFV(MP12)__Z30318.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcuuagugcgcauggaaacccuuguaugaaagagaagcuggugaugaagacucacugcccaaaugauuaucagagcgcacaccauuugaacaaugacggcaaaauggccuccguuaagugucccccuaaauacgaacucaccgaggauugcaacuuuugucgccagaugacaggugcuucucugaagaaagggucguauccacugcaggaccucuucugccaaucaagcgaggaugacggaaguaaguuaaagaccaaaaugaagggcgugugugaagucggcgugcaggcccugaaaaagugcgaugggcagcuuuccacugcacacgagguaguuccguuugcuguguucaaaaauucuaagaaagucuacuuggacaagcuggaccuaaagacagaagagaaccuccugcccgauagcuuuguguguuucgagcauaaaggacaguauaaggguaccauggacuccggccaaacgaaacgagaacuuaagucauuugauauuagucagugcccuaaaaucgggggacacggcagcaagaagugcacuggugacgccgcguucuguucugccuacgagugcaccgcacaguacgcuaaugccuauuguucccacgcuaacgggucaggaauugugcagauccaagucagcggcguuuggaaaaagccacugugcgugggcuacgaacguguaguggucaaaagagaguugagugccaagcccauacagaggguggaaccuuguacaacuugcaucaccaaaugugagccacaugggcucguugugcggucuacaggauuuaagauuuccagcgcagucgccugcgcuucggguguguguguaaccggcucucagucccccucaacggagaucacucugaaguauccggggauuagucaaagcuccggaggcgauaucgguguucacauggcgcaugacgaucagucugugagcucaaaaauagucgcacacugcccuccccaggacccauguuuagugcaugauugcauugucugcgcccacgggcugaucaauuaccagugucacacagcucucagugccuucgugguuguguucguauuuuccagcauugcaaucaucugccuugccauucuguaucgcgucuugaagugucuaaaaauagcuccuagaaaggugcugaacccccucauguggaucaccgccuucauuagguggaucuacaaaaagaugguugcacggguggcgcauaauauaaaccaagucaaucgcgaaauuggcuggauggagggaggccagcuggugcuugggaacccagcucccaucccucgacacgccccaaucccgagauauucuacuuaccugauguugcuccugauuguaucauacgcaagugcc

SEQ ID NO: 11311 - RNA, 1680 nt, Artificial Sequence
  derived and/or modified CDS sequence (opt3) from RVFV(2007001811)__EU574040.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuuuaccgcguccugaaguguuugaaaauagcuccuagaaaggugcuaaacccccugauguggaucaccgccuucauuagguggguuuauaaaaagaugguggcacgggucgcggauaauaucaaccaggugaaucgcgaaauaggauggauggagggcgggcagcucguacugggaaacccagcucccauuccucgacacgccccaaucccgagauacucuacuuaccuuaugcuguugcucaucgugucauaugcaagugcc

SEQ ID NO: 11312 - RNA, 1680 nt, Artificial Sequence
  derived and/or modified CDS sequence (opt3) from RVFV(2250/74)__DQ380209.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuuuaccgcguccugaaguguuugaaaauagcuccuagaaaggugcuaaacccccugauguggaucaccgccuucauuagguggaucuauaaaaagaugguugcacggguggcggauaauauaaaccaggucaaucgcgaaauuggauggauggagggcgggcagcucgugcugggaaacccagcucccaucccucgacacgccccaaucccgagauacucuacuuaccuuaugcuguugcucauuguaucauaugcaagugcc

SEQ ID NO: 11313 - RNA, 1680 nt, Artificial Sequence
  derived and/or modified CDS sequence (opt3) from RVFV(T1)__DQ380201.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccguccuuuaccgcgugcugaaguguuugaaaauugcuccuagaaagguucuaaacccccugauguggauaaccgccuucaucagguggauuuauaaaaagaugguggcacgggucgcggauaauaucaaccaggugaaucgcgaaauaggauggauggagggcgggcagcucguacugggaaacccagcucccauuccucgacacgccccaaucccgagauacucuacuuaccuuaugcuguugcucaucgugucauaugcaagugcc

SEQ ID NO: 11314 - RNA, 1680 nt, Artificial Sequence
  derived and/or modified CDS sequence (opt3) from RVFV(Ken 199800523)__KU978777.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuuuuguucccacgcuaacgggucaggaauugugcaaauccaggucagcggcguuuggaaaaagccacuuugcgugggcuacgaacguguaguggucaaaagagagcugagugccaagcccauacagaggguggaaccuuguacaacuugcaucaccaaaugugagccacacggguugguugugcggucuacaggauucaagauuuccagcgcagucgccugcgcuucggguguguguguaaccggcucucaaucccccucaacggagaucacucucaaguauccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaccaaugucacacagcucugagugccuucgugguuguguuuguauucuccagcauugcaaucaucugccucgccauucuuuaucgcguccugaaguguuugaaaauagcuccuagaaaggugcuaaacccccugauguggaucaccgccuuuauuagguggguuuacaaaaagaugguggcacgggucgcggauaauaucaaccaggugaaucgcgaaauaggauggauggagggcgggcagcucguacugggaaacccagcucccauuccucgacacgccccaaucccgagauauucuacuuaccuuaugcuguugcucaucgugucauacgcaagugcc

SEQ ID NO: 11315 - RNA, 1680 nt, Artificial Sequence
  derived and/or modified CDS sequence (opt3) from RVFV(1853/78)__DQ380220.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggagugguccaaauucagguuagcggcguguggaaaaagccacuuugcguaggcuaugaacguguggucgugaaaagagagcugagugccaagcccauccagaggguugaaccuuguacaacuugcauaaccaaaugugagccacacggguuggugguccggucuacaggauuuaagaucuccagcgcaguggccugcgcuucggguguauguguuaccggcucucaaucccccucaacggagauuacucucaaguacccggggaucagucagagcuccggaggcgauauuggugugcauauggcgcacgacgaucagucugucagcucaaaaaucguggcacauugcccuccccaggacccaugucugguccacgggugcauagugugcgcccauggcuuaauuaauuaucaaugucacacagcucugagugccuucguugugguauucgucuuuuccagcaucgcaauuaucugccucgccauccuuuaccgcgugcugaaguguuugaaaauugcuccuagaaagguucuaaacccccugauguggauaaccgccuucaucagguggguguauaaaaagauggucgcacggguggcggauaauauuaaccagguaaaucgcgaaaucggauggauggagggcgggcagcucgugcugggaaacccagcucccauaccucgacacgccccaauuccgagauacucuacuuaccuuaugcuguugcucaucguuucauaugcaagugcc

SEQ ID NO: 11316 - RNA, 1680 nt, Artificial Sequence
  derived and/or modified CDS sequence (opt3) from RVFV(73HB1449)__DQ380211.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaaaucccuccacggagaucacucucaaguacccggggauuucacagaguagcggaggcgauaucgguguucauauggcgcacgacgaucaguccgugucuagcaaaauagucgcacauugcccuccccaggacccaugucuggugcacgggugcauugucugcgcccauggcuuaaucaacuaucaaugucacacagcucugucagccuucgugguuguguucguauuuaguuccauugcaaucaucugccucgccauucuuuaccgcguccugaaguguuugaaaauagcuccuagaaaggugcuaaauccccugauguggaucaccgccuucauuagguggguuuauaaaaagaugguggcacgggucgcggauaacaucaaucaggugaaccgcgaaauaggauggauggagggcgggcagcucguacugggaaacccagcucccauuccucgacacgccccaaucccgagauacagcacuuaccuuaugcuguugcucaucgugucuuaugcaucagcc

SEQ ID NO: 11317 - RNA, 1680 nt, Artificial Sequence
  derived and/or modified CDS sequence (opt3) from RVFV(2007000234)__JF326191.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuauuuucguguuuuccagcaccgcaaucaucugccucgccguacuuuaccgcguccugaaguguuugaaaauugcuccuagaaaggugcuaaacccccugauguggauaacugccuucaucagguggguuuauaaaaagaugguggcacgggucgcggauaauauuaaccaggugaaucgcgaaaucggauggauggagggcgggcagcucgcucugggaaacccagcccccauaccucgacacgcaccaauuccgagauacucuacauaccuuaugcuguugcucaucguaucauaugccagugcu

SEQ ID NO: 11318 - RNA, 1680 nt, Artificial Sequence
  derived and/or modified CDS sequence (opt3) from RVFV(73HB1230)__DQ380221.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaaaaggaacugaaaucauuugauauuagucagugcccuaagaucgggggacauggcagcaagaaaugcacuggugacgccgcguucuguucugccuacgagugcaccgcacaguaugcuaaugccuacuguucccacgcuaacgggucaggaauugugcaaauccaggucagcggcguuuggaagaaaccacuuugcgugggcuaugaacgaguaguggucaagcgugagcugagugccaaacccauacagagaguggaaccuuguacaacuugcaucaccaagugugagccacacggguugguugugaggucuacaggauuuaagauuuccagcgcagucgccugcgcuucggguguguguguaaccggcucucaaucccccucaacggagaucacucucaaauacccggggauuagucagagcuccggaggcgauaucgguguucauauggcgcacgacgaucagucugugagcucaaagauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuuuaccggguccugaaauguuugaagauagcuccucgcaaagugcuaaacccccugauguggaucaccgccuucauuagauggguuuauaagaagaugguggcaagggucgcggauaauaucaaccaggugaaucgggaaauaggauggauggagggcgggcagcucguacugggaaacccagcucccauuccucgccacgccccaaucccgcgauacucuacuuaccuuaugcuguugcucaucgugucauaugcaagugcc

SEQ ID NO: 11319 - RNA, 1680 nt, Artificial Sequence
  derived and/or modified CDS sequence (opt3) from RVFV(ZM-657)__DQ380204.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaagccuacuguucccacgcuaaugggucaggaauugugcaaauccaggucagcggcguuuggaagaaaccacuuugcgugggcuaugaacguguaguggucaagagagagcugagugccaaacccauacagaggguggaaccuuguacaacuugcaucaccaagugugagccacacggguugguugugcggucuacaggauuuaagauuuccagcgcagucgccugcgcuucggguguguguguaaccggcucucaaucccccucaacggagaucacucucaaauacccggggauuagucagagcuccggaggcgauaucgguguucauauggcgcacgacgaucagucugugagcucaaagauagucgcacauugcccuccccaggacccaugucuggugcacgggugcauugucugcgcccauggcuuaaucaacuaucaaugucacacagcucugagugccuucgugguuguguucguauuuuccagcauugcaaucaucugccucgccauucuuuaccgcguccugaaauguuugaagauagcuccuagaaaagugcuaaauccccugauguggaucaccgccuucauuagguggaucuauaagaagaugguugcacggguggcggauaacauaaaucaggucaaccgcgaaauuggauggauggagggcgggcagcucgugcugggaaauccagcucccaucccucgacacgccccaaucccgagauacucuacuuaccuuaugcuguugcucauuguaucauaugcaagugcc

SEQ ID NO: 11320 - RNA, 1680 nt, Artificial Sequence
  derived and/or modified CDS sequence (opt3) from RVFV(Kenya 83 (21445))__DQ380198.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuuuaccgcguccugaaguguuugaaaauagcuccuagaaaggugcuaaacccccugauguggaucaccgccuucauuagguggguuuauaaaaagaugguggcacgggucgcggauaauaucaaccaggugaaucgcgaaauaggauggauggagggcgggcagcucgcucugggaaacccagcccccauuccucgacacgcaccaaucccgagauacucuacuuaccuuaugcuguugcucaucguaucauaugccagugcu

SEQ ID NO: 11321 - RNA, 1680 nt, Artificial Sequence
  derived and/or modified CDS sequence (opt3) from RVFV(SAUDI 200010901)__KU978778.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuuuuguucccacgcuaacgggucaggaauugugcaaauccaggucagcggcguuuggaaaaagccacuuugcgugggcuacgaacguguaguggucaaaagagagcugagugccaagcccauacagaggguggaaccuuguacaacuugcaucaccaaaugugagccacacggguugguugugcggucuacaggauucaagauuuccagcgcagucgccugcgcuucggguguguguguaaccggcucucaaucccccucaacggagaucacucucaaguauccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaccaaugucacacagcucugagugccuucgugguuguguuuguauucuccagcauugcaaucaucugccucgccauucuuuaucgcguccugaaguguuugaaaauagcuccuagaaaggugcuaaacccccugauguggaucaccgccuuuauuagguggguuuacaaaaagaugguggcacgggucgcggauaauaucaaccaggugaaucgcgaaauaggauggauggagggcgggcagcucguacugggaaacccagcucccauuccucgacacgccccaaucccgagauauucuacuuaccuuaugcuguugcucaucauuucauacgcaagugcc

SEQ ID NO: 11322 - RNA, 1680 nt, Artificial Sequence
  derived and/or modified CDS sequence (opt3) from RVFV(2007004194)__EU574031.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccuguccaacgacggcaaaauggccucuguuaagugucccccuaaauaugaauugaccgaggauugcaauuuuugucgccagaugacaggugcuucgcucaagaaagggucauacccacugcaagaccuguucugccagagcagugaggaugacggauccaagcucaagaccaaaaugaagggcgugugugaagucggcgugcaggccuuaaagaagugcgaugggcagcugucuacugcacaugagguaguuccguuugcuguguucaaaaacagcaagaaagucuaucuugacaaguuggaccugaagacagaagagaaucuacuccccgauuccuuuguguguuucgagcacaaaggacaauacaaggguaccauggacucaggccagacgaaacgagaacugaagaguuuugauauuagccagugcccuaaaaucgggggacauggcucuaagaagugcacuggugacgccgcguucuguuccgccuacgagugcaccgcacaguaugcuaacgccuacuguucacacgcuaaugggagcggaauugugcaaauccaggucaguggcguuuggaaaaagccacuuugcgugggcuaugaacguguaguggucaaaagagagcugucugccaagcccauacagaggguggaaccuuguacaacuugcaucaccaaaugugagccacacggguugguugugcgguccacaggauuuaagauuagcucggcagucgccugcgcuucugguguguguguaaccggcucccaaucacccaguacggagaucacucucaaguacccggggauuagccaguccucuggaggcgauaucgguguucauauggcgcacgacgaucagagcgugucaaguaaaauagucgcacauugcccuccccaggacccaugucuggugcacgggugcauugucugcgcccauggcuuaaucaacuaucaaugucacacagcucuguccgccuucgugguuguguucguauuuagcucuauugcaaucaucugccucgccauucuuuaccgcguccugaaguguuugaaaauagcuccuagaaaggugcuaaauccccugauguggaucaccgccuucauuagguggguuuauaaaaagaugguggcacgggucgcggauaacaucaaucaggugaaccgcgaaauaggauggauggagggcgggcagcucguacugggaaauccagcucccauuccucgacacgccccaaucccgagauacucaacuuaccuuaugcuguugcucaucgugaguuaugcaagcgcc

SEQ ID NO: 11323 - RNA, 1680 nt, Artificial Sequence
  derived and/or modified CDS sequence (opt3) from RVFV(ZH-501-777)__DQ380202.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacccuggccagacgaaacgagaacugaaguccuuugauauuucacagugcccaaaaaucgggggacauggcaguaagaagugcacuggugacgccgcguucuguagcgccuacgagugcaccgcacaguaugcuaaugccuacuguucucacgcuaacggguccggaauugugcaaauccaggucucaggcguuuggaaaaagccccuuugcgugggcuaugaacguguaguggucaaaagagagcugagcgccaagccuauacagaggguggaaccauguacaacuugcaucaccaaaugugagccccacggguugguugugcggaguacaggauuuaagauuucuuccgcagucgccugcgcuagcgguguguguguaaccggcucgcaaucuccguccacggagaucacucucaaguacccugggauuucacagaguagcggaggcgauaucgguguucauauggcgcacgacgaucaguccgugucuagcaaaauagucgcacauugucccccacaggacccuugccuggugcacgggugcauugucugcgcccauggcuuaaucaauuaucaaugucacacagcucugucagccuucgugguuguguucguauuuaguuccauugcaaucaucugccucgccguccuuuaccgcgugcugaaguguuugaaaauugcucccagaaagguucuaaacccacugauguggauaaccgccuucaucagguggauuuauaaaaagaugguggcacgggucgcggauaauaucaaccaggugaaucgcgaaauaggauggauggagggcgggcagcucguacugggaaaccccgcuccuauuccacgacacgccccgauccccagauacagcacuuaccuuaugcuguugcucaucgugucuuaugcaucagcc

SEQ ID NO: 11324 - RNA, 1680 nt, Artificial Sequence
  derived and/or modified CDS sequence (opt3) from RVFV(ZC-3349)__DQ380207.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucaggcagugucuagcaaaauagucgcccauugcccuccccaggacccaugucuggugcacgggugcauugucugcgcucauggcuuaaucaauuaucaaugucacacagcccugucagcauucgugguuguguucguauuuaguuccauugccaucaucugccucgcuauucuuuaccgcguccugaaguguuugaaaauagccccuagaaaggugcuaaacccccugauguggaucaccgcauucauuagguggaucuauaaaaagaugguugcgcggguggcugauaauauaaaccacgucaaucgcgaaauuggauggauggagggcgggcagcucgugcugggaaacccagcccccaucccucgacaugcaccaaucccgagauacagcacuuaccuuaugcuguugcucauuguaucuuaugccucagcu

SEQ ID NO: 11325 - RNA, 1680 nt, Artificial Sequence
  derived and/or modified CDS sequence (opt3) from RVFV(200803166)__JF311381.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuaaagaaagggaaguuuccucuguuccaaucuuacgcacaccaucggacccuacucgaggccguccacgacacaauaaucgcuaaagccgauccacccucaugcgaccugcagagugcgcauggaaacccuuguaugaaggaaaaacuugugaugaagacucacugcccaaaugauuaucagagcgcacacuaccugaacaaugacggcaagauggccuccguuaaaugucccccuaaguaugaguugaccgaagauugcaacuuuugucgccagaugacaggugcuucucucaaaaaggggucguacccacugcaagaccuguucugccagucaagcgaggaugacggaaguaagcucaaaaccaagaugaaaggcgugugugaggucggcgugcaggccuuaaagaaaugcgaugggcagcuguccacugcacaugaaguaguuccguuugcuguguucaaaaauucuaagaaggucuaucuugacaaguuggaccugaaaacagaggaaaaccuacuccccgauagcuuuguguguuucgagcacaagggacaauacaaagguaccauggacuccggccagacgaagcgagagcugaaaucauuugauauuagucagugcccuaagaucgggggacauggcagcaagaaaugcacuggugacgccgcguucuguucugccuacgaaugcaccgcacaguaugcuaaugccuacuguucccacgcuaacgggucaggaauugugcaaauccaggucagcggcguuuggaagaaaccacuuugcgugggcuaugagcguguaguggucaagagagaacugagugccaaacccauacagaggguggagccuuguacaacuugcaucaccaagugugaaccacacggguugguugugcggucuacaggauuuaagauuuccagcgcagucgccugcgcuucggguguguguguaaccggcucucaaucccccucaacggagaucacucucaaauacccggggauuagucagagcuccggaggcgauaucgguguucauauggcgcacgacgaucagucugugagcucaaagauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuuuaccgcguccugaaauguuugaagauagcuccuagaaaagugcuaaacccccugauguggaucaccgccuucauuagguggguuuauaagaagaugguggcacgggucgcggauaauaucaaccaggugaaucgcgagauaggauggauggaaggcgggcagcucguacugggaaacccagcucccauuccucgacacgccccaaucccgagauacucuacuuaccuuaugcuguugcucaucgugucauaugcaacagcc

SEQ ID NO: 11326 - RNA, 1680 nt, Artificial Sequence
  derived and/or modified CDS sequence (opt3) from RVFV(1260/78)__DQ380214.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccauucuucaccgcguccugaaguguuugaaaauagcuccuagaaaggugcuaaacccccugauguggaucaccgccuucauuagguggguuuacaaaaagaugguggcacgggucgcggauaauaucaaccaggugaaucgcgaaauaggauggauggagggcgggcagcucguacugggaaacccagcucccauuccucgacaugccccaaucccgagauauucuacuuaccuuaugcuguugcucaucgugucauacgcaagugcc

SEQ ID NO: 11327 - RNA, 1680 nt, Artificial Sequence
  derived and/or modified CDS sequence (opt3) from RVFV(T-46 (228113))__DQ380199.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccaaagacuccggccagacgaagcgagaacugaaaucauuugauauuagucagugcccuaagaucgggggacauggcagcaagaaaugcacuggugacgccgcguucuguucugccuacgagugcaccgcacaguaugcuaaugccuacuguucccacgcuaacgggucaggaauugugcaaauccaggucagcggcguuuggaagaaaccacuuugcgugggcuaugaacguguaguggucaagagagagcugagugccaaacccauacagaggguggaaccuuguacaacuugcaucaccaagugugagccacacggguugguugugcggucuacaggauuuaagauuuccagcgcagucgccugcgcuucggguguguguguaaccggcucucaaucccccucaacggagaucacucucaaauacccggggauuagucagagcuccggaggcgauaucgguguucauauggcgcacgacgaucagucugugagcucaaagauagucgcacauugcccuccccaggacccaugucuggugcacgggugcauugucugcgcccauggcuuaaucaauuaucaaugucacacagcucugagugccuucgugguuguguucguauuuuccagcauugcaaucaucugccucgccguccuuuaccgcgugcugaaauguuugaagauugcuccuagaaaaguucuaaacccccugauguggauaaccgccuucaucagguggauuuauaagaagaugguggcacgggucgcggauaauaucaaccaggugaaucgcgaaauaggauggauggagggcgggcagcucguacugggaaacccagcucccauuccucgacacgccccaaucccgagauacucuacuuaccuuaugcuguugcucaucgugucauaugcaagugcc

SEQ ID NO: 11328 - RNA, 1680 nt, Artificial Sequence
  derived and/or modified CDS sequence (opt3) from RVFV(ZINGA J83 R1)__KU978776.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaagauggccuccguuaagugucccccuaaauaugaauugaccgaggauugcaacuuuugucgccucaugacaggugcuucucugaagaaagggucguacccacugcaggaccucuucugccaaucaagcgaggaugacggaaguaaguuaaagaccaaaaugaagggcgugugugaagucggcgugcaggcccugaaaaagugcgaugggcagcuuuccacugcacaugagguaguuccguuugcuguguucaaaaauucuaagaaagucuauuuggacaagcuggaccuaaagacagaagagaaccuccugcccgauagcuuuguguguuucgagcacaaaggacaguacaaggguaccauggacuccggccaaacgaaacgagaacuuaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcagauccaagucagcggcguuuggaaaaagccacugugcgugggcuaugaacguguaguggucaaaagagaguugagugccaagcccauacagaggguggaaccuuguacaacuugcaucaccaaaugugagccacacgggcucguugugcggucuacaggauuuaagauuuccagcgcagucgccugcgcuucggguguguguguaaccggcucucagucccccucaacggagaucacucugaaguacccggggauuagucaaagcuccggaggcgauaucgguguucauauggcgcacgacgaucagucugugagcucaaaaauagucgcacauugcccuccccaggacccauguuuagugcacgggugcauugucugcgcccauggccugaucaauuaucagugucacacagcucucagugccuucgugguuguguucguauuuuccagcauugcaaucaucugccuugccauucuguaccgcgucuugaagugucuaaaaauagcuccuagaaaggugcugaacccccucauguggaucaccgccuucauuagguggguuuaucggaaaaugguggcacgcgucgcggauaauaucaaccaagugaaucgagaaauaggauggauggagggcgggcagcugguacuuggaaacccagcucccauuccuagacacgugccaaucccgagguacucuacuuaccugauguugcuccugaucguuucauaugccagugca

SEQ ID NO: 11329 - RNA, 1680 nt, Artificial Sequence
  derived and/or modified CDS sequence (opt3) from RVFV(clone 13)__DQ380213.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaacaugaauugaccgaggauugcaacuuuugucgccagaugacaggugcuucucucaagaaagggucguauccacugcaagaccuguucugccagucaagcgaggaugacggaaguaagcucaagaccaaaaugaagggcgugugugaagucggcgugcaggccuuaaagaagugcgaugggcagcuguccacugcacacgagguaguuccguuugcuguguucaaaaauucuaagaaagucuaccuugacaaguuggaccugaagacagaagagaaccuacuccccgauagcuuuguguguuucgagcauaaaggacaauauaaggguaccauggacuccggccagacgaaacgagaacugaagucauuugauauuagucagugcccuaaaaucgggggacacggcagcaagaagugcacuggugacgccgcguucuguucugccuacgagugcaccgcacaguacgcuaaugccuauuguucccacgcuaacgggucaggaauugugcaaauccaggucagcggcguuuggaaaaagccacuuugcgugggcuacgaacguguaguggucaaaagagagcugagugccaagcccauacagaggguggaaccuuguacaacuugcaucaccaaaugugagccacauggguugguugugcggucuacaggauuuaagauuuccagcgcagucgccugcgcuucggguguguguguaaccggcucucaaaaucccuccacggagaucacucucaaguauccggggauuucacagaguagcggaggcgauaucgguguucacauggcgcaugacgaucaguccgugucuagcaaaauagucgcacacugcccuccccaggacccaugucuggugcaugggugcauugucugcgcccacggcuuaaucaacuaccaaugucacacagcucugucagccuucgugguuguguucguauuuaguuccauugcaaucaucugccucgccauucuuuaucgcguccugaaguguuugaaaauagcuccuagaaaggugcuaaauccccugauguggaucaccgccuucauuagguggguuuacaaaaagaugguggcacgggucgcggauaacaucaaucaggugaaccgcgaaauaggauggauggagggcgggcagcucguacugggaaacccagcucccauuccucgacaugccccaaucccgagauauagcacuuaccuuaugcuguugcucaucgugucuuacgcaucagcc

SEQ ID NO: 11330 - RNA, 1680 nt, Artificial Sequence
  derived and/or modified CDS sequence (opt3) from RVFV(SA01-1322)__KX096942.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuuuuguucccacgcuaacgggucaggaauugugcaaauccaggucagcggcguuuggaaaaagccacuuugcgugggcuacgaacguguaguggucaaaagagagcugagugccaagcccauacagaggguggaaccuuguacaacuugcaucaccaaaugugagccacacggguugguugugcggucuacaggauucaagauuuccagcgcagucgccugcgcuucggguguguguguaaccggcucucaaucccccucaacggagaucacucucaaguauccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaccaaugucacacagcucugagugccuucgugguuguguuuguauucuccagcauugcaaucaucugccucgccauucuuuaucgcguccugaaguguuugaaaauagcuccuagaaaggugcuaaacccccugauguggaucaccgccuuuauuagguggguuuacaaaaagaugguggcacgggucgcggauaauaucaaccaggugaaucgcgaaauaggauggauggagggcgggcagcucguacugggagacccagcucccauuccucgacacgccccaaucccgagauauucuacuuaccuuaugcuguugcucaucauuucauacgcaagugcc

SEQ ID NO: 11331 - RNA, 1680 nt, Artificial Sequence
  derived and/or modified CDS sequence (opt3) from RVFV(25010-24)__KM210509.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugauuguucggucuacaggauuuaagaucuccagcgcaguggccugcgcuucgggugucugugugaccggcucucaaucccccucaacggagauuacucucaaguacccggggaucagucagagcuccggaggcgauauagguguacauauggcgcacgacgaucagucuguuagcucaaaaauuguggcacauugcccuccccaggacccaugucugguccacgggugcaucgugugcgcccauggcuuaauuaauuaucaaugucacacagcucugagugccuucgucgugguuuucguguuuuccagcguagcaaucaucugccucgccauucuuuacaagguccugaaauguuugaagauagcuccuaaaaaggugcuaaacccccugauguggaucaccgccuucauucgcuggguuuauaagaaaaugguggcaagagucgcggauaauaucaaccaggugaauagggaaauaggauggauggagggcgggcagcucgcucugggaaacccagcccccauuccucggcacgcaccaaucccgcgcuacucuacuuaccuuaugcuguugcucaucguaucauaugccagugcu

SEQ ID NO: 11332 - RNA, 1680 nt, Artificial Sequence
  derived and/or modified CDS sequence (opt3) from RVFV(200803162)__JF311377.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucgcaaaaugugagccacacggguugguugugcggucuaccggauuuaagauuuccagcgccgucgcuugcgcgucggguguguguguaacaggcucucaaucccccucaaccgagaucacgcucaaguacccggggauuagucagagcuccggaggcgauaucgguguucauauggcacacgacgaucagucugugagcucaaaaauagucgcccauugcccuccccaggacccaugucuggugcacgauugcauugucugcgcucauggguuaaucaauuaucaaugucacacugcccugagugcauucgugguuauuuucguguuuuccagcacagccaucaucugccucgcuguacuuuaccgcguccugaaguguuugaaaauugccccuagaaaggugcuaaacccccugauguggauaaccgcauucaucagguggguuuauaaaaagaugguggcgcgggucgcugacaauauuaaccaggugaaucgcgaaaucggcuggauggagggaggccagcucgcccugcgaaacccagcacccauaccuagacacgccccaauuccgagguacucuacuuaccuuaugcuguugcucaucguaucauaugcuagugcc

SEQ ID NO: 11333 - RNA, 1680 nt, Artificial Sequence
  derived and/or modified CDS sequence (opt3) from RVFV(2007002476)__EU574036.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuauuuucguguuuuccagcaccgcaaucaucugccucgccguacuuuaccgcguccugaaguguuugaaaauugcuccuagaaaggugcuaaacccccugauguggauaacugccuucaucaaauggguuuauaagaagaugguggcaagggucgcggauaauauuaaccaggugaaucgggaaaucggauggauggagggcgggcagcucgcucugggaaacccagcccccauaccucgccacgcaccaauuccgcgauacucuacauaccuuaugcuguugcucaucguaucauaugccagugcu

SEQ ID NO: 11334 - RNA, 1680 nt, Artificial Sequence
  derived and/or modified CDS sequence (opt3) from RVFV(Hv-B375)__DQ380218.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaaaacgaauugaccgaggauugcaauuuuugucgccagaugacaggugcuucucucaagaaagggucguauccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaacucuaagaaagucuaccuugacaaguuggaccugaagacagaagagaaucuacuccccgauagcuuuguguguuucgagcacaaaggacaauauaaggguaccauggacuccggccagacgaaacgagaacugaagucauuugauauuagucagugcccuaaaaucgggggacauggcagcaagaagugcacuggugacgccgcguucuguucugccuacgagugcaccgcacaguacgcuaacgccuauuguucccacgcuaaugggucaggaauugugcaaauccaggucagcggcguuuggaaaaagccacuuugcgugggcuacgaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguauccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaacuaccaaugucacacagcucugagugccuucgugguuguguucguauuuuccagcauugcaaucaucugccucgccauucuuuaucgcguccugaaguguuugaaaauagcuccuagaaaggugcuaaauccccugauguggaucaccgccuucauuagguggguuuacaaaaagaugguggcacgggucgcggauaacaucaaucaggugaaccgcgaaauaggauggauggagggcgggcagcucguacugggaaacccagcucccauuccucgacacgccccaaucccgagauauucuacuuaccuuaugcuguugcucaucgugucauacgcaagugcc

SEQ ID NO: 11335 - RNA, 1680 nt, Artificial Sequence
  derived and/or modified CDS sequence (opt3) from RVFV(OS-1)__DQ380186.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggagugguccaaauucagguuagcggcguguggaaaaagccacuuugcguaggcuaugaacguguggucgugaaaagagagcugagugccaagcccauccagaggguugaaccuuguacaacuugcauaaccaaaugugagccacacggguuggugguccggucuacaggauuuaagaucuccagcgcaguggccugcgcuucggguguauguguuaccggcucucaaucccccucaacggagauuacucucaaguacccggggaucagucagagcuccggaggcgauauuggugugcauauggcgcacgacgaucagucugucagcucaaaaaucguggcacauugcccuccccaggacccaugucugguccacgggugcauagugugcgcccauggcuuaauuaauuaucaaugucacacagcucugagugccuucguugugguauucgucuuuuccagcguggcaaucauuugccucgccauccuuuacaagguucugaaauguuugaagaucgcuccucgcaaagugcuaaacccccugauguggauuaccgccuucauaagaugggucuauaagaagaugguggcaaggguagcggauaauaucaaccaggugaaucgggaaauuggauggauggagggcgggcagcucgcucugggaaacccagcccccaucccucgccacgcaccaauaccgcgauacucuacuuaccuuaugcuguugcucauuguuucauaugccagugcu

SEQ ID NO: 11336 - RNA, 1680 nt, Artificial Sequence
  derived and/or modified CDS sequence (opt3) from RVFV(2373/74)__DQ380194.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauggucgcacauugcccuccccaggacccaugucuggugcacgggugcauagucugcgcccauggcuuaauuaauuaucaaugucacacagcucugagugccuucgugguuguguucguauuuuccagcgucgcaaucauuugccucgccauccuuuacaaggugcugaaauguuugaagaucgcuccucgcaaaguucuaaacccccugauguggauuaccgccuucauaagauggguguauaagaagauggucgcaaggguggcggauaauaucaaccagguaaaucgggaaauuggauggauggagggcgggcagcucgcucugggaaacccagcccccaucccucgccacgcaccaauaccgcgauacucuacuuaccuuaugcuguugcucauugugucauaugccagugcu

SEQ ID NO: 11337 - RNA, 1680 nt, Artificial Sequence
  derived and/or modified CDS sequence (opt3) from RVFV(Kenya 57 (Rintoul))__DQ380192.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagauuaaacgagaacugaagucauuugauaucagucagugcccuaaaauugggggacauggcagcaagaagugcacgggugacgccgcguucuguucugccuacgagugcacugcacaguaugcuaaugccuacuguucccacgcuaacgggucaggaaucgugcaaauacaggucagcggcguuuggaaaaagccacuuugcgugggcuaugaacguguaguggucaaaagagagcugagugccaagcccauccagaggguggaaccuuguaccacaugcauuacuaaaugugagccacacggguugguugugcggucuaccggauuuaagaucuccagcgcagucgccugcgcuucggguguguguguaacaggcucucaaucccccucaaccgagauuacgcucaaguacccggggaucagucagagcuccggaggcgauauagguguucauauggcgcacgacgaucagucugugagcucaaaaauugucgcacauugcccuccccaggacccaugucuggugcacgggugcaucgucugcgcccauggcuuaauuaauuaucaaugucacacugcucugagugccuucgugguuguguucguauuuuccagcgucgcaaucaucugccucgccauucuuuacaaggugcugaaauguuugaagauagcuccucgcaaaguucuaaacccccugauguggaucacagccuucauuagauggguguauaagaagauggucgcaaggguggcggauaauaucaaccagguaaaucgggaaauaggauggauggagggcgggcagcucgugcugggaaacccagcucccauuccucgccacgccccaaucccgcgauacucuaccuaccuuaugcuguugcucaucguuucauaugcaagugcc

SEQ ID NO: 11338 - RNA, 1680 nt, Artificial Sequence
  derived and/or modified CDS sequence (opt3) from RVFV(Sudan 2V-2007)__JQ820490.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccauguagugugcacgggugcauugucugcgcccauggccugaucaauuaucaaugucacacagcuuuauccgccuucgugguuguguucguauuuagcucuauugcaaucaucugccuggccauucucuaccgcguccuuaagugucugaaaauagcuccuagaaagguguugaacccccuaauguggaucaccgccuucauuagguggguuuauaaaaagaugguggcacgggucgcggauaauaucaaccaggugaaucgcgaaauaggauggauggagggcgggcagcugguacucggaaacccagcucccauuccucgacacgccccaaucccgagauacucaacuuaccugaugcuucuguugaucgugagucaugcaagcgcc

SEQ ID NO: 11339 - RNA, 1680 nt, Artificial Sequence
  derived and/or modified CDS sequence (opt3) from RVFV(200803167)__JF311382.1__Gn
auggccggcaucgcuaugaccgugcugcccgcacucgccgucuucgcgcuugcuccuguuguguuugccgaggaccugcacuugagaaacaggccagggaagggacauaauuacauugaugguaugacacaggaagacgcaacuugcaaaccgguaacguaugccggcgcuuguagcuccuucgauguguuacuggagaaggggaaauuuccccuauuccaaucuuacgcacaccaucggacccuccuggaagccguccacgacacaauaaucgcuaaggccgauccuccaucaugcgaccuucagagugcgcauggaaaccccuguaugaaagagaagcuggugaugaagacucacugcccuaaugauuaucagagcgcacacuacuugaacaaugacggcaaaauggccuccguuaaguguccacccaaauaugaacucaccgaggauugcaacuuuugucgccagaugacaggugcuucucugaagaaagggucguacccucugcaagaccucuucugccagucaagcgaggaugacggaaguaaguuaaagaccaaaaugaagggcgugugugaagucggcgugcaggcccugaaaaagugcgaugggcagcuuuccacugcacaugagguaguuccauuugcuguguucaaaaauucuaagaaagucuauuuggacaagcuggaccuaaagacagaagagaaccuccugccggauagcuuuguguguuucgagcacaaaggacaauacaaggguaccauggacuccggccagacgaaacgagaacuuaagucauuugauauuagucagugccccaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccucugugcgugggcuaugaacguguaguggucaaaagagaguugagugccaagccaauacagaggguggaacccuguacaacuugcaucaccaaaugugagccucacgggcucguugugcggucuacaggauuuaagauuuccagcgcagucgccugcgcuucggguguguguguaaccggcucucaauccccaucaacggagaucgcgcugaaguaccccgggauuagucagagcuccggaggcgauaucgguguucauauggcacacgacgaucagucugugagcucaaaaauagucgcccauugcccgccucaggaccccuguuuagugcacgggugcauugucugcgcucauggccugaucaauuaucaaugucacacugcccucagugcauucgugguuguguucguauuuuccagcauugccaucaucugccuugcuauucuguaccgcgucuugaagugucuaaaaauagccccaagaaaggugcugaacccucucauguggaucacagcauucauuagguggguuuauaaaaagaugguggcgcgggucgcugauaauaucaaccaggugaaucgcgaaauaggauggauggagggcgggcagcugguacuuggaaaccccgccccaauuccccgacacgcaccuaucccaagauacucuaccuaccugauguugcuccugaucgugucauaugccagugcu

SEQ ID NO: 11340 - RNA, 1680 nt, Artificial Sequence
  derived and/or modified CDS sequence (opt3) from RVFV(KEN/Gar-008/06)__HM586965.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagccguguuuggaaaaagccacuuugcgugggcuaugaaagaguaguggucaaaagggagcugagugccaagcccauacagcggguggaaccuuguacaacuugcaucaccaaaugugagccacacggcuugguugugcgcucuacaggguuuaagauuuccagcgcagucgccugcgcuucgggaguguguguaaccgguucucaaucccccucaacggagaucacucucaaguacccgggcauuagucagagcuccgggggagauaucggcguucauauggcgcacgacgaucagucugugagcucaaaaauagucgcacauugcccuccccaggacccaugucuggugcacgguugcauugucugcgcccauggguuaaucaauuaucaaugucacacagcucugagugccuucgugguuauuuucguguuuuccagcaccgcaaucaucugccucgccguacuuuacagaguccugaaguguuugaaaauugcuccuaggaaggugcuaaacccccugauguggauaacugccuucauccgguggguuuauaaaaagaugguggcacgcgucgcggauaauauuaaccaggugaaucgagaaaucggcuggauggagggaggccagcucgcucuggggaacccagcccccauaccuagacacgcaccaauuccgagguacucuacauaccuuaugcuguugcucaucguaucauaugccagugcu

SEQ ID NO: 11341 - RNA, 1680 nt, Artificial Sequence
  derived and/or modified CDS sequence (opt3) from RVFV(ANK-6087)__DQ380216.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaaacuggacuccggccagaccaagcgagaacuuaaaucauuugauauuagucagugcccuaagaucgggggacauggcagcaagaaaugcacgggugacgccgcguucuguucugccuacgagugcacugcacaguaugcuaaugccuacuguucccacgcuaacgggucaggaauugugcaaauccaggucagcggcguuuggaagaaaccacugugcgugggcuaugaacguguaguggucaagagagaguugagugccaaacccauacagaggguggaaccuuguaccacaugcaucacuaagugugagccacacgggcucguugugcggucuaccggauuuaagauuuccagcgcagucgccugcgcuucggguguguguguaacaggcucucaaucccccucaaccgagaucacgcugaaauacccggggauuagucagagcuccggaggcgauaucgguguucauauggcgcacgacgaucagucugugagcucaaagauagucgcacauugcccuccccaggacccauguuuagugcacgggugcauugucugcgcccauggccugaucaauuaucaaugucacacugcucucagugccuucgugguuguguucguauuuuccagcauugcaaucaucugccuugccauucuguaccgcgucuugaaaugucuaaagauagcuccuagaaaagugcugaacccccucauguggaucacagccuucauuagguggguuuaucggaagaugguggcacgcgucgcggauaauaucaaccaggugaaucgagaaauaggauggauggagggcgggcagcugguacuuggaaacccagcucccauuccuagacacgugccaaucccgagguacucuaccuaccugauguugcuccugaucguuucauaugccagugca

SEQ ID NO: 11342 - RNA, 1680 nt, Artificial Sequence
  derived and/or modified CDS sequence (opt3) from RVFV(763/70)__DQ380188.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugguuugaccgaagauugcaacuuuugucgccagaugacaggggcuucucucaagaaaggaucguacccacugcaagaccuguucugccagucaagcgaggaugacggcaguaagcucaagaccaaaaugaagggcgugugugaggucggggugcaggccuuaaagaagugcgauggacagcuguccacugcacaugaaguaguuccguuugcuguguucaaaaauucuaagaaagucuaucuugacaaguuggaccugaagacagaggaaaaccuacuccccgauagcuuuguguguuucgagcacaaaggucaauacaagggcaccauggacuccgggcagacgaaacgagagcugaagucauuugauauuagucagugcccuaaaaucggaggccaugguagcaagaagugcacuggggacgccgcguucuguucugccuacgaaugcaccgcacaguaugcuaaugccuacuguucccacgcuaacggaucaggcauugugcaaauccaggucagcggcguuuggaaaaagccacuuugcgugggguaugagcguguaguggucaaaagagaacugagugccaagcccauacagaggguggagccuuguacaacuugcaucaccaaaugugaaccacacggauugguugugcggucuacagguuuuaagauuuccagcgcagucgccugcgcuucgggcguguguguaaccgggucucaaucccccucaacggagaucacucucaaguacccgggaauuagucagagcuccggcggugauaucgggguucauauggcgcacgacgaucagucugugagcucaaaaauagucgcacauugcccuccccaggacccaugucuggugcacggcugcauugucugcgcccauggauuaaucaauuaucaaugucacacagcucugagugccuucgugguuguguucguauuuuccagcgucgcaauuaucugccucgccauccuuuacaaggugcugaaauguuugaagauugcuccucgcaaaguucuaaacccccugauguggauaaccgccuucaucagauggguguauaagaagauggucgcaaggguggcggauaauauuaaccagguaaaucgggagaucggcuggauggaagggggacagcucgcucuggguaacccagcccccauaccucgccacgcaccaauuccgcgauacucuacuuaccuuaugcuguugcucaucgugucauaugccagugcu

SEQ ID NO: 11343 - RNA, 1680 nt, Artificial Sequence
  derived and/or modified CDS sequence (opt3) from RVFV(BIME-01)__KX609032.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuguguucguauuuuccagcgucgcaauuaucugccucgccauccuuuacaaggugcugcgcuguuugaaaauugcuccuaagaaaguucuaaacccccugauguggauaaccgccuucaucagauggguguauaagaagauggucgcaaggguggcggauaauauuaaccagguaaaucgggaaaucggauggauggagggcgggcagcucgcucugggaaacccagcccccauaccucgccacgcaccaauuccgcgauacucuacuuaccuuaugcuguugcucaucaucucauaugccagugcu

SEQ ID NO: 11344 - RNA, 1680 nt, Artificial Sequence
  derived and/or modified CDS sequence (opt3) from RVFV(KEN07-KUR340)__EF460404.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcaaauccaggucagcggcguuuggaaaaagccacuuugcgugggcuaugaacguguaguggucaaaagagagcugagugccaagcccauacagaggguggaaccuuguacaacuugcaucaccaaaugugagccacacggguugguugugcggucuacaggauuuaagauuuccagcgcagucgccugcgcuucggguguguguguaaccggcucucaaucccccucaacggagaucacucucaaguacccggggauuagucagagcuccggaggcgauaucgguguucauauggcgcacgacgaucagucugugagcucaaaaauagucgcacauugcccuccccaggacccaugucuggugcacgggugcauugucugcgcccauggcuuaaucaauuaucaaugucacacagcucugagugccuucgugguuauuuucguguuuuccagcaccgcaaucaucugccucgccguacuuuaccgcaugcugaaguguuugaaaauugcuccuagaauaguccuaaacccccugauguggaucacugccuucauuagguggguguauaagaaaaugguugcacggguggcggauaauaucaaccaggucaaucgcgaaauaggauggauggagggcgggcagcucgcucugggaaacccagcccccauuccucgacacgcaccaaucccgagauacucuacauaccuuaugcuguugcucaucgugucauaugccagugcu

SEQ ID NO: 11345 - RNA, 1680 nt, Artificial Sequence
  derived and/or modified CDS sequence (opt3) from RVFV(SA-51 (Van Wyck))__DQ380195.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacguggcagcaagaagugcacuggugacgccgcguucuguucugccuacgagugcaccgcacaguaugcuaaugccuacuguucccaugcuaacgggucaggaauugugcaaauccaggucagcggcguuuggaaaaagccacuuugcgugggcuaugaaagaguaguggucaaaagggagcugagugccaagcccauacagcggguggaaccuuguacaacuugcaucaccaaaugugagccacacggguugguugugcgcucuacaggauuuaagauuuccagcgcagucgccugcgcuucggguguguguguaaccggcucucaaucccccucaacggagaucacucucaaguacccggggauuagucagagcuccggaggcgauaucgguguucacauggcgcaugacgaucagucugugagcucaaaaauagucgcacacugcccuccccaggacccaugucuggugcaugggugcauugucugcgcccacggcuuaaucaauuaucaaugucauacagcucugagugccuucgugguuguguucguauuuuccagcgucgcaauuaucugccucgccauccuuuacaaggugcugaaauguuugaagauugcuccuagaaaaguucuaaacccccugauguggauaaccgccuucaucagguggguguauaagaagauggucgcacggguggcggauaauauuaaccagguaaaucgcgaaaucggauggauggagggcgggcagcucgcucugggaaacccagcccccauaccucgacacgcaccaauuccgagauacucuacuuaccuuaugcuguugcucaucgugucauaugccagugcu

SEQ ID NO: 11346 - RNA, 1680 nt, Artificial Sequence
  derived and/or modified CDS sequence (opt3) from RVFV(Lunyo)__KU167026.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccaugguguccggccagacgaaacgagaacugaagucauuugacauuagucagugcccuaaaaucgggggacauggcagcaagaagugcacuggugaugccgcguucuguucugccuacgagugcaccgcacaguaugcuaaugccuacuguucccacgcuaacgggucaggaauuguccaaauccagguuagcggcguguggaaaaagccacuuugcguaggcuaugaacguguggucgugaaaagagagcugagugccaagcccauacagaggguugaaccuuguacaacuugcaucaccaaaugugagccacacggguuggugguccggucuacaggauuuaagauuuccagcgcaguggccugcgcuucggguguauguguuaccggcucucaaucccccucaacggagaucacucucaaguacccggggauuagucagagcuccggaggcgacaucggugugcauauggcgcacgaugaccagucugucagcucaaaaauaguggcacauugcccuccccaggauccaugucugguccacgggugcauugugugcgcccauggcuuaaucaauuaucaaugucacacagcucugagugccuucguugugguauucgucuuuuccagcguggcaauuaucugccucgccauccuuuacaagguucugaaauguuugaagauugcuccucgcaaagugcuaaacccccugauguggauaaccgccuucaucagaugggucuauaagaagaugguggcaaggguagcggacaauauuaaccaggugaaucgggaaaucggauggauggagggcgggcagcucgcucugggaaacccagcccccauaccucgccacgcaccaauuccgcgauacucuacuuaccuuaugcuguugcucaucguuucauaugccagugcu

SEQ ID NO: 11347 - RNA, 1680 nt, Artificial Sequence
  derived and/or modified CDS sequence (opt3) from RVFV(2269/74)__DQ380222.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaacauaaggguaccauggacuccggccagacgaaacgagaacugaagucauuugauauuagucagugcccuaaaaucgggggacacggcagcaagaagugcacuggugacgccgcguucuguucugccuacgagugcaccgcacaguacgcuaaugccuauuguucccacgcuaacgggucaggaauugugcaaauccaggucagcggcguuuggaaaaagccacuuugcgugggcuacgaacguguaguggucaaaagagagcugagugccaagcccauacagaggguggaaccuuguacaacuugcaucaccaaaugugagccacauggguugguugugcggucuacaggauuuaagauuuccagcgcagucgccugcgcuucggguguguguguaaccggcucucaaucccccucaacggagaucacucucaaguauccggggauuagucagagcuccggaggcgauaucgguguucacauggcgcaugacgaucagucugugagcucaaaaauagucgcacacugcccuccccaggacccaugucuggugcaugggugcauugucugcgcccacggcuuaaucaauuaccaaugucacacagcucugagugccuucgugguuguguucguauuuuccagcgucgcaauuaucugccucgccauccuuuauaaggugcugaaauguuugaagauugcuccuaaaaagguucuaaacccccugauguggauaaccgccuucauccgcuggguguacaagaaaauggucgcaagaguggcggauaauauuaaccagguaaauagggaaaucggauggauggagggcgggcagcucgcucugggaaacccagcccccauaccucggcaugcaccaauuccgcgcuauucuacuuaccuuaugcuguugcucaucgugucauacgccagugcu

SEQ ID NO: 11348 - RNA, 1680 nt, Artificial Sequence
  derived and/or modified CDS sequence (opt3) from RVFV(MgH824)__DQ380210.1__Gn
auggccggcaucgcuaugaccgugcugcccgcacucgccgucuucgcgcuugcuccuguuguguuugccgaggacccacaccugagaaacaggccggggaagggauacaauuauauugaugguaugacacaggaagacgcaacuugcaaacccguaacguacgccggcgcuuguagcuccuucgauguguuguuagagaaggggaaauuuccucuguuccaaucuuaugcacaucaccggacccuacucgaagccguccaugacacaauaaucgcuaaggccgauccacccucaugcgaccugcagagugcgcacggaaacccuuguaugaaagagaaacuugugaugaagacucauugcccaaaugauuaccagagcgcacacuaucugaacaaugacggcaaaauggccuccguuaagugucccccuaaauacgaauugaccgaggauugcaacuuuugucgccagaugacaggugcuucucucaagaaagggucguauccacugcaagaccuguucugccagucaagcgaggaugacggaaguaagcucaagaccaaaaugaagggcgugugugaagucggcgugcaggccuuaaagaagugcgaugggcagcuguccacugcacacgagguaguuccguuugcuguguucaaaaauucuaagaaagucuaccuugacaaguuggaccugaagacagaagagaaccuacuccccgauagcuuuguguguuucgagcgaaaaggacaauacaaggguaccauggacuccggccagacgaaacgugaacugaagucauuugauauuagucagugcccuaaaaucgggggacauggcagcaagaagugcacuggugacgccgcguucuguucugccuaugagugcaccacacaguacgcaaaugcuuauuguucccacgccaacgggucaggagugguccaaauucagguuagcggcguguggaaaaagccacuuugcguaggcuacgaaagaguggucgugaaaagggagcugagugcuaagcccauccagcggguugaaccuuguacuaccugcauaacaaaaugugagccacauggguuggugguccgcucuaccggauuuaagaucuccagcgccguggcaugcgccucggguguauguguuacgggcucucaaucccccucaacugagauuacacucaaguauccggggaucagucagagcuccggaggcgauauuggugugcacauggcucacgacgaucagucugucagcucaaaaaucguggcgcauugcccuccccaggacccaugucugguccacgggugcauagugugcgcacauggcuuaauuaauuaccaaugucacaccgcccugagugcuuucguugugguauucgucuuuuccagcaucgccauuaucugccucgcaauccuuuauagagugcugaaguguuugaaaauugccccuaggaagguucuaaacccccugauguggauaacugcuuucauccgguggauuuacaaaaagaugguggcccgcgucgcagauaauaucaaccaggugaaucgagaaauaggauggauggagggcgggcagcucguacugggaaacccagcgcccauuccuagacaugcuccaaucccgagguacucuacauaucuuaugcuguugcucaucgugucauacgccagugca

SEQ ID NO: 11349 - RNA, 1680 nt, Artificial Sequence
  derived and/or modified CDS sequence (opt3) from RVFV__JQ068143.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauugacuccggccagacgaaacgagaacugaagucauuugauaucagucagugcccuaaaauugggggacauggcagcaagaagugcacuggugacgccgcguucuguucugccuacgagugcaccgcacaguaugcuaaugccuacuguucccacgcuaacgggucaggaaucgugcaaauacaggucagcggcguuuggaaaaagccacuuugcgugggcuaugaacguguaguggucaaaagagagcugagugccaagcccauccagaggguggaaccuuguacaacuugcauuaccaaaugugagccacacggguugguugugcggucuacaggauuuaagaucuccagcgcagucgccugcgcuucggguguguguguaaccggcucucaaucccccucaacggagauuacucucaaguacccggggaucagucagagcuccggaggcgauauagguguucauauggcgcacgacgaucagucugugagcucaaaaauugucgcacauugcccuccccaggacccaugucuggugcacgggugcaucgucugcgcccauggcuuaauuaauuaucaaugucacacagcucugagugccuucgugguuguguucguauuuuccagcgucgcaaucaucugccucgccauucuuuacaaggugcugcgcuguuugaaaauagcuccuaagaaaguucuaaacccccugauguggaucaccgccuucauuagauggguguauaagaagauggucgcaaggguggcggauaauaucaaccagguaaaucgggaaauaggauggauggagggcgggcagcucgcucugggaaacccagcccccauuccucgccacgcaccaaucccgcgauacucuacuuaccuuaugcuguugcucaucauuucauaugccagugcu

SEQ ID NO: 11350 - RNA, 1680 nt, Artificial Sequence
  derived and/or modified CDS sequence (opt3) from RVFV(RVFBJ01/2016)__KX785331.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaacaugaauugaccgaggauugcaacuuuugucgccagaugacaggugcuucucucaagaaagggucguauccacugcaagaccuguucugccagucaagcgaggaugacggaaguaagcucaagaccaaaaugaagggcgugugugaagucggcgugcaggccuuaaagaagugcgaugggcagcuguccacugcacacgagguaguuccguuugcuguguucaaaaauucuaagaaagucuaccuugacaaguuggaccugaagacagaagagaaccuacuccccgauagcuuuguguguuucgagcauaaaggacaauauaaggguaccauggacuccggccagacgaaacgagaacugaagucauuugauauuagucagugcccuaaaaucgggggacacggcagcaagaagugcacuggugacgccgcguucuguucugccuacgagugcaccgcacaguacgcuaaugccuauuguucccacgcuaacgggucaggaauugugcaaauccaggucagcggcguuuggaaaaagccacuuugcgugggcuacgaacguguaguggucaaaagagagcugagugccaagcccauacagaggguggaaccuuguacaacuugcaucaccaaaugugagccacauggguugguugugcggucuacaggauuuaagauuuccagcgcagucgccugcgcuucggguguguguguaaccggcucucaaucccccucaacggagaucacucucaaguauccggggauuagucagagcuccggaggcgauaucgguguucacauggcgcaugacgaucagucugugagcucaaaaauagucgcacacugcccuccccaggacccaugucuggugcaugggugcauugucugcgcccacggcuuaaucaauuaccaaugucacacagcucugagugccuucgugguuguguucguauuuuccagcgucgcaauuaucugccucgccauccuuuauaaggugcugcgcuguuugaaaauugcuccuaagaaaguucuaaacccccugauguggauaaccgccuucaucagauggguguacaagaagauggucgcaaggguggcggauaauauuaaccagguaaaucgggaaaucggauggauggagggcgggcagcucgcucugggaaacccagcccccauaccucgccaugcaccaauuccgcgauauucuacuuaccuuaugcuguugcucaucaucucauacgccagugcu

SEQ ID NO: 11351 - RNA, 1680 nt, Artificial Sequence
  derived and/or modified CDS sequence (opt3) from RVFV(KEN/Kil-006/07)__HM586966.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcggauggaaacaaauguaugaaggagaaacuugugaugaagacucauugcccuaaugacuaucagagcgcacacuaccugaacaaugauggcaagauggccuccguuaaauguccacccaaguaugaauugaccgaggacugcaacuuuugucgccagaugacaggugcuucucucaaaaaggggucguacccucugcaagaucuguucugccagucaagcgaggacgauggaaguaagcucaaaaccaagaugaaaggcgugugugaagucggcgugcaggccuuaaagaaaugcgacgggcagcuguccacugcacacgagguaguuccauuugcuguguucaaaaauucuaagaaggucuaucuugacaaguuggaucugaaaacagaagagaaccuacucccggacagcuuuguguguuucgagcauaagggacaauacaaagguaccauggauuccggccagacgaagcgagaacugaaaucauuugacauuagucagugccccaagaucgggggacacggcagcaagaaaugcacuggugaugccgcguucuguucugccuacgagugcaccgcacaguaugcuaaugccuacuguucccaugcuaacgggucaggaauugugcaaauccaggucagcggcguuuggaagaaaccucuuugcgugggcuaugaacguguaguggucaagagagagcugagugccaaaccaauacagaggguggaacccuguacaacuugcaucaccaagugugagccucacggguugguugugcggucuacaggauuuaagauuuccagcgcagucgccugcgcuucggguguguguguaaccggcucucaauccccaucaacggagaucacucucaaauaccccgggauuagucagagcuccggaggcgacaucgguguucacauggcgcaugaugaccagucugugagcucaaagauagucgcacacugcccgccucaggaucccugucuggugcaugggugcauugucugcgcccacggcuuaaucaauuaucaaugucauacagcucugagugccuucgugguuauuuucguguuuuccagcaccgcaaucaucugccucgccguacuuuaccgcguccugaaauguuugaagauugcuccaagaaaagugcuaaacccucugauguggauaacugccuucaucagguggguuuauaagaagaugguggcacgggucgcggacaauauuaaccaggugaaucgcgaaaucggauggauggagggcgggcagcucgcucugggaaaccccgccccaauaccccgacacgcaccuauuccaagauacucuacauaccuuaugcuguugcucaucguaucauaugccagugcu

SEQ ID NO: 11352 - RNA, 1680 nt, Artificial Sequence
  derived and/or modified CDS sequence (opt3) from RVFV(SA-75)__DQ380189.1__Gn
auggccagaaucgcuaugaccgugcugcccgcacucgccgucuucgcgcuugcuccuguuguguuugccgaggacccacaccugaggaaccggccgggcaaggggcauaauuacauugauggaaugacacaggaagacgcaacuugcaaacccguaacguaugccggugcuuguagcuccuucgauguguuguuagagaagggcaaauuuccucuguuccaaucuuacgcacaccaucgcacccuacucgaagccguccacgacacaauaaucgcuaaggccgauccacccucaugcgaccugcagagugcgcaugggaacccuuguaugaaagagaaacuugugaugaagacucacugcccaaaugauuaucagagcgcacacuaccugaacaaugacggaaaaauggccuccguuaagugucccccuaaauaugaauugaccgaggauugcaacuuuugucgacagaugacaggcgcuucucucaagaaagguucguacccacugcaagaccuguucugccagucaagcgaggaugacgggaguaagcucaagaccaaaaugaagggagugugugaagucggcgugcaggccuuaaagaagugcgauggccagcuguccacugcacaugagguaguuccguuugcuguguucaaaaauucuaagaaagucuaucuugacaaguuggaccugaagacagaagagaaccuacuccccgauagcuuuguguguuucgagcacaaagggcaauacaagggaaccauggacuccggucagacgaaacgugaacugaagucauuugauauuagucagugcccuaaaaucggcgggcauggaagcaagaagugcacuggcgacgccgcguucuguucugccuacgagugcaccgcacaguaugcuaaugccuacuguucccacgcuaacgguucaggggugguccaaauucagguuagcggaguguggaaaaagccacuuugcguaggcuaugaaagaguggucgugaaaagggagcugagugccaagcccauccagcggguugaaccuuguacaacuugcauaaccaaaugugagccacacggcuuggugguccgcucuacaggguuuaagaucuccagcgcaguggccugcgcuucgggaguauguguuaccgguucucaaucccccucaacggagauuacucucaaguacccgggcaucagucagagcuccgggggagauauuggcgugcauauggcgcacgacgaucagucugucagcucaaaaaucguggcacauugcccuccccaggacccaugucugguccacgguugcauagugugcgcccauggguuaauuaauuaucaaugucacacagcucugagugccuucguugugguauucgucuuuuccagcguggcaaucauuugccucgccauccuuuacaagguucugaaauguuugaagaucgcuccuagaaaagugcuaaacccccugauguggauuaccgucuucauaagguggguguauaagaagaugguagcccggguggcagauaauaucaaccagguuaaucgcgaaauuggcuggauggagggaggccagcucgcgcuggggaacccagcucccaucccucgacacgccccaauaccgagauacucuacuuaccuuaugcuguugcucauugucucauaugcaagugcc

SEQ ID NO: 11353 - RNA, 1680 nt, Artificial Sequence
  derived and/or modified CDS sequence (opt3) from RVFV(35/74)__JF784387.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggagugguccaaauucagguuagcggcguguggaaaaagccacuuugcguaggcuaugaacguguggucgugaaaagagagcugagugccaagcccauccagaggguugaaccuuguacaacuugcauaaccaaaugugagccacacggguuggugguccggucuacaggauuuaagaucuccagcgcaguggccugcgcuucggguguauguguuaccggcucucaaucccccucaacggagauuacucucaaguacccggggaucagucagagcuccggaggcgauauuggugugcauauggcgcacgacgaucagucugucagcucaaaaaucguggcacauugcccuccccaggacccaugucugguccacgggugcauagugugcgcccauggcuuaauuaauuaucaaugucacacagcucugagugccuucguugugguauucgucuuuuccagcguggcaaucauuugccucgccauccuuuacaagguucugaaauguuugaagaucgcuccucgcaaagugcuagauccccugauguggauuaccgucuucauaagauggguguauaagaagaugguagccaggguggcagacaacaucaaucagguuaaccgggaaauuggauggauggagggcgggcagcucgcgcugggaaauccagcucccaucccucgccacgccccaauaccgcgauacucuacuuaccuuaugcuguugcucauugucucauaugcaagugcc

SEQ ID NO: 11354 - RNA, 1680 nt, Artificial Sequence
  derived and/or modified CDS sequence (opt3) from RVFV__M11157.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaagauggccuccguuaagugucccccuaaauaugguuugaccgaagauugcaacuuuugucgccagaugacaggggcuucucucaagaaaggaucguacccacugcaagaccuguucugccagucaagcgaggaugacggcaguaagcucaagaccaaaaugaagggcgugugugaggucggggugcaggcccauaaaaagugcgauggacaguuauccacugcacacgaaguaguuccguuugcuguguucaaaaauucuaagaaagucuaucuggacaaacuugacuugaagacagaggaaaaccugcuacccgauagcuuuguguguuucgagcauaagggucaauacaagggcaccauggacuccgggcagacgaaacgagagcucaagucauuugauauuagucagugcccuaaaaucggaggccacgguagcaagaagugcacuggggacgccgcguucuguucugccuacgaaugcaccgcacaguaugcuaaugccuacuguucccacgcuaacggaucaggcauugugcaaauccaggucagcggcguuuggaaaaagccacugugcgugggguaugagcguguaguggucaaaagagaacuuagugccaagcccauacagaggguggagccuuguacaacuugcaucaccaaaugugaaccacauggacugguugugcggucuacagguuuuaagauuuccagcgcagucgccugcgcuucgggcguguguguaaccgggucucaaucccccucaacggagaucacuuugaaguacccgggaauuagucagagcuccggcggugauaucgggguucacauggcgcaugacgaucagucugugagcucaaaaauagucgcacacugcccuccccaggacccaugucucgugcauggcugcauugucugcgcccacggacugaucaauuaucaaugucacacagcuuuaagugccuucgugguuguguucguauuuuccagcauugcaaucaucugccuggccguccucuaccgcgugcuuaagugucugaaaauugcuccuagaaagguuuugaacccccuaauguggauaaccgccuucaucagguggauuuauaaaaagaugguggcacgggucgcgcauaauaucaaccaggugaaucgcgagauaggcuggauggaagggggacagcugguacucgguaacccagcucccauuccucgacacgccccaaucccgagauacucuacuuaccugaugcuucuguugaucgugucauaugcaagugcc

SEQ ID NO: 11355 - RNA, 1680 nt, Artificial Sequence
  derived and/or modified CDS sequence (opt3) from RVFV(KEN/Bar-035/07)__HM586969.1__Gn
auggccggcaucgcuaugaccgugcugcccgcacucgccgucuucgcgcuugcuccuguuguguuugccgaggacccacaccugagaaacaggccggggaagggacauaauuacauugauggucgguugcaggaagacgcaacaugcaaacccguaacuuaugccggcgcuuguagcuccuucgauguguuacuggagaaggggaaauuuccucuauuccaaucuuacgcacaccaucgcacgcuccuggaagccguccacgacaccauaaucgcuaaggccgauccacccucaugcgaccuucagagugcggauggaaacaaauguaugaaggagaagcuggugaugaaaacacauugcccuaaugacuaucagagcgcacacuacuugaacaaugauggcaagauggccuccguuaaauguccacccaaguaugaacucacugaggacugcaacuuuugucgacagaugaccggugcuucucugaaaaaggggucguacccucugcaagaucucuucugccagucaagcgaggacgauggaaguaaguuaaaaacaaagaugaaaggcgugugugaagucggcgugcaggcccugaagaaaugcgacgggcagcuuuccaccgcacacgagguaguuccauuugcuguguucaaaaauucuaagaaggucuauuuggacaagcuggaucuaaaaacugaagagaaccuccugccggacagcuuuguguguuucgagcauaagggacaauacaaagguacaauggauuccggccagaccaagcgugaacuuaaaucauuugacauuagucagugccccaagaucgggggacacggcagcaagaaaugcacgggugaugccgcguucuguucugccuacgagugcacugcacaguaugcuaaugccuacuguucccaugcuaacgggucaggaauugugcaaauccaggucagcggcguuuggaagaaaccucugugcgugggcuaugaaagaguaguggucaagagggaguugagugccaaaccaauacagcggguggaacccuguaccacaugcaucacuaagugugagccucacgggcucguugugcgcucuaccggauuuaagauuuccagcgcagucgccugcgcuucggguguguguguaacaggcucucaauccccaucaaccgagaucacgcugaaauaccccgggauuagucagagcuccggaggcgacaucgguguucacauggcgcaugaugaccagucugugagcucaaagauagucgcacacugcccgccucaggaucccuguuuagugcaugggugcauugucugcgcccacggccugaucaauuaucaaugucauacugcucucagugccuucgugguuauuuucguguuuuccagcacagcaaucaucugccuugccguacuguacagagucuugaaaugucuaaagauugcuccaaggaaagugcugaacccucucauguggauaaccgccuucauccgguggguuuauaagaagaugguggcacgcgucgcggacaauauuaaccaggugaaucgagaaaucggauggauggagggcgggcagcuggcucuuggaaaccccgccccaauacccagacacgcaccuauuccaagguacucuacuuaccugauguugcuccugaucguaucauaugccagugcu

SEQ ID NO: 11356 - RNA, 1680 nt, Artificial Sequence
  derived and/or modified CDS sequence (opt3) from RVFV(Kenya 56 (IB8))__DQ380190.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacagggcgacgcaacuugcaaacccguaacguaugccggggcuuguagcuccuucgauguguuguuagaaaagggaaaauuuccucuguuccaaucuuacgcacaccaucggacccuacucgaggccguccacgacacaauaaucgcuaaggccgauccacccucaugcgaccugcagagugcgcauggcaacccuuguaugaaagaaaaacuugugaugaagacucacugcccaaaggauuaucagagcgcacacuaccugaauaacgacgguaagauggccuccguuaaaugucccccuaaguaugaguugaccgaagauugcaauuuuugucgccagaugacaggggcuucucucaaaaagggaucguacccacugcaagaccuguucugccagucaagcgaggaugacggcaguaagcucaaaaccaagaugaaaggcgugugugaggucggggugcaggccuuaaagaaaugcgauggacagcuguccacugcacaugaaguaguuccguuugcuguguucaagaacucuaaaaaggucuaucuugacaaguuggaccugaaaacagaggaaaaucuacuccccgauagcuuuguguguuucgagcacaagggucaauacaaaggcaccauggacuccgggcagacgaagcgagagcugaaaucauuugauauuagucagugcccuaagaucggaggccaugguagcaagaaaugcacuggggacgccgcguucuguucugccuacgaaugcaccgcacaguaugcuaacgccuacuguucccacgcuaauggaucaggcauugugcaaauccaggucagcggcguuuggaagcguccacuuugcgugggguaugagagaguaguggucaaaagggaacugagugccaagcccauacagcggguggagccuuguacaacuugcaucaccaaaugugaaccacacggauugguugugcgcucuacagguuuuaagauuuccagcgcagucgccugcgcuucgggcguguguguaaccgggucucaaucccccucaacggagaucacucucaaguacccgggaaugagucagagcuccggcggugauauugggguucauauggcgcacgacgaucagucugugagcucaaaaaucgucgcacauugcccuccccaggacccaugucuggugcacggcugcauagucugcgcccauggauuaauuaacuaucaaugucacacagcucugagugccuucgugguuguguucguauuuuccagcgucgcaaucauuugccucgccauccuuuacaaggugcugaaauguuugaagaucgcuccuagaaaaguucuaaauccccugauguggauuaccgccuucauaagguggguguauaagaagauggucgcacggguggcggauaacaucaaucagguaaaccgcgagauuggcuggauggaagggggacagccagcucucgguaaucccgccccuaucccacgacacgcaccgauacccagauacucuacuuaccugaugcuucuguugauugugucauaugccagugcu

SEQ ID NO: 11357 - RNA, 1680 nt, Artificial Sequence
  derived and/or modified CDS sequence (opt3) from RVFV(KEN/Bar-032/07)__HM586968.1__Gn
auggccggcaucgcuaugaccgugcugcccgcacucgccgucuucgcgcuugcuccuguuguguuugccgaggacccacaccugagaaacaggccggggaagggacauaauuacauugauggucgguugcaggaagacgcaacaugcaaacccguaacuuaugccggcgcuuguagcuccuucgauguguuacuggagaaggggaaauuuccucuauuccaaucuuacgcacaccaucgcacgcuccuggaagccguccacgacaccauaaucgcuaaggccgauccacccucaugcgaccuucagagugcggauggaaacaaauguaugaaggagaagcuggugaugaaaacacauugcccuaaugacuaucagagcgcacacuacuugaacaaugauggcaagauggccuccguuaaauguccacccaaguaugaacucacugaggacugcaacuuuugucgacagaugaccggugcuucucugaaaaaggggucguacccucugcaagaucucuucugccagucaagcgaggacgauggaaguaaguuaaaaacaaagaugaaaggcgugugugaagucggcgugcaggcccugaagaaaugcgacgggcagcuuuccaccgcacacgagguaguuccauuugcuguguucaaaaauucuaagaaggucuauuuggacaagcuggaucuaaaaacugaagagaaccuccugccggacagcuuuguguguuucgagcauaagggacaauacaaagguacaauggauuccggccagaccaagcgugaacuuaaaucauuugacauuagucagugccccaagaucgggggacacggcagcaagaaaugcacgggugaugccgcguucuguucugccuacgagugcacugcacaguaugcuaaugccuacuguucccaugcuaacgggucaggaauugugcaaauccaggucagcggcguuuggaagaaaccucugugcgugggcuaugaaagaguaguggucaagagggaguugagugccaaaccaauacagcggguggaacccuguaccacaugcaucacuaagugugagccucacgggcucguugugcgcucuaccggauuuaagauuuccagcgcagucgccugcgcuucggguguguguguaacaggcucucaauccccaucaaccgagaucacgcugaaauaccccgggauuagucagagcuccguuggagacaucggcgugcacauggcgcaugaugaccagucugucagcucaaagauaguggcacacugcccgccucaggaucccuguuuaguccaugguugcauugugugcgcccacgggcugaucaauuaucaaugucauacugcucucagugccuucguugugauuuucguauuuuccagcacagcaaucaucugccuugccguccuguacagaguguugaaaugucuaaagauugcuccaaggaaaguucugaacccucucauguggauaaccgccuucauccgguggguguauaagaagauggucgcacgcguggcggacaauauuaaccagguaaaucgagaaaucggcuggauggagggaggccagcuggcucuugggaaccccgccccaauacccagacacgcaccuauuccaagguacucuacuuaccugauguugcuccugaucgugucauaugccagugcu

SEQ ID NO: 11358 - RNA, 1680 nt, Artificial Sequence
  derived and/or modified CDS sequence (opt3) from RVFV(Beijing-01)__KX611606.1__Gn
auggccggcaucgcuaugaccgugcugcccgcacucgccgucuucgcgcuugcuccuguuguguuugccgaggacccacaccugagaaacaggccggggaagggacauaauuacauugaugguguaacacaggaagacgcaacuugcaaacccgugacguaugccggcgcuuguagcuccuucgaugucuuguuagagaaggggaaauuuccucuguuccaaucuuacgcacaccaucggacccuacucgaagccgugcacgacacaauaaucgcuaaggccgauccacccucaugcgaccugcagagugcgcauggaaacccuuguaugaaagagaaacuuguuaugaagacucacugcccaaaugauuaucagagcgcacacuaccugaacaaugacggcaaaauggccuccgugaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgucugugaagugggcguacaggccuuaaagaagugcgaugggcgacuguccacugcacaugagguugugccguuugcugucuucaaaaauucuaagaaaguguaucuugacaaguuggaccugaagacagaagagaaccuacuccccgauagcuuuguguguuucgagcacaaaggacaguacaaggguaccauggacuccggccaaacgaaacgugaacugaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauuguccagauccaaguuagcggcguguggaaaaagccacuuugcguaggcuaugaaagaguggucgugaaaagggagcugagugccaagcccauacagcggguugaaccuuguacaacuugcaucaccaaaugugagccacacggguuggugguccgcucuacaggauuuaagauuuccagcgcaguggccugcgcuucggguguauguguuaccggcucucagucccccucaacggagaucacucucaaguacccggggauuagucaaagcuccggaggcgauaucggugugcauauggcgcacgacgaucagucugucagcucaaaaauaguguucgacugcccuccccaggauccaugucugguccaugggugcauugugugcgcacacggcuuaaucaauuaucagugucauacagcccugagugcuuucguugugguauuugucuucuccagcguggccauuaucugccucgcaauccuuuacaagguucugagauguuugaaaauugccccuaagaaagugcuaaacccccugauguggauaaccgcuuuuaucaggugggucuauaagaagaugguggcccggguagcagacaauauuaaccaagugaaucgcgaaaucggauggauggagggcgggcagcucgcgcugggaaacccagcucccauaccucgacacgccccaauuccgagauacucuacuuaccuuaugcuguugcucaucaucucauaugcaagugcc

SEQ ID NO: 11359 - RNA, 1680 nt, Artificial Sequence
  derived and/or modified CDS sequence (opt3) from RVFV(Smithburn)__DQ380193.1__Gn
auggccggcaucgcuaugaccguguuccccgcacuggucguuuuugcccucgcgccugugguauucgcugaggacccacaccuuagaaacaggccggggaagggacauaauuacauugaugguaugacacaggaagacgccacuugcaaacccgugacguaugcaggcgccuguagcuccuuugauguccuguuggagaaggggaaauucccuuuauuucaaucuuacgcucaccaucggacccugcuagaagcagugcacgacauaaucauugccaaggcugauccacccucaugcaaccuccagagugcccauggaaauccuuguaugaaagagaagcugguuaugaagacauauugcccaaacgacuaccagagcgcgcacuaucuuaauaacgauggcaaaauggcauccgugaagugucccccuaaacacgaacugacugaggacugcaauuucugucgccagaugaccggugccucuuugaaggaggggucguacccacuccaagaucuguuuugccagucaagcgaagacgauggaaguaaacugaagacaaagaugaaaggcgucugugaggugggcguacagguucucaagaaaugcgacgggcaguuauccaccgcucaugaaguggucccguucgccguguuuaagaacucuaaaaagguguaucuggauaaacuugacuugaagacugaggagaaucugcuacccgacagcuucgucuguuuugaacacaagggacaauacaaagguacaauggauuccggccagaucaagcgagagcucaaaucauucgacauuagucagugcccuaagaucgggggacauggcagcaaaaagugcaccggugaugcagcuuuuuguucugccuacgaaugcacggcgcaguaugccaacgcauacuguucccacgcuaaugggucaggaauaguucaaauccaggugagcggcguauggaagaaaccacugugcgugggcuaugagcgugucgugguuaagagagaacuuagugccaaacccauucagaggguggagccuuguacuaccugcaucacaaagugugagccacacgggcuggucgugcggucuacuggauucaaaauuuccagcgcuguagccugcgcaucggguguuugugugaccggcucucaaucccccucaacagaaaucaccuugaaguacccggggauaagucagagcuccggaggcgacauugguguccauauggcccacgaugaccagucugugagcucaaagaucgucgcucauugcccuccccaggauccaugucucgugcacgggugcauuguuugcgcgcauggccugaucaacuaucaaugucacacggcauucagugccuuugugguagucuucguguuuuccagcguugugaucauuugcuuagcuauacuguacaaaguccucaagugucuuaaaaucgccccucgcaaggugcugaaucccuugauguggauuacugcauucaucagauggguauauaaaaagaugguggccaggguugcugacaacauaaaucaggucaaccgggagauuggauggauggaaggcgggcagcuagugcugggaaacccagcccccaucccucgccacgcaccaaucccgcgauacucuacauaccucaugcugcuucugauugugucauaugcgagugcu

SEQ ID NO: 11360 - RNA, 1680 nt, Artificial Sequence
  derived and/or modified CDS sequence (opt3) from RVFV(TAN/Dod-002/07)__HM586971.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucuaagaaagucuaucuugacaaguuggaccugaagacagaagagaaccuacuccccgauagcuuuguguguuucgagcacaaaggacaauacaaggguaccauggacuccggccagacgaaacgagaacugaagucauuugauauuagucagugcccuaaaaucgggggacauggccguaagaagugcacuggugacgccgcguucuguagcgccuacgagugcaccgcacaguaugcuaaugccuacuguucucacgcuaacggguccggaauugugcaaauccaggucucaggcguuuggaaaaagccacuuugcgugggcuaugaaagaguaguggucaaaagggagcugagcgccaagcccauacagcggguggaaccuuguacaacuugcaucaccaaaugugagccacacggguugguugugcgcaguacaggauuuaagauuucuuccgcagucgccugcgcuagcgguguguguguaaccggcucgcaaucucccuccacggagaucacucucaaguacccggggauuucacagaguagcggaggcgauaucgguguucauauggcgcacgacgaucaguccgugucuagcaaaauagucgcacauugcccuccccaggacccaugucuggugcacgggugcauugucugcgcccaggcuuggaucauuucacaauggcauacagccuuaagugcauucgugguuaucuucguguuuuccagcaccgccaucauuugucuggcuguacucuauagaguccuuaagugccugaaaauagccccuaggaagguguugaauccccuaauguggaucacugcauucauucgguggguuuacaaaaagaugguggcgcgcgucgcugauaacaucaaucaggugaaccgagaaauaggcuggauggagggaggccagcuggcccucgggaauccagcacccauuccuagacacgccccaaucccgagguauucuacauaccugaugcuucuguugaucguaucauacgcuagugcc

SEQ ID NO: 11361 - RNA, 1680 nt, Artificial Sequence
  derived and/or modified CDS sequence (opt3) from RVFV(KEN/Gar-004/06)__HM586964.1__Gn
auggccggcaucgcuaugaccgugcugcccgcacucgccgucuucgcgcuugcuccuguuguguuugccgaggacccacaccugagaaacaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcagagugcgcauggaaacccuuguaugaaagagaaacuugugaugaagacucacugcccaaaugauuaucagagcgcacacuaccugaacaaugacggcaaaauggccuccguuaagugucccccuaaauaugaauugaccgaggauugcaacuuuugucgccagaugacaggugcuucucucaagaaagggucguacccacugcaagaccuguucugccagucaagcgaggaugacggaaguaagcucaagaccaaaaugaagggcgugugugaagucggcgugcaggccuuaaagaagugcgaugggcagcuguccacugcacaugagguaguuccguuugcuguguucaaaaauucucaaaaggucuaucuugacaaauuggaccugaagacagaagagaaccuacuccccgauagcuuuguguguuucgagcacaagggacaguacaaagguaccauggacuccggccagacgaagcgagaacugaaaucauuugauauuagucagugcccuaagaucgggggacauggccguaaaaagagaacuggugacgccgcguucugcagcgccuacgaguguaccgcacaauaugcuaaugccuacugcucuagggcuaacggguccggaauugugcagauccaggucucacggguuuggaagaaaccacuuugugugggcuaugaacgcguaguggucaagagagagcugagcgccaaacccauacaaaggguggaaccuugcacaacuuguaucaccaagugcgagccacacggcuugguugugcggaguacaggguuuaaaauuucuuccgcagucgccugugcuagcggagugugcguaaccgguucgcagucucccuccacggagaucacucucaaguacccgggcauuucacagaguagcgggggagauaucggcguucacauggcgcaugacgaucaguccgugucuagcaagauagucgcacacuguccuccccaagacccaugccuggugcaugguuguauugucugcgcccacggguuaaucaauaaccagucacauagugcucuguccgccuucgugguuauuuucguguuuagcucuacagcaaucaucugccucgccguacuuuaucgcguccugaaauguuugaagauugcuccucgaaaagugcuaaauccccugauguggauaaccgccuucaucagauggguuuacaagaaaaugguggcaagggucgcggauaacauuaaucaggugaaccgggaaaucggcuggauggagggaggccagcucgcucuggggaacccagcccccauaccucgucacgcaccaauuccgcgcuauucaacuuaccuuaugcuguugcucaucguaaguuacgccagcgcu

SEQ ID NO: 11362 - RNA, 1521 nt, Artificial Sequence
  derived and/or modified CDS sequence (opt3) from RVFV(ZH-548)__DQ380206.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccugauuagcuauaagccaaugaucgaccagcuagagugcacaacuaaucucauagaucccuucgugguguucgaaagaggaucucugccucagaccaggaacgacaaaacauuugcugccucaaagggcaaucggggcguccaggcguucaguaaggggagcguucaagcagaucuuacccugauguuugacaacuucgagguggauuuuguaggagccgcuguguccugugacgccgcauucuugaaucucacggguugcuacucuuguaacgcuggcgcccgugucugccugucgauuacuagcacagggaccggauccuuaucagcgcauaacaaagacggcagucugcacaucgugcucccaucugaaaaugguacuaaggaucagugucagauucuucacuuuacaguucccgagguggaggaagaguucauguauagcugcgacggggaugaacgcccucuguuggucaaaggcacccuaaucgccaucgacccauuugaugacagaagggaggcaggaggcgaauccacggugguaaacccgaagucagggagcuggaauuucuuugauugguucucuggacugauguccugguuugguggcccccucaaaaccauucugcuuauaugucuguacguugcuuugaguaucggacucuucuuccuguuaauuuaucugggacggacaggccuaagcaagauguggcucgccgcuacuaaaaaggccucu

SEQ ID NO: 11363 - RNA, 1521 nt, Artificial Sequence
  derived and/or modified CDS sequence (opt3) from RVFV(35/74)__JF784387.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccugauuagcuauaagccaaugaucgaccagcuagagugcacaacuaaucucauagaucccuucgugguguucgaaagaggaucucugccucagaccaggaacgacaaaacauuugcugccucaaagggcaaucggggcguccaggcguucaguaaggggagcguucaagcagaucuuacccugauguuugacaacuucgagguggauuuuguaggagccgcuguguccugugacgccgcauucuugaaucucacggguugcuacucuuguaacgcuggcgcccgugucugccugucgauuacuagcacagggaccggaacuuuauccgcgcauaacaaagacggcucacugcacaucgugcucccaagugaaaaugguacaaaggaucagugucagauucuucacuuuaccguucccgagguggaggaagaguucauguauucuugcgacggggaugaacgcccucuguuggucaaaggcacgcuaaucgccaucgacccauuugaugacagaagggaggcaggaggcgaaagcaccgugguaaacccgaaguccgggucauggaauuucuuugauugguucagcggacugaugucuugguuugguggcccccucaaaacaauucugcuuauaugucuguacguugcuuuguccaucggacucuucuuccuguuaauuuaucugggacggacuggccuaaguaagauguggcucgccgcuaccaaaaaggccagc

SEQ ID NO: 11364 - RNA, 1521 nt, Artificial Sequence
  derived and/or modified CDS sequence (opt3) from RVFV(200803162)__JF311377.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccuggugagcuauaagccaaugauugaccagcuagagugcacaacuaaucucaucgaucccuucguggucuucgaaagaggaucucugccucagaccaggaacgacaaaacauuugcugccucaaagggcaaucggggcguucaggcguucaguaaggggagcgugcaagcagaucuuacccugauguuugacaacuucgagguagauuuugugggagccgcugucuccugugacgccgcauucuugaaucucacggguugcuacucuuguaacgcuggcgcccgugugugccugucgauaacuagcacagggaccggaacuuuauccgcgcauaacaaagacggcucacugcacauuguucucccaagugaaaaugguacaaaggaucagugucagauccuucacuuuaccgugcccgaggucgaggaagaguucauguauucuugcgacggggaugaacgcccucuguuggugaaaggcacgcuaauugccaucgacccauuugaugacagaagggaggcaggaggcgaaagcaccguaguuaacccgaaguccgggucauggaauuucuuugauugguucagcggacugaugucuugguuugguggcccccucaaaacaauccugcuuauuugucuguacguggcuuuguccauaggacucuucuuccuguuaaucuaucugggacggacuggccuaaguaagauguggcucgccgcuaccaaaaaggccagc

SEQ ID NO: 11365 - RNA, 1521 nt, Artificial Sequence
  derived and/or modified CDS sequence (opt3) from RVFV(200803166)__JF311381.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccugauuagcuauaagccaaugaucgaccagcuagagugcacaacuaaucucauagaucccuucgugguguucgaaagaggaucucugccucagaccaggaacgacaaaacauuugcugccucaaagggcaaucggggcguccaggcguucaguaaggggagcguucaagcagaucuuacccugauguuugacaacuucgagguggauuuuguaggagccgcuguguccugugacgccgcauucuugaaucucacggguugcuacucuuguaacgcuggcgcccgugucugccugucgauuacuagcacagggaccggaacuuuauccgcgcauaacaaagacggcucacugcacgugguucucccaagugaaaaugguacaaaggaucagugucagauccuucacuuuaccgugcccgaggucgaggaagaguucauguauucuugcgacggggaugaacgcccucuguuggugaaaggcacgcuaauugccaucgacccauuugaugacagaagggaggcaggaggcgaaagcaccguaguuaacccgaaguccgggucauggaauuucuuugauugguucagcggacugaugucuugguuugguggcccccucaaaacaauccugcuuauuugucuguacguggcuuuguccauaggacucuucuuccuguuaaucuaucugggacggacuggccuaaguaagauguggcucgccgcuaccaaaaaggccagc

SEQ ID NO: 11366 - RNA, 1521 nt, Artificial Sequence
  derived and/or modified CDS sequence (opt3) from RVFV(SA-51 (Van Wyck))__DQ380195.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaguaacggauuucgacggguccguuucaacuaucgaucugggagcaagcaguucuagguuuaccaauugggguuccgugagccucucguuagacgccgagggcauuucuggguccaacucauucaguuuuaucgaaagcccaggaaaaggcuacgcuauagucgaugagccguucuccgaaaucccccggcaagguuuucugggggagauucgcugcaauucugagagcucagugcuuagugcacacgaauccuguuugcgagccccuaaccugaucagcuauaagccaaugauugaccagcuagagugcacaacuaaucucaucgaucccuucguggucuucgaaagaggaucucugccucagaccaggaacgacaaaacauuugcugccucaaagggcaaucggggcguucaggcguucaguaaggggagcgugcaagcagaucuuacccugauguuugacaacuucgagguagauuuugugggagccgcugucuccugugacgccgcauucuugaaucucacggguugcuacucuuguaacgcuggcgcccgugugugccugucgauaacuagcacagggaccggaacuuuauccgcgcauaacaaagacggcucacugcacauuguucucccaagugaaaaugguacaaaggaucagugucagauccuucacuuuaccgugcccgaggucgaggaagaguucauguauucuugcgacggggaugaacgcccucuguuggugaaaggcacgcuaauugccaucgacccauuugaugacagaagggaggcaggaggcgaaagcaccguaguuaacccgaaguccgggucauggaauuucuuugauugguucagcggacugaugucuugguuugguggcccccucaaaacaauccugcuuauuugucuguacguggcuuuguccauaggacucuucuuccuguuaaucuaucugggacggacuggccuaaguaagauguggcucgccgcuaccaaaaaggccagc

SEQ ID NO: 11367 - RNA, 1521 nt, Artificial Sequence
  derived and/or modified CDS sequence (opt3) from RVFV(ZINGA J83 R1)__KU978776.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccugauuagcuauaagccaaugaucgaccagcuagagugcacaacuaaucucauagaucccuucgugguguucgaaagaggaucucugccucagaccaggaacgacaaaacauuugcugccucaaagggcaaucggggcguccaggcguucaguaaggggagcguucaagcagaucuuacccugauguuugacaacuucgagguggauuuuguaggagccgcuguguccugugacgccgcauucuugaaucucacggguugcuacucuuguaacgcuggcgcccgugucugccugucgauuacuagcacagggaccggaacuuuauccgcgcauaacaaagacggcucacugcacaucgugcucccaagugaaaaugguacaaaggaucagugucagauucuucacuuuaccguucccgagguggaggaagaguucauguauucuugcgacggggaugaacgcccucuguuggucagaggcacgcuaaucgccaucgacccauuugaugacaggcgggaggcaggaggcgaaagcaccgugguaaacccgaaauccgggucauggaauuucuuugauugguucagcggacugaugucuugguuugguggcccccucaagacaauucugcuuauaugucuguacguugcuuuguccaucggacucuucuuccuguuaauuuaucugggacgaacuggccuaaguaaaauguggcucgccgcuaccaagaaagccagc

SEQ ID NO: 11368 - RNA, 1521 nt, Artificial Sequence
  derived and/or modified CDS sequence (opt3) from RVFV(Entebbe)__DQ380191.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuguugaucugggagcaagcaguucuagguuuaccaauugggguuccgugagccucucguuagacgccgagggcauuucuggguccaacucauucaguuuuaucgaaagcccaggaaaaggcuacgcuauagucgaugagccguucuccgaaaucccccggcaagguuuucugggggagauucgcugcaauucugagagcucagugcuuagugcacacgaauccuguuugcgagccccuaaccugaucagcuauaagccaaugauugaccagcuagagugcacaacuaaucucaucgaucccuucguggucuucgaaagaggaucucugccucagaccaggaacgacaaaacauuugcugccucaaagggcaaucggggcguucaggcguucaguaaggggagcgugcaagcagaucuuacccugauguuugacaacuucgagguagauuuugugggagccgcugucuccugugacgccgcauucuugaaucucacggguugcuacucuuguaacgcuggcgcccgugugugccugucgauaacuagcacagggaccggaacuuuauccgcgcauaacaaagacggcucacugcacauuguucucccaagugaaaaugguacaaaggaucagugucagauccuucacuuuaccgugcccgaggucgaggaagaguucauguauucuugcgacggggaugaacgcccucuguuggugaaaggcacgcuaauugccaucgacccauuugaugacagaagggaggcaggaggcgaaagcaccguaguuaacccgaaguccgggucauggaauuucuuugauugguucagcggacugaugucuugguuugguggcccccucaaaacaauccugcuuauuugucuguacguggcuuuguccauaggacucuucuuccuguuaaucuaucugggacggacuggccuaaguaagauguggcucgccgcuaccaaaaaggccagc

SEQ ID NO: 11369 - RNA, 1521 nt, Artificial Sequence
  derived and/or modified CDS sequence (opt3) from RVFV(Sudan 2V-2007)__JQ820490.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccugauuagcuauaagccaaugaucgaccagcuagagugcacaacuaaucucauagaucccuucgugguguucgaaagaggaucucugccucagaccaggaacgacaaaacauuugcugccucaaagggcaaucggggcguccaggcguucaguaaggggagcguucaagcagaucuuacccugauguuugacaacuucgagguggauuuuguaggagccgcuguguccugugacgccgcauucuugaaucucacggguugcuacucuuguaacgcuggcgcccgugucugccugucgauuacuagcacagggaccggaacuuuauccgcgcauaacaaagacggcucacugcacaucgugcucccaagugaaaaugguacaaaggaucagugucagauucuucacuuuaccguucccgagguggaggaagaguucauguauucuugcgacggggaugaacgcccucuguuggucaaaggcacgcuaauggccaucgacccauuugaugacagaagggaggcaggaggcgaaagcaccgugguaaacccgaaguccgggucauggaauuucuuugauugguucagcggacugaugucuugguuugguggcccccucaaaacaauccugcuuauuugucuguacguugcuuuguccauaggacucuucuuccuguuaaucuaucugggacggacuggccuaaguaagauguggcucgccgcuaccaaaaaggccagc

SEQ ID NO: 11370 - RNA, 1521 nt, Artificial Sequence
  derived and/or modified CDS sequence (opt3) from RVFV(Sudan 86-2010)__JQ820489.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccugauuagcuauaagccaaugaucgaccagcuagagugcacaacuaaucucauagaucccuucgugauuuucgaaagaggaucucugccucagaccaggaacgacaaaacauuugcugccucaaagggcaaucggggcgugcaggcguucaguaaggggagcguccaagcagaucuuacccugauguuugacaacuucgagguugauuuugugggagccgcuguauccugugacgccgcauucuugaaucucacggguugcuacucuuguaacgcuggcgcccgugugugccugucgaucacuagcacagggaccggaacuuuauccgcgcauaacaaagacggcucacugcacauuguccucccaagugaaaaugguacaaaggaucagugucagauccuucacuuuaccgugcccgagguugaggaagaguucauguauucuugcgacggggaugaacgcccucuguuggugaaaggcacgcuaaucgccauugacccauuugaugacagaagggaggcaggaggcgaaagcaccgucgugaacccgaaguccgggucauggaauuucuuugauugguucagcggacugaugucuugguuugguggcccccucaaaacaauacugcuuaucugucuguacguagcuuuguccauuggacucuucuuccuguuaaucuaucugggacggacuggccuaaguaagauguggcucgccgcuaccaaaaaggccagc

SEQ ID NO: 11371 - RNA, 1521 nt, Artificial Sequence
  derived and/or modified CDS sequence (opt3) from RVFV(Kenya 56 (IB8))__DQ380190.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccugauuagcuauaagccaaugaucgaccagcuagagugcacaacuaaucucauagaucccuucguggcuuucgaaagaggaucucugccucagaccaggaacgacaaaacauuugccgcgucaaagggcaaucggggcgugcaggcauucaguaaggggagcguccaagccgaucuuacccugauguuugacaacuucgagguugauuuugugggagcugccguauccugugacgcagcuuucuugaaucucacggguugcuacucuuguaacgccggcgcgcgugugugccugucgauuacuagcacagggaccggaacuuuauccgcccauaacaaagacggcucacugcacaucguccucccaagugaaaaugguacaaaggaucagugucagauucuucacuuuaccgugcccgagguugaggaagaguucauguauucuugcgacggggaugaacgcccucuguuggugaaaggcacgcuaaucgcaaucgacccauuugaugacagaagggaggcuggaggcgaaagcaccgucgugaacccgaaguccgggucauggaauuucuuugauugguucagcggacugaugucuugguuugguggcccccucaaaacaauucugcuuauaugucuguacguagccuuguccaucggacucuucuuccuguuaauuuaucugggacggacuggccuaaguaagauguggcucgcugccaccaaaaaggcaagc

SEQ ID NO: 11372 - RNA, 1521 nt, Artificial Sequence
  derived and/or modified CDS sequence (opt3) from RVFV(ARD-38388)__DQ380187.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuuauuggugaaaguaccacuaugcgggaaaauaaguguuucgagcagugcgggggauggggcuguggcugcuuuaacgucaauccuagcugccuuuucgugcacacauaucugcagucuguucgcaaagaggccuugagaguguuuaacuguaucgacuggguccauaagcucacccuggaaauuacggauuucgacggguccgugucaacuaucgaucugggagcaagcaguucuagguuuaccaauugggguuccguaagccucucguuagacgccgagggcauaucuggguccaacucauucaguuuuaucgaaagcccaggaaaaggcuacgcuauuguugaugagccguucuccgaaaucccccggcaagguuuucugggggagauucgcugcaauucugagagcucaauccuuagugcacacgaauccuguuugcgagccccuaaccugauaagcuauaagccaaugauugaccagcuagagugcacaacuaaucucaucgaucccuucguggucuucgaaagaggaucucugccucagaccaggaacgacaaaacauuugcugccucaaagggcaaucggggcgugcaggcguucaguaaggggagcgugcaagcagaucuuacccugauguuugacaacuucgaggucgauuuuguuggagccgcuguguccugugacgccgcauucuugaaucucacggguugcuacucuuguaacgcuggcgcccguguaugccugucgauuacuagcacagggaccggaacuuuauccgcgcauaacaaagacggcucacugcacaucgugcucccaagugaaaaugguacaaaggaucagugucagauccuucacuuuaccguccccgagguggaggaagaguucauguauucuugcgacggggaugaacgcccucuguugguuaaaggcacgcuaauugccauagacccauuugaugacagaagggaggcaggaggcgaaagcaccguggucaacccgaaguccgggucauggaauuucuuugauugguucagcggacugaugucuugguuugguggcccccucaaaacaauccugcuuauuugucuguacguggcuuuguccaucggacucuucuuccuguuaauauaucugggacggacuggccuaaguaagauguggcucgccgcuaccaaaaaggccagc

SEQ ID NO: 11373 - RNA, 1521 nt, Artificial Sequence
  derived and/or modified CDS sequence (opt3) from RVFV(Sudan 28-2010)__JQ820491.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccugauuagcuauaagccaaugaucgaccagcuagagugcacaacuaaucucauagaucccuucgugguguucgaaagaggaucucugccucagaccaggaacgacaaaacauuugcugccucaaagggcaaucggggcguccaggcguucaguaaggggagcguucaagcagaucuuacccugauguuugacaacuucgagguggauuuuguaggagccgcuguguccugugacgccgcauucuugaaucucacggguugcuacucuuguaacgcuggcgcccgugucugccugucgauuacuagcacagggaccggaacuuuauccgcgcauaacaaagacggcucacugcacaucgugcucccaagugaaaaugguacaaaggaucagugucagauucuucacuuuaccguucccgagguggaggaagaguucauguauucuugcgacggggaugaacgcccucuguuggucaaaggcacgcuaaucgccaucgacccauuugaugacagaagggaggcaggaggcgaaagcaccgugguaaacccgaaguccgggucauggaauuucuuugauugguucagcggacugaugucuugguuugguggcccccucaaaacaauucugcuuauaugucuguacguuguguuguccaucggacucuucuuccuguuaauuuaucugggacggacuggccuaaguaagauguggcucgcugccaccaaaaaggcuagc

SEQ ID NO: 11374 - RNA, 1521 nt, Artificial Sequence
  derived and/or modified CDS sequence (opt3) from RVFV(200803167)__JF311382.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccugauuagcuauaagccaaugaucgaccagcuagagugcacaacuaaucucauagaucccuucgugguguucgaaagaggaucucugccucagaccaggaacgacaaaacauuugcugccucaaagggcaaucggggcguccaggcguucaguaaggggagcguucaagcagaucuuacccugauguuugacaacuucgagguggauuuuguaggagccgcuguguccugugacgccgcauucuugaaucucacggguugcuacucuuguaacgcuggcgcccgugucugccugucgauuacuagcacagggaccggaacuuuauccgcgcauaacaaagacggcucacugcacaucgugcucccaagugaaaaugguacaaaggaucagugucagauucuucacuuuaccguucccgagguggaggaagaguucauguauucuugcgacggggaugaacgcccucuguuggucaaaggcacgcuaaucgccaucgacccauuugaugacagaagggaggcaggaggcgaaagcaccgugguaaacccgaaguccgggucauggaauuucuuugauugguucagcggacugaugucuugguuugguggcccccucaaaacaaugcugcuuauuugucuguacguugcuuuguccauaggacucuucuuccuguuaaucuaucugggacggacuggccuaaguaagauguggcucgccgcuaccaaaaaggccagc

SEQ ID NO: 11375 - RNA, 1521 nt, Artificial Sequence
  derived and/or modified CDS sequence (opt3) from RVFV(73HB1230)__DQ380221.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccauuaugcgggaaaauaaguguuucgagcagugcgggggauggggcuguggcugcuuuaacgugaauccuagcugccuuuucguucacacuuaucugcagucugugcgcaaagaggccuugagagucuuuaacuguaucgacugggugcauaagcucacacuggaaauuaccgauuucgacggguccguaucaacgaucgaucugggagcaagcaguucuagguuuacuaauugggguuccguuagccucucguuagacgccgagggcauaucuggguccaacucauucaguuuuaucgaaagcccaggaaaaggcuacgcuauuguggaugagccguucuccgaaaucccccggcaagguuuucugggggagauucgcugcaauucugagagcucaguccuuagugcacacgaauccuguuugcgagccccuaaccugaucagcuauaagccaaugauagaccagcuagagugcaccacaaaucucauugaucccuucgugguguucgaaagaggaucucugccucagacuaggaacgacaaaaccuuugcugccucaaagggcaaucggggcguccaggcguucaguaaggggagcguucaagcagaucuuacacugauguuugacaacuucgagguggauuuuguaggagccgcuguguccugugacgccgcauucuugaaucucaccgguugcuacucuuguaacgcuggcgcccgugucugccugucgaucacgagcacugggacaggaaccuuauccgcgcauaacaaagacggcucacugcacauugugcucccaagugaaaaugguacuaaggaucagugucagauccuucacuuuacaguucccgagguggaggaagaguucauguauucuugcgacggggaugaacgcccucuguuggucaaaggcacccuaaucgccauugacccauuugaugacagaagggaggcaggaggcgaaagcacggugguaaacccgaaguccgggucauggaauuucuuugauugguucagcggacugaugucuugguuugguggcccccucaaaaccauacugcuuaucugucuguacguugcuuuguccauuggacucuucuuccuguuaaucuaucugggacggacaggccuaaguaagauguggcucgccgcuacuaaaaaggccagc

SEQ ID NO: 11376 - RNA, 1521 nt, Artificial Sequence
  derived and/or modified CDS sequence (opt3) from RVFV(2250/74)__DQ380209.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccugauuagcuauaagccaaugaucgaccagcuagagugcacaacuaaucucauagaucccuucgugguguucgaaagaggaucucugccucagaccaggaacgacaaaacauuugcugccucaaagggcaaucggggcguccaggcguucaguaaggggagcguucaagcagaucuuacccugauguuugacaacuucgagguggauuuuguaggagccgcuguguccugugacgccgcauucuugaaucucacggguugcuacucuuguaacgcuggcgccaaagucugccugucgauuacuagcacagggaccggauccuuaucagcgcauaacaaggacggcagucugcacaucgugcucccaucugaaaaugguacuaaagaucagugucagauucuucacuuuacaguucccgagguggaggaagaguucauguauagcugcgacggggaugaacguccucuguuggucaagggcacccuaaucgccaucgacccauuugaugaccgcagagaggcaggaggcgaauccacggugguaaacccgaaaucagggagcuggaauuucuuugauugguucucuggacugauguccugguuugguggcccccucaagaccauucugcuuauaugucuguacguugcuuugaguaucggacucuucuuccuguuaauuuaucugggaaggacaggccuaagcaaaauguggcucgccgcuacuaagaaggccucu

SEQ ID NO: 11377 - RNA, 1521 nt, Artificial Sequence
  derived and/or modified CDS sequence (opt3) from RVFV(SAUDI 200010901)__KU978778.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccugauuagcuauaagccaaugaucgaccagcuagagugcacaacuaaucucauagaucccuucgugguguucgaaagaggaucucugccucagaccaggaacgagaaaacauuugcugccucaaagggcaaucggggcguccaggcguucaguaaggggagcguucaagcagaccuuacccugauguuugauaacuucgaaguggacuuuguaggagccgcuguguccugugaugccgcauucuugaaucucacggguugcuacucuuguaacgcuggcgcccgugucugccugucgauuacuagcacagggaccggaacuuuauccgcgcauaacaaagacggcucacugcacaucgugcucccaagugagaaugguacaaaggaccagugucagauucuucacuuuaccguucccgagguggaagaggaguucauguauucuugcgauggggacgaacgcccucuguuggucaaaggcacgcuaaucgccaucgauccauuugacgauagaagggaagcaggaggcgagagcaccgugguaaacccgaaguccgggucauggaauuucuuugacugguucagcggacugaugucuugguuugguggcccccucaaaacaauucugcuuauaugucuguacguugcuuuguccaucggacucuucuuccuguuaauuuaucugggacggacuggccuaaguaagauguggcucgccgcuaccaaaaaggccagc

SEQ ID NO: 11378 - RNA, 1521 nt, Artificial Sequence
  derived and/or modified CDS sequence (opt3) from RVFV(Lunyo)__KU167026.1__Gc
ugcagcgagcugauccaggccuccucuagaauuaccacauguucaacugaaggcgugaacacgaggugccggcucagugggaccgcucuuauacgcgcaggaagcgucggugccgaggcgugucugauguugaagggcguuaaagaagaccaaacaaaguucuuaaaaaucaagacuguguccucugagcugucgugccgagaagggcagucauacuggaccgggagcuuuagucccaaaugucuauccucucguagaugccaccucguaggcgagugucaugugaauaggugccugagcuggcgggauaacgagacauccgcugaguucucauuugucggugaaaguaccacuaugcgcgaaaauaaguguuucgagcagugcgggggauggggcuguggcugcuuuaacgugaauccuagcugccuuuucguucacacauaucugcagucugugagaaaggaggccuugagggucuuuaacuguauugacugggugcauaaacucacccuggaaaucacggauuucgacggguccguaucaacuauugaucugggagcaagcaguucucgguuuaccaauugggguuccguuagccucucguuagacgccgagggcaucucuggguccaacucauucaguuuuauagaaagcccaggaaagggcuacgcuaucguggaugagccguucuccgaaauuccccgccaagguuuucugggggagauccgaugcaauucugagagcucaguccuuagugcacacgaauccuguuugagagccccuaaccugauuagcuauaaaccaaugaucgaccagcuagagugcacaacuaaucucauagaucccuucgugguguucgaaaggggaucucugccucagacccggaacgacaagacauuugcugccucaaaaggcaaucguggcguccaggcguucaguaaggggagcguucaagcagaucuuacccugauguuugacaacuucgagguggauuuuguaggagccgcuguguccugugacgccgcauucuugaaucucacggguugcuacucuuguaacgcuggcgcccgcgucugccugucgauuacuagcacagggaccggaacuuuauccgcgcauaacaaggacggcucacugcacaucgugcucccaagugaaaaugguacaaaagaucagugucagauucuucacuuuaccguucccgagguggaggaagaguucauguauucuugcgacggggaugaaagaccucuguuggucaagggcacgcuaaucgccaucgacccauuugaugacaggcgggaggcaggaggcgaaagcaccgugguaaacccgaaauccgggucauggaauuucuuugauugguucagcggacugaugucuugguuugguggcccccucaagacaauucugcuuauaugucuguacguugcuuuguccaucggacucuucuuccuguuaauuuaucugggacgaacuggccuaaguaaaauguggcucgccgcuaccaagaaagccagc

SEQ ID NO: 11379 - RNA, 1521 nt, Artificial Sequence
  derived and/or modified CDS sequence (opt3) from RVFV(25010-24)__KM210509.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggacgaucaaacaaaauucuuaaagaucaaaacuguguccucugaacugucgugccgcgaggggcagucauacuggaccgggagcuuuagucccaagugucuauccucucgacguugccaccucguaggcgaaugucaugugaauagaugccugagcuggagggacaacgagacauccgcugaguucucauuugucggugaaaguaccacuaugcgggagaauaaguguuucgaacagugcgggggauggggcuguggcugcuuuaacgugaauccuagcugccuuuucguucacacauaucugcagucugugcgcaaagaggccuugagagucuuuaacuguauugauugggugcauaagcucacccuggagaucacggacuucgauggguccguaucaacuauugaccugggagcaagcaguucuagguuuaccaauugggguuccguuagccucucguuagaugccgaaggcaucucuggguccaacucauucaguuuuauagagagcccaggaaaaggcuacgcuaucguggacgaaccguucuccgagauuccccggcaagguuuucugggggaaauccgcugcaauucugagagcucaguccuuagugcacacgaguccuguuugcgagccccuaaccugauuagcuauaagccaaugaucgaucagcuagaaugcacaacuaaucucauagaccccuucgugguguucgagagaggaucucugccucagaccaggaacgauaaaacauuugcugccucaaagggcaaucggggcguccaggcguucaguaaggggagcguucaagcagaccuuacccugauguuugauaacuucgaaguggacuuuguaggagccgcuguguccugugacgccgcauucuugaaucucacggguugcuacucuuguaacgcuggcgcccgugucugccugucgauuacuagcacagggaccggaacuuuauccgcgcauaacaaagauggcucacugcacaucgugcucccaagugagaaugguacaaaggaccagugucagauucuucacuuuaccguucccgaaguggaggaggaguucauguauucuugcgauggggacgaacgcccucuguuggucaaaggcacgcuaaucgccaucgauccauuugacgauagaagggaagcaggaggcgagagcaccgugguaaacccgaaguccgggucauggaauuucuuugacugguucagcggacugaugucuugguuugguggcccccucaaaacaauucugcuuauaugucuguacguugcuuuguccaucggacucuucuuccuguuaauuuaucugggacggacuggccuaaguaagauguggcucgccgcuaccaaaaaggccagc

SEQ ID NO: 11380 - RNA, 1521 nt, Artificial Sequence
  derived and/or modified CDS sequence (opt3) from RVFV(2007000253)__JF326192.1__Gc
ugcagcgagcugauccaggccuccucuagaauuaccacauguucaacugaaggcgugaacacgaagugcaggcucagugggaccgcucuuauacgggcaggaagcgccggugcggaggcuugucugauguugaaaggcgucaaggaagaccaaacaaaauucuuaaagaucaaaacuguuuccucugagcugucgugccgcgaagggcagucauacuggaccgggagcuuuagucccaagugucuauccucucgacguugccaccucgugggcgagugucauguaaauagaugccugagcuggagggauaacgagacauccgccgaguucucauuugugggugaaaguaccacuaugcgggaaaauaaguguuucgagcagugcgggggauggggcuguggcugcuuuaacgucaauccuagcugccuuuucgugcacacauaucugcagucuguucgcaaagaggcauugagaguguuuaacuguauugacuggguccauaagcucacccuggaaaucacggauuucgacggguccgugucaacuauugaucugggagccagcaguucuagguuuaccaauugggguuccguaagccucucguuagacgcugagggcaucucuggguccaacucauucaguuuuauagaaagcccaggaaaaggcuacgcaaucguugaugagccguucuccgaaauuccccggcaagguuuucugggggagauccgcugcaauucugagagcucagugcuuagugcccacgaauccuguuugcgagcuccuaaccuggucagcuauaagccaaugauugaccagcuagagugcacaacuaaucucaucgaucccuucgugguguucgaaagaggaucucugccucagaccaggaacgacaaaacauuugccgcgucaaagggcaaucggggcguccaggcauucaguaaggggagcguucaagccgaucuuacccugauguuugacaacuucgagguggauuuuguaggagcugccguguccugugacgcagcuuucuugaaucucacggguugcuacucuuguaacgccggcgcgcgugucugccugucgauaacuagcacagggaccggaacuuuauccgcccauaacaaagacggcucacugcacauugugcucccaagugaaaaugguacaaaggaucagugucagauccuucacuuuaccguucccgagguggaggaagaguucauguauucuugcgacggggaugaacgcccucuguuggucaaaggcacgcuaauugcaaucgacccauuugaugacagaagggaggcuggaggcgaaagcaccgugguaaacccgaaguccgggucauggaauuucuuugauugguucagcggacugaugucuugguuugguggcccccucaaaacaauccugcuuauuugucuguacguugccuuguccauaggacucuucuuccuguuaaucuaucugggacggacuggccuaaguaagauguggcucgcugccaccaaaaaggcaagc

SEQ ID NO: 11381 - RNA, 1521 nt, Artificial Sequence
  derived and/or modified CDS sequence (opt3) from RVFV(ZC-3349)__DQ380207.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugaaggccccuaaccugauuagcuauaaaccaaugaucgaccagcuagagugcacaacuaaucucauagaucccuucgugguguucgaacgaggaucucugccucagaccagaaacgacaagacauuugcugccucaaagggcaauaggggcguccaggcguucaguaaagggagcguucaagcagaucuuacccugauguuugacaacuucgagguggauuuuguaggagccgcuguguccugugacgccgcauucuugaaucucacggguugcuacucuuguaacgcuggcgcccgggucugccugucgauuacuagcacagggaccggauccuuaucagcgcauaacaaggacggcagucugcacaucgugcucccaucugaaaaugguacuaaagaucagugucagauucuucacuuuacaguucccgagguggaggaagaguucauguauagcugcgacggggaugaacguccucuguuggucaagggcacccuaaucgccaucgacccauuugaugaccgcagagaggcaggaggcgaauccacggugguaaacccgaaaucagggagcuggaauuucuuugauugguucucuggacugauguccugguuugguggcccccucaagaccauucugcuuauaugucuguacguugcuuugaguaucggacucuucuuccuguuaauuuaucugggaaggacaggccuaagcaaaauguggcucgccgcuacuaagaaggccucu

SEQ ID NO: 11382 - RNA, 1521 nt, Artificial Sequence
  derived and/or modified CDS sequence (opt3) from RVFV(OS-1)__DQ380186.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugaaggucuuuaacuguauugacugggugcauaaacucacccuggaaaucacggauuucgacggguccguaucaacuauugaucugggagcaagcaguucuagauuuaccaauugggguuccguuagccucucguuagacgccgagggcaucucuggguccaacucauucaguuuuauagaaagcccaggaaagggcuacgcuaucguggaugagccguucuccgaaauucccaggcaagguuuucugggggagauccggugcaauucugagagcucaguccuuagugcacacgaauccuguuugcgcgccccuaaccugauuagcuauaaaccaaugaucgaccagcuagagugcacaacuaaucucauagaucccuucgugguguucgaacgaggaucucugccucagaccagaaacgacaagacauuugcugccucaaagggcaauaggggcguccaggcguucaguaaagggagcguucaagcagaucuuacccugauguuugacaacuucgagguggauuuuguaggagccgcuguguccugugacgccgcauucuugaaucucacggguugcuacucuuguaacgcuggcgcccgggucugccugucgauuacuagcacagggaccggaacuuuauccgcgcauaacaaggacggcucacugcacaucgugcucccaagugaaaaugguacaaaagaucagugucagauucuucacuuuaccguucccgagguggaggaagaguucauguauucuugcgacggggaugaacguccucuguuggucaagggcacgcuaaucgccaucgacccauuugaugaccgcagagaggcaggaggcgaaagcaccgugguaaacccgaaauccgggucauggaauuucuuugauugguucagcggacugaugucuugguuugguggcccccucaagacaauucugcuuauaugucuguacguugcuuuguccaucggacucuucuuccuguuaauuuaucugggaaggacuggccuaaguaaaauguggcucgccgcuaccaagaaggccagc

SEQ ID NO: 11383 - RNA, 1521 nt, Artificial Sequence
  derived and/or modified CDS sequence (opt3) from RVFV(KEN/Gar-004/06)__HM586964.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccuggugagcuauaagccaaugauugaccagcuagagugcacaacuaaucucaucgaucccuucguggucuucgaaagaggaucucugccucagaccaggaacgacaaaacauuugcugccucaaagggcaaucggggcguucaggcguucaguaaggggagcgugcaagcagaucuuacccugcguuuugacaacuucgagguagauuuugugggagccgcugucuccugugacgccgcauucuugaaucucacggguugcuacucuuguaacgcuggcgcccgcgugugccugucgauaacuagcacagggaccggaacuuuauccgcgcauaacaaagacggcucacugcacauuguucucccaagugaaaaugguacaaaggaucagugucagauccuucacuuuaccgugcccgaggucgaggaagaguucauguauucuugcgacggggaugaaagaccucuguuggugaaaggcacgcuaauugccaucgacccauuugaugacaggcgggaggcaggaggcgaaagcaccguaguuaacccgaaguccgggucauggaauuucuuugauugguucagcggacugaugucuugguuugguggcccccucaaaacaauccugcuuauuugucuguacguggcuuuguccauaggacucuucuuccuguuaaucuaucugggacgaacuggccuaaguaagauguggcucgccgcuaccaaaaaggccagc

SEQ ID NO: 11384 - RNA, 1521 nt, Artificial Sequence
  derived and/or modified CDS sequence (opt3) from RVFV(Smithburn)__DQ380193.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuguugaucugggagcaagcaguucuagguuuaccaauugggguuccgugagccucucguuagacgccgagggcauuucuggguccaacucauucaguuuuaucgaaagcccaggaaaaggcuacgcuauagucgaugagccguucuccgaaaucccccggcaagguuuucugggggagauucgcugcaauucugagagcucagugcuuagugcacacgaauccuguuugcgagccccuaaccugaucagcuauaagccaaugauugaccagcuagagugcacaacuaaucucaucgaucccuucguggucuucgaaagaggaucucugccucagaccaggaacgacaaaacauuugcugccucaaagggcaaucggggcguucaggcguucaguaaggggagcgugcaagcagaucuuacccugauguuugacaacuucgagguagauuuugugggagccgcugucuccugugacgccgcauucuugaaucucacggguugcuacucuuguaacgcuggcgcccgugugugccugucgauaacuagcacagggaccggaacuuuauccgcgcauaacaaagacggcucacugcacauuguucucccaagugaaaaugguacaaaggaucagugucagauccuucacuuuaccgugcccgaggucgaggaagaguucauguauucuugcgacggggaugaacgcccucuguuggugaaaggcacgcuaauugccaucgacccauuugaugacagaagggaggcaggaggcgaaagcaccguaguuaacccgaaguccgggucauggaauuucuuugauugguucagcggacugaugucuugguuugguggcccccucaaaacaauccugcuuauuugucuguacguggcuuuguccauaggacucuucuucuuucugaucuauuuaggacggacuggccugaguaagauguggcuagccgcuaccaaaaaggccagc

SEQ ID NO: 11385 - RNA, 1521 nt, Artificial Sequence
  derived and/or modified CDS sequence (opt3) from RVFV(2008/00101)__HE687306.1__Gc
ugcagcgagcugauccaggccuccucuagaauuacaacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccuggugagcuauaagccaaugauugaccagcuagagugcacaacuaaucucaucgaucccuucguggucuucgaaagaggaucucugccucagaccaggaacgacaaaacauuugcugccucaaagggcaaucggggcguucaggcguucaguaaggggagcgugcaagcagaucuuacccugauguuugacaacuucgagguagauuuugugggagccgcugucuccugugacgccgcauucuugaaucucacggguugcuacucuuguaacgcuggcgcccgugugugccugucgauaacuagcacagggaccggaacuuuauccgcgcauaacaaagacggcucacugcacauuguucucccaagugaaaaugguacaaaggaucagugucagauccuucacuuuaccgugcccgaggucgaggaagaguucauguauucuugcgacggggaugaacgcccucuguuggugaaaggcacgcuaauugccaucgacccauuugaugacagaagggaggcaggaggcgaaagcaccguaguuaacccgaaguccgggucauggaauuucuuugauugguucagcggacugaugucuugguuugguggcccccucaaaacaacucugcuuaucugucuguacguggcuuuguccauuggacucuucuuccuguuaauauaucugggacggaccggccuaaguaagauguggcucgccgcuaccaaaaaggccagc

SEQ ID NO: 11386 - RNA, 1521 nt, Artificial Sequence
  derived and/or modified CDS sequence (opt3) from RVFV(2007001292)__EU574046.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccggcagcuuuagucccaagugucuauccucucgacguugccaccucguaggagagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccuggugagcuauaagccaaugauugaccagcuagagugcacaacuaaucucaucgaucccuucguggucuucgaaagaggaucucugccucagaccaggaacgacaaaacauuugcugccucaaagggcaaucggggcguucaggcguucaguaaggggagcgugcaagcagaucuuacccugauguuugacaacuucgagguagauuuugugggagccgcugucuccugugacgccgcauucuugaaucucacggguugcuacucuuguaacgcuggcgcccgugugugccugucgauaacuagcacagggaccggaacuuuauccgcgcauaacaaagacggcucacugcacauuguucucccaagugaaaaugguacaaaggaucagugucagauccuucacuuuaccgugcccgaggucgaggaagaguucauguauucuugcgacggggaugaacgcccucuguuggugaaaggcacgcuaauugccaucgacccauuugaugacagaagggaggcaggaggcgaaagcaccguaguuaacccgaaguccgggucauggaaucuguucgauugguuuagcggacucaugucuugguucgguggcccccugaaaacaauccuucugauuuguuuguacguggcucucuccauagggcuguuuuucuuacugaucuaucuaggacggacuggccucaguaagauguggcuggccgcuaccaaaaaggccagc

SEQ ID NO: 11387 - RNA, 1521 nt, Artificial Sequence
  derived and/or modified CDS sequence (opt3) from RVFV(2007002445)__EU574037.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccuggugagcuauaagccaaugauugaccagcuagagugcacaacuaaucucaucgaucccuucguggucuucgaaagaggaucucugccucagaccaggaacgagaaaacauuugcugccucaaagggcaaucggggcguucaggcguucaguaaggggagcauacaagcagaccuuacccugauguuugauaacuucgaaguggacuuuguaggagccgcuguguccugugaugccgcauucuugaaucucacggguugcuacucuuguaacgcuggcgcccgugucugccugucgauuacuagcacagggaccggaacuuuauccgcgcauaacaaagacggcucacugcacaucgugcucccaagugagaaugguacaaaggaccagugucagauucuucacuuuaccguucccgagguggaagaggaguucauguauucuugcgauggggacgaacgcccucuguuggucaaaggcacgcuaaucgccaucgauccauuugacgauagaagggaagcaggaggcgagagcaccgugguaaacccgaaguccgggucauggaauuucuuugacugguucagcggacugaugucuugguuugguggcccccucaaaacaauucugcuuauaugucuguacguugcuuuguccaucggacucuucuuccuguuaauuuaucugggacggacuggccuaaguaagauguggcucgccgcuaccaaaaaggccagc

SEQ ID NO: 11388 - RNA, 1521 nt, Artificial Sequence
  derived and/or modified CDS sequence (opt3) from RVFV(Ken 199800523)__KU978777.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuaacgcacacgaaaguuguuugcgagccccuaaucugauuuccuauaagccaaugaucgaccagcuagagugcacaacuaaccucauagaucccuucgugguguucgaaagaggaagccugccucagaccaggaaugacaaaacauuugcugccucuaagggcaaccggggcguccaggcguucucaaaggggaguguucaagcagaucuuacccugauguuugacaauuucgagguggauuuuguaggagccgcugugagcugugacgccgcauucuugaaccucacggguugcuacuccuguaacgcuggcgcccgugucugccugucuauuacuucgacagggaccggaacuuuaagcgcgcauaauaaagaaggcucccugcacaucgugcucccaucagagaacgguacaaaggaccagugucagauucuucacuuuaccguucccgagguggaagaggaguucauguauaguugcgauggggacgaacgcccucuguuggucaaaggcacgcuaaucgccaucgauccauuugacgauagaagggaagcaggaggcgagucuaccgugguaaaucccaagagcggguccuggaacuucuuugacugguucucaggacugaugagcugguuugguggcccgcucaaaacaauucugcuuauaugucuguacguugcuuugucuaucggacucuucuuccuguuaauuuaucugggacggacuggccuauccaagauguggcucgccgcuaccaaaaaggccagu

SEQ ID NO: 11389 - RNA, 1521 nt, Artificial Sequence
  derived and/or modified CDS sequence (opt3) from RVFV(clone 13)__DQ380213.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggacgaucaaacaaaauucuuaaagaucaaaacuguguccucugaacugucgugccgcgaggggcagucauacuggaccgggagcuuuagucccaagugucuauccucucgacguugccaccucguaggcgaaugucaugugaauagaugccugagcuggagggacaacgagacauccgcugaguucucauuugucggugaaaguaccacuaugcgggagaauaaguguuucgaacagugcgggggauggggcuguggcugcuuuaacgugaauccuagcugccuuuucguucacacauaucugcagucugugcgcaaagaggccuugagagucuuuaacuguauugauugggugcauaagcucacccuggagaucacggacuucgauggguccguaucaacuauugaccugggagcaagcaguucuagguuuaccaauugggguuccguuagccucucguuagaugccgaaggcaucucuggguccaacucauucaguuuuauagagagcccaggaaaaggcuacgcuaucguggacgaaccguucuccgagauuccccggcaagguuuucugggggaaauccgcugcaauucugagagcucaguccuuagugcacacgaguccuguuugcgagccccuaaccugauuagcuauaagccaaugaucgaucagcuagaaugcacaacuaaucucauagaccccuucgugguguucgagagaggaucucugccucagaccaggaacgagaaaacauuugcugccucaaagggcaaucggggcguccaggcguucaguaaggggagcguucaagcagaucuuacccugauguuugacaacuucgaaguggauuuuguaggagccgcuguguccugugacgccgcauucuugaaucucacggguugcuacucuuguaacgcuggcgcccgugucugccugucgauuacuagcacagggaccggaacuuuauccgcgcauaacaaagacggcucacugcacaucgugcucccaagugaaaaugguacaaaggaucagugucagauucuucacuuuaccguucccgagguggaggaagaguucauguauucuugcgacggggaugaacgcccucuguuggucaaaggcacgcuaaucgccaucgacccauuugaugacagaagggaggcaggaggcgaaagcaccgugguaaacccgaaguccgggucauggaauuucuuugauugguucagcggacugaugucuugguuugguggcccccucaaaacaauucugcuuauaugucuguacguugcuuuguccaucggacucuucuuccuguuaauuuaucugggacggacuggccuaaguaagauguggcucgccgcuaccaaaaaggccagc

SEQ ID NO: 11390 - RNA, 1521 nt, Artificial Sequence
  derived and/or modified CDS sequence (opt3) from RVFV(2373/74)__DQ380194.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccggcagcuuuagucccaagugucuauccucucgacguugccaccucguaggagagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacucuggaucucggagcaagcaguucuagguuuaccaauugggguuccguuagcuuaucgcuggacgccgagggcauuucuggguccaacucauucaguuuuaucgaaagcccaggaaaaggcuacgcuauaguggaugagccguucuccgaaaucccccggcaagguuuucuuggggagauucgcugcaauucugagagcucagucuugagugcacacgaauccugucugcgagccccuaaccuaaucagcuauaagccaaugauugaccagcucgagugcacaacuaaucugaucgaucccuucgugguguucgaaagaggaucucuuccucagaccaggaacgagaaaacauuugcugccucaaagggcaaucggggcguccaggcguucaguaaggggagcguucaagcagaccugaccuugauguuugauaacuucgaaguggacuuuguaggagccgcuguguccugugaugccgcauuccucaaucugacggguugcuacucuuguaacgcuggcgcccgugucugcuuaucgauaacuagcacagggaccggaacucuguccgcgcauaacaaagacggcucacuccacauugugcuuccaagugagaaugguacaaaggaccagugucagauccugcacuuuaccguucccgagguggaagaggaguucauguauucuugcgauggggacgaacgcccuuugcuagucaaaggcacgcugauugccaucgauccauuugacgauagaagggaagcaggaggcgagagcaccgugguaaacccgaaguccgggucauggaauuucuuugacugguucagcggacucaugucuugguuugguggcccccugaaaacaauccuucugauuuguuuguacguugcucucuccauagggcuguucuucuuacugaucuaucuaggacggacuggccucaguaagauguggcuggccgcuaccaaaaaggccagc

SEQ ID NO: 11391 - RNA, 1521 nt, Artificial Sequence
  derived and/or modified CDS sequence (opt3) from RVFV(OS-8)__DQ380185.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuacgcaucaagacuguguccucugagcugucgugccgagaagggcagucauacuggaccgggagcuuuagucccaaaugucuauccucucguagaugccaccucguaggcgagugucaugugaauaggugccugagcuggcgggauaacgagacauccgcugaguucucauuugucggugaaaguaccacuaugcgcgaaaauaaguguuucgagcagugcgggggauggggcuguggcugcuuuaacgugaauccuagcugccuuuucguucacacauaucugcagucugugagaaaggaggccuugagggucuuuaacuguauugacugggugcauaaacucacccuggaaaucacggauuucgacggguccguaucaacuauugaucugggagcaagcaguucucgguuuaccaauugggguuccguuagccucucguuagacgccgagggcaucucuggguccaacucauucaguuuuauagaaagcccaggaaagggcuacgcuaucguggaugagccguucuccgaaauuccccgccaagguuuucugggggagauccgaugcaauucugagagcucaguccuuagugcacacgaauccuguuugagagccccuaaccugauuagcuauaaaccaaugaucgaccagcuagagugcacaacuaaucucauagaucccuucgugguguucgaaaggggaucucugccucagacccggaacgacaagacauuugcugccucaaaaggcaaucguggcguccaggcguucaguaaggggagcguucaagcagaucuuacccugauguuugacaacuucgagguggauuuuguaggagccgcuguguccugugacgccgcauucuugaaucucucugguugcuacucguguaacgcuggcgcccgcgucugccugagcauuacguccacugggacaggaaccuuaucagcgcauaacaaggacggcagucugcacaucgugcucccaucugaaaaugguacuaaagaucagugucagauucuucacuuuacaguucccgagguggaggaagaguucauguauagcugcgacggggaugaaagaccucuguuggucaagggcacccuaaucgccaucgacccauuugaugacaggcgggaggcaggaggcgaauccacggugguaaacccgaaaucagggagcuggaauuucuuugauugguucucuggacugauguccugguuugguggcccccucaagaccauucugcuuauaugucuguacguugcuuugaguaucggacucuucuuccuguuaauuuaucugggacgaacaggccuaagcaaaauguggcucgccgcuacuaagaaagccucu

SEQ ID NO: 11392 - RNA, 1521 nt, Artificial Sequence
  derived and/or modified CDS sequence (opt3) from RVFV(KEN/Bar-035/07)__HM586969.1__Gc
ugcagcgagcugauccaggccuccucuagaauuaccacauguucaacugaaggcgugaacacgaagugcaggcucagugggaccgcucuuauacgggcacgcagcgucggagccgaggcgugucugauguugaaagguguuaaggaagaccaaacaaaauucuuaaagaucaaaacuguguccucugagcugucgugccgagaaggccagucauacuggaccgggagcuuuagucccaagugucuauccucucguagaugccaccucguaggagagugucaugugaauaggugccugagcuggcgggauaacgagacauccgcugaguucucauuugucggcgaaaguaccacuaugcgcgaaaauaaguguuucgagcagugcgguggguggggauguggcugcuuuaacgugaauccuagcugccuuuucguucacacauaucugcagucugugagaaaagaggccuugagggucuuuaacuguauugacugggugcauaagcucacccuggaaaucacggauuucgacggcuccguaucaacuauugaucugggggcaagcaguucucgguuuaccaauuggggauccguuagccucucguuagacgccgaggguaucucuggcuccaacucauucaguuuuauagaaagcccagggaaaggauacgcuaucguggaugagccguucuccgaaauuccccgccaaggcuuucugggugagauccgaugcaauucugagagcucaguccuuagugcacacgaauccuguuugagagccccuaaccuggugagcuauaagccaaugauugaccagcuagagugcacaacuaaucucaucgaucccuucguggucuucgaaagggggucucugccucagacccggaacgacaaaacauuugcugccucaaagggaaaucguggcguucaggcguucaguaagggcagcgugcaagcagaucuuacccugauguuugacaacuucgagguagauuuugugggggccgcugucuccugugacgccgcauucuugaaucucacgggaugcuacucuuguaacgcuggugcccgcgugugccugucgauaacuagcacaggcaccgggacuuuauccgcgcauaacaaagacggaucacugcacauuguucucccaagugaaaauggcacaaaggaucagugucagauccuucacuuuaccgugcccgaggucgaggaagaguucauguauucuugcgacggugaugaaagaccucuguuggugaaagggacgcuaauugccaucgacccauuugaugacaggcgggaggcaggcggagaaagcaccguaguuaacccgaaguccggcucauggaauuucuuugauugguucagcgggcugaugucuugguuuggagguccccucaaaacaauccugcuuauuugucuguacguggcuuuguccauaggccucuucuuccuguuaaucuaucuggggcgaacuggacuaaguaagauguggcucgccgcuaccaaaaaggccagc

SEQ ID NO: 11393 - RNA, 1521 nt, Artificial Sequence
  derived and/or modified CDS sequence (opt3) from RVFV(MgH824)__DQ380210.1__Gc
ugcagcgagcugauccaggccuccucuagaauuaccacauguucaacugaaggcguggacacgaagugcaggcucagugggaccgcucuuauacgggcaggaagcgucggugccgaggcgugucugauguugaaaggcguuaaggaagaucaaacaaaauucuuaaagaucaaaacuguguccucugagcugucgugccgcgaagggcagucauacuggaccgggagcuuuagucccaagugucuauccucucgacguugccaccucguaggcgagugucaugugaacagaugccugagcuggagggacaaugagacauccgcugaguucucauuugucggugaaaguaccacuaugcgggaaaacaaguguuucgagcagugcgggggauggggcuguggcugcuuuaaugugaacccuagcugccuuuucguucacacauaucugcagucugugcgcaaagaggccuugagagucuuuaauuguauugauugggugcauaagcucacccuggaaaucacggacuucgauggguccguaucaacuauugaccugggagcaagcaguucuagguuuaccaacugggguuccguuagccucucguuagaugccgagggcaucucuggguccaauucauucaguuuuauagaaagcccaggaaaaggcuacgcuaucguggacgagccguuccccgaaauuccucggcaagguuuucugggggagauccgcugcaacuccgagucuagcguccuuucagcacacgaaaguuguuugcgagccccaaaucugauuuccuauaagcccaugaucgaucagcuagagugcacaacuaaccucauagacccuuucgugguguucgaaagaggaagccugccacagaccaggaaugauaaaacauuugcugccucuaagggcaaccggggcguccaggcguucucaaaggggaguguucaagcagaccuuacccugauguuugauaauuucgagguggacuuuguaggagccgcugugagcugugacgccgcauucuugaaccucacggguugcuacuccuguaaugcuggcgcccgugucugccugucuauuacuucgacagggaccggcagcuuauccgcgcauaacaaagauggaucacugcacaucgugcuccccagugaaaacgguacuaaggaccagugucagauucuucacuuuacaguuccugagguggaggaagaguucauguauucuugcgauggggacgaacgcccacuguuggucaaaggcacccuaaucgccaucgauccguuugacgauagaagggaggcaggaggcgaaagcacggugguaaaucccaaguccgggucauggaacuucuuugacugguucagcggacugaugucuugguuugguggcccucucaaaaccauucugcuuauaugucuguacguugcuuuguccaucggacucuucuuccuguuaauuuaucugggacggacaggccuaaguaagauguggcucgccgcuacuaaaaaggccagc

SEQ ID NO: 11394 - RNA, 1521 nt, Artificial Sequence
  derived and/or modified CDS sequence (opt3) from RVFV(200803169)__JF311384.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaagguggaccaaacaaaauucuuaaagaucaaaacuguauccucugaacugucgugccgcgaggggcagucauacuggaccgggagcuuuagucccaagugucuauccucucgacguugccaccucgugggcgaaugucaugucaauagaugccugagcuggagggauaacgagacauccgcugaguucucauuugugggugaaaguaccacuaugcgggagaauaaguguuucgaacagugcgggggauggggcuguggcugcuuuaacguuaauccuagcugccuuuucgugcacacauaucugcagucuguccgcaaagaggccuugagaguguuuaacuguauugacuggguacauaagcucacccuggagaucacggauuucgacggguccguuucaacuauugaucugggagcaagcaguucuagguuuaccaauugggguuccgugagccucucguuagacgccgaaggcaucucuggguccaacucauucaguuuuauagagagcccaggaaaaggcuacgcuaucgucgaugaaccguucuccgagauuccccggcaagguuuucugggggaagugcgcugcaauucugagagcucagugcuuagugcacacgaguccuguuugcgagccccuaaccuggucagcuauaagccaaugaucgaccagcuagaaugcacaacuaaucucauugaucccuucguuguguucgagagaggaucucugccucagaccaggaacgacaaaacauuugcugccucaaagggcaaucggggcguacaggcguucaguaaggggagcgugcaagcagaucuuacccugauguuugacaacuucgaagucgauuuugugggagccgcuguuuccugugacgccgcauucuugaaucucacggguugcuacucuuguaacgcuggcgcccgugugugccugucgaucacuagcacagggaccggaacuuuauccgcgcauaacaaagacggcucacugcacauaguccucccaagugagaaugguacaaaggaucagugucagauucuucacuuuaccgugcccgaaguagaggaggaguucauguauucuugcgacggggaugaacgcccucuguugguuaaaggcacgcuaaucgccauugacccauuugaugacagaagggaagcaggaggcgagagcaccguggucaacccgaaguccgggucauggaauuucuuugauugguucagcggacugaugucuugguuugguggcccccucaaaacaauccugcuuaucugucuguacguggcuuuguccauuggacucuucuuccuguuaauauaucugggacggacuggccuaaguaagauguggcucgccgcuaccaaaaaggccagc

SEQ ID NO: 11395 - RNA, 1521 nt, Artificial Sequence
  derived and/or modified CDS sequence (opt3) from RVFV(2007001811)__EU574040.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaugaucaagacuguguccucugagcugucgugccgcgaagggcagucauacuggaccgggagcuuuagucccaaaugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaggaggccuugagagucuuuaacuguauugacugggugcauaaacucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaagggcuacgcuaucguggaugagccguucuccgaaauuccccggcaagguuuucugggggagauccgcugcaauucugagagcucaguccuuagugcacacgaauccuguuugcgagccccuaaccugauuagcuauaaaccaaugaucgaccagcuagagugcacaacuaaucucauagaucccuucgugguguucgaaagaggaucucugccucagaccaggaacgagaagacauuugcugccucaaaaggcaaucggggcguccaggcguucaguaaggggagcguucaagcagaccuuacccugauguuugauaacuucgaaguggacuuuguaggagccgcuguguccugugaugccgcauucuugaaucucacggguugcuacucuuguaacgcuggcgcccgugucugccugucgauuacuagcacagggaccggaacuuuauccgcgcauaacaaggacggcucacugcacaucgugcucccaagugagaaugguacaaaagaccagugucagauucuucacuuuaccguucccgagguggaagaggaguucauguauucuugcgauggggacgaacgcccucuguuggucaagggcacgcuaaucgccaucgauccauuugacgauagaagggaagcaggaggcgagagcaccgugguaaacccgaaauccgggucauggaauuucuuugacugguucagcggacugaugucuugguuugguggcccccucaagacaauucugcuuauaugucuguacguugcuuuguccaucggacucuucuuccuguuaauuuaucugggacggacuggccuaaguaaaauguggcucgccgcuaccaagaaagccagc

SEQ ID NO: 11396 - RNA, 1521 nt, Artificial Sequence
  derived and/or modified CDS sequence (opt3) from RVFV(Kenya 57 (Rintoul))__DQ380192.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuguugaucugggagcaagcaguucuagguuuaccaauugggguuccgugagccucucguuagacgccgagggcauuucuggguccaacucauucaguuuuaucgaaagcccaggaaaaggcuacgcuauagucgaugagccguucuccgaaaucucucggcaagguuuucugggggagauucgcugcaauagcgagucaagugugcuuuccgcacacgaaagcuguuugcgagcccccaaccugaucucuuauaagccuaugauugaccagcuagagugcacaacuaaucucaucgauccauucguggucuucgaaagaggaucacugccccagaccaggaacgacaaaacauuugcugccaguaagggcaaucggggcguucaggcguucagcaagggguccgugcaagcagaucuuacccugauguuugacaacuucgagguagauuuugugggagccgcugucucuugugacgccgcauucuugaaucucacggguugcuacucguguaacgcuggcgcccgugugugccugagcauaacuuccacagggaccggaacuuuaucagcgcauaacaaagacggcagucugcacauuguucucccuucugaaaaugguacaaaggaucagugucagauccuucacuuuaccgugccagaggucgaggaagaguucauguauagcugcgacggggaugaacgcccccuguuggugaaaggcacgcuaauugccaucgacccuuuugaugacagaagggaggcaggaggcgaauccaccguaguuaacccaaagucagggagcuggaauuucuuugauugguucucuggacugauguccugguuugguggcccgcucaaaacaauccugcuuauuugucuguacguggcuuugaguauaggacucuucuuccuguuaaucuaucugggacggacuggccuaagcaagauguggcucgccgcuaccaaaaaggccucu

SEQ ID NO: 11397 - RNA, 1521 nt, Artificial Sequence
  derived and/or modified CDS sequence (opt3) from RVFV(Beijing-01)__KX611606.1__Gc
ugcagcgagcugauccaggccuccucuagaauuaccacauguucaacugaaggcgugaauacgaagugcaggcucagugggaccgcucuuauacgggcaggaagcgucggugccgaggcgugucugauguucgaaggcguuaaagaggaccaaacaaaguuuuugaaaaucaagacuguguccucugaauuaucgugccgcgaggggcagucauacuggaccggcagcuucagucccaaaugucuguccucucgacguugccaccuaguaggagagugucaugugaauagaugccucagcuggagggauaacgaaacauccgcugaguuuucauucgucggugaaaguaccacuaugcgggagaauaaguguuuugagcagugcgggggauggggcuguggcugcuucaacgugaauccuagcugccuguuuguucacacauaucuucagucugugcgcaaggaagcccugagagucuucaacuguauugacugggugcauaaauugacccucgagaucacggauuuugacggguccguaucaacuauugaucugggagcaagcaguucuagguucaccaauugggguuccguuagccugucgcucgacgccgaaggcaucucuggguccaacucauuuaguuucauagagagcccaggaaagggcuacgcuaucguggaugaaccguuuuccgagauuccccggcaagguuucuuaggggagauccgcugcaauucugaaagcucaguccugagugcacacgaguccugucuucgagccccuaacuugauuagcuauaaaccaaugaucgaccagcuggaaugcacaacuaaucuaauagaucccuucgugguguuugagagaggaucucucccucagaccaggaacgacaagacauucgcugccucaaaaggcaaucggggcguccaggcguuuaguaaggggagcguucaagcagaucugacccuuauguucgacaacuuugaaguggauuucguaggagccgcuguguccugugacgccgcauuucugaauuugacggguugcuacucuuguaacgcuggcgcccgugucugccucucgauuacuagcacagggaccggaacucuguccgcgcauaacaaggacggcucauuacacaucgugcugccaagugagaaugguacaaaagaucagugucagauucuccacuucaccguucccgagguggaagaggaauuuauguauucuugcgacggggaugagcgcccucuucuggucaagggcacguugaucgccaucgacccauucgaugacagaagggaagcaggaggcgagagcaccgugguaaacccgaaauccgggucauggaacuuuuucgauugguuuagcggacuaaugucuugguucgguggcccccugaagacaauucuccugauaugucuuuacguugcucuguccaucggguuguucuuucuccugauuuauuuaggacggacuggccugaguaaaauguggcuagccgcuaccaagaaagccagc

SEQ ID NO: 11398 - RNA, 1521 nt, Artificial Sequence
  derived and/or modified CDS sequence (opt3) from RVFV(ANK-6087)__DQ380216.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagaucaaaacuguguccucugagcugucgugccgcgaagggcagucauacuggaccgggagcuuuagucccaagugucuauccucucgacguugccaccucguaggcgagugucaugugaauagaugccugagcuggagggauaacgagacauccgcugaguucucauuugucggugaaaguaccacuaugcgggaaaauaaguguuucgagcagugcgggggauggggcuguggcugcuuuaacgugaauccuagcugccuuuucguucacacauaucugcagucugugcgcaaagaggccuugagagucuuuaacuguauugacugggugcauaagcucacccuggaaaucacggauuucgacggguccguaucaacuauugaucugggagcaagcaguucuagguuuaccaauugggguuccguuagccucucguuagacgccgagggcaucucuggguccaacucauucaguuuuauagaaagcccaggaaaaggcuacgcuaucguggaugagccguucuccgaaauuccccggcaagguuuucugggggagauccgcugcaauucugagagcucaguccuuagugcacacgaauccuguuugcgagccccuaaccugauuagcuauaagccaaugaucgaccagcuagagugcucuacaaaucucauagaucccuucgugguguucaaaagaggaucacugccucagacuaggaacgacaagaccuuugcugccaguaagggcaaucggggcguccaggcguucagcaaaggguccguucaagcagaucuuacacugauguuugacaacuucgaaguggauuuuguaggagccgcugugucuugugacgccgcauucuugaaucucaccgguugcuacucguguaacgcuggcgcccgugucugccugagcauuacguccacugggacaggaaccuuaucagcgcauaacaaggacggcagucugcacaucgugcucccaucugagaaugguacuaaagaucagugucagauucuucacuuuacaguucccgaaguggaggaggaguucauguauagcugcgacggggaugaacgcccucuguuggucagaggcacccuaaucgccaucgacccauuugaugacaggcgggaagcaggaggcgaguccacggugguaaacccgaagucagggagcuggaauuucuuugauugguucucuggacugauguccugguuugguggcccccucaaaaccauucugcuuauaugucuguacguugcuuugaguaucggacucuucuuccuguuaauuuaucugggacgaacaggccuaagcaagauguggcucgccgcuacuaaaaaggccucu

SEQ ID NO: 11399 - RNA, 1521 nt, Artificial Sequence
  derived and/or modified CDS sequence (opt3) from RVFV(MP12)__Z30318.1__Gc
ugcagcgagcugauccaggccuccucuagaauuaccacauguucaacugaaggcgugaacacgaagugcaggcucagugggaccgcucuuauacgggcaggaagcgucggugccgaggcgugucugauguugaaaggcguuaaggaagaccaaacaaaauucuuaaagcugaaaacuguguccucugagcuaucgugccgcgaagggcagucauacuggaccggcagcuuuagucccaagugucucuccucucgacguugccaccugguaggagagugucaugugaauagaugccuuagcuggagggauaacgagacauccgcugaguucucauuugucggugaaaguaccacuaugcgggaaaauaaguguuucgagcagugcgggggauggggcuguggcugcuuuaacgugaauccuagcugccuguucguucacacauauuugcagucugugcgcaaagaggcccucagagucuuuaacuguaucgacugggugcauaagcugacccuggaaauuacggauuucgacggguccguaucaacuaucgaucucggagcaagcaguucuagguuuaccaauugggguuccguuagcuuaucgcuggacgccgagggcauuucuggguccaacucauucaguuuuaucgaaagcccaggaaaaggcuacgcuauaguggaugagccguucuccgaaaucccccggcaagguuuucuuggggagauucgcugcaauucugagagcucagucuugagugcacacgaauccugucugcgagccccuaaccuaaucagcuauaagccaaugauugaccagcucgagugcacaacuaaucugaucgaucccuucgugguguucgaaagaggaucucuuccucagaccaggaacgacaaaacauuugcugccucaaagggcaaucggggcguccaggcguucaguaaggggagcguucaagcagaucugaccuugauguuugacaacuucgagguggauuuuguaggagccgcuguguccugugacgccgcauuccucaaucugacggguugcuacucuuguaacgcuggcgcccgugucugcuuaucgauaacuagcacagggaccggaucccugucagcgcauaacaaagacggcagucuccacauugugcuuccaucugaaaaugguacuaaggaucagugucagauccugcacuuuacaguucccgagguggaggaagaguucauguauagcugcgacggggaugaacgcccuuugcuagucaaaggcacccugauugccaucgacccauuugaugacagaagggaggcaggaggcgaauccacggugguaaacccgaagucagggagcuggaauuucuuugauugguucucuggacucauguccugguuugguggcccccugaaaaccauccuucugauuuguuuguacguugcucucaguauagggcuguucuucuuacugaucuaucuaggaggcacaggucucagcaagauguggcuggccgcuacuaaaaaggccucu

SEQ ID NO: 11400 - RNA, 1521 nt, Artificial Sequence
  derived and/or modified CDS sequence (opt3) from RVFV(KEN/Bar-032/07)__HM586968.1__Gc
ugcagcgagcugauccaggccuccucuagaauuaccacauguucaacugaaggcgugaacacgaagugcaggcucagucacaccgcucuuauacgggcagggagcgucggagccgaggcgugucugauguugaaagguguuaaggaagaccaaacaaaauucuuaaagaucaaaacuguguccucugagcugucgugccgcgaaggccagucauacuggaccgggagcuuuagucccaagugucuauccucucgacguugccaucucguaggagagugucacgugaauagaugccugagcuggagggauaacgagacauccgcugaguucucauuugucggcgaaaguaccacuaugcgggaaaauaaguguuucgagcagugcgguggguggggauguggcugcuuuaacgugaauccuagcugccuuuucguucauacauaucugcagucugugcgcaaagaggccuugagagucuuuaacuguauugacugggugcacaagcucacccuggaaaucacggauuucgacggcuccguaucaacuauugaucugggggcaagcaguucuagguuuaccaauuggggauccguuagccucucguuagacgccgaggguaucucuggcuccaacucauucaguuuuauagaaagcccagggaaaggauacgcuaucguggaugagccguucuccgaaauuccccggcaaggcuuucugggugagauccgcugcaauucugagagcucaguccuuagugcacaugaauccuguuugcgagccccuaaccuggugagcuauaagccaaugauugaccagcuagagugcacaacuaaucucaucgaucccuucguggucuucgaaagagggucucugccucagaccaggaacgacaaaacauuugcugccucaaagggaaaucggggcguucaggcguucaguaagggcagcgugcaagcagaucuuacccugcguuuugacaacuucgagguagauuuugugggggccgcugucuccugugacgccgcauucuugaaucucacgggaugcuacucuuguaacgcuggugcccgcgugugccugucgauaacuagcacaggcaccgggacuuuauccgcgcacaacaaagacggaucacugcacauuguucucccaagugaaaauggcacaaaggaucagugucagauccuucauuuuaccgugcccgaggucgaggaagaguucauguauucuugcgacggugaugaaagaccucuguuggugaaagggacgcuaauugccaucgacccauuugaugacaggcgggaggcaggcggagaaagcaccguaguuaacccgaaguccggcucauggaauuucuuugauugguucagcgggcugaugucuugguuuggagguccccucaaaacaauccugcuuauuugucuguacguggcuuuguccauaggccucuucuuccuguuaaucuaucuggggcgaacuggacuaaguaagauguggcucgccgcuaccaaaaaggccagc

SEQ ID NO: 11401 - RNA, 4020 nt, Artificial Sequence
  derived and/or modified CDS sequence (opt3) from SFNV(Toscana)__NC_006320.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaauaucaccgagucuauuggucucacaucgggcacuugcaaggucgggucacuggaaaaccgggauuguaaacgcgacaucaugagcaauuauguugccgaggugcacaguaaccuucauggacugggcgcgaugaugcacaauuacggugaugacaagcgaguagaaguguugaacgaugucauacccgacgagcucaauccugggcgucauaacugcuccgaucuggacagaaaaccauucuggaccgaguuuaucaauguggcuaagccggccaacaagauugcacccaucucuguuauuccuccacccaucgugaaaccuauaccaauugccgaaagcacaaucaagaaaaccauucccuucgauaagcugcucuccgaggcugaaaaagaguuaaaucaaacuaagaucaggcuggagacagaacggcgcucaaacgcagaggaagccgcuagagagagggcccggaugcgcgaaaucgaggacaaacuucgaaagaauugggaguuggaaagagagaggaaggaugcggucgcagacgaucuggccaaagaaauugcucggcgucgcgagauagaaagaaaggcccacgagcuagacaaaaugcucaagaaaaaggagagggaagaccagguggcaaucgagcggguaagugaagauaugcgaaaccauguucgcagaccuaauaccacgauugcuccagccccgacuaucauaaccacacugcuuauggcgagcgccgugauggcaggaccccuggagaacagggaaacuaaccacuugcucaaucggccuggcaacggcgcuuauacccugucugacuuugccgaguccacauguaccuuagcuuacgggucaaagugcaaaagcugggagcaccagcuggaugaacucaguuucccauuuuuccauucuaaucuugacaaguauuccaugcuggaggccgcaacggaaacuauucccaucuugaacaaaagcucggccgucuguacaaucucuccuuccacccacucaaguaaugcuugcggacgcgaggcgagccuaauuaagaaaaagugugguaacaauauguccgcauuuuucuacgugaaccuggccggccaaaucacuguggucaagugcgauacaaaucauguucucucuaacgacugugggaauugcauuagcaaaacccugucaggacagaagauauacacgccagugcaggauauguuuugccagagaggcuggaccgagaguauccccuccacaagguauagcaaagaccuuuguucuauuggucugcacacuguaaaggaaugcaaaaccgggacaacuaacuucgagcgugugggauuuaucgucgugaagucacggaagauguacaucgaacaaaugaaaaugcgaaguagacaggaguucagcgaagaucaguucuuguguuauaaguccgagucuucgagcggcuccucaguuaaacucaagaaagugaaggucgagaguugcaagggcgugaccacaucuagcgcuuccaaauguucaggggacgaauacuuuugcagcagguauccgugugagaccgccaauguagaagcacacugcauucugcgccggcauucugccguuauagaggugaacgucaauggagugugggucgugccuagauguaucgguuacgaagagguuuuagugaggcgcacuucccugaagauggaggauacgaguagccgagaaugcgacacaugucuaugggagugcggcaaaaacaagcucauuguaaaaacccacgggcccaagaucgucuaugcuacugccugcucucauggauccuguaaaucagugaugcagaagccagcaaccuucguuuaccugccuuaccccggcaacagugaaauuguggguggggacaucggcguccacaugacagaggaaagcucgccauccaauauacauaugguggcgcacugccccgcuaaggauucuugugagguaagcucaugcuuguuuugugugcacggacuucugaacuaucaaugccauacccucuucagugcccugcuuaucuccacuacaguuaugucuauucugacguugcuccuguuacuggucaaaggcgcaaaggaccuagugaaaaagcucuuuuacuggcugaucaccccucuuuguugguugagcguguucugcggguggaugauuaaauccuggaagaagaaagucggaucagccaucagccggacuaaugauacaauagguuggcgugacaacagaagguauggccgcgauguugagcgggcucaguacaccgggggagccccaggcgcaaaguauaguuuuuacggugugaugauucuggggcuccugggcaaugugcacucuuguuccgaaagcguaaucgcugacucgaaagucaugcagugcacaacuucaggaucuaguaccuuauguaaggccuccggcacggugauuaugaaacuggggccgaucggaagcgagucuugccuuauauugaagggucucaaggauaacgaaaaacaauucaucagcauuaagaccaucuccucagagcugacaugcagagagggcgaaaguuuuuggacuacccuauauacacccguuugucugagcucuaggcgaugccaucucaugggggaguguugcuccgaccgcugucugaaauggaagacuaaugaaaccucagcggaguucacgggaaaagcccacggcgaagugaugcacgagaaccggugcuuugagcagaguggugggauuggcuacggauguuucaaugucaacccuagcugccuuuacgugcauuccaucuugaagucuguuuauaagaauggcuuuaaaauauucagauguguggcuuggaaccacaggauucgucuggaaguaacaacccauucgcgcaaguucccaauggucuuaauggcaaugagcacucagcccacagauugggggucaaucggacucauccuggacuccgagggcauuaccgguacuaaugccuacaguuuuaugaaacacgggucuggaagccuugcuaucauugaugacccuuauuccccagaaccccggaagggcuuccugggugaggugagaugcccgaccgaagagacagccauaagggcaucaccuucuuguaaaauggcgccaaacuugaucgaguaccagcccgaaauggauacggccgagugcaccacuaauaugauugacccuauggcuaucuuuaaccgaggcagccucccccaagugcgggacgggaugacauucacccagaguauugaaaagaacacaguccaggcccugacuaccggagagguucgcgcauccaucagacuaacgcuggaugacuaugaugugguauaccauaauagccagucugacugcucagcuacauuuaaaaaccucaccggcuguuauuccugcgaugaagggaguaggauguguuaccaagugaaggccgagggagagacuauauuccacuuugucaaugaagacgagagcaucaacgugauuaauaagguuucgccagaugugucugacuacugcaccguccugcacuucucccggccugugaucagcauugaaggccgauaugauuguggucuuucaaaaagucccaugguuaucaaggggacauugauagcaacugccccacaugacgauagaaaacacgagggagguucuucccugguggucaacccgaagggcggcaccguagacuuuuucgggugggugagcggauuaacaucauggcucggcgggccucugaaaacguuucuuaccauucugggauuccuagcucucggccuguugcugguugugaucaucauuacuauagcgcgcacaggugucgagcaggccuuaaagaagaaaaauaaguga

SEQ ID NO: 11402 - RNA, 3972 nt, Artificial Sequence
  derived and/or modified CDS sequence (opt3) from SFNV__HM566171.1__GP
augcugaacaccaagagcaucauucucauaacaugccuugugcagcaaguccaccugaaauacacuaucauuuccgagguuacgaagggcgccagagaagugucuuguuauucaaguaccacaagguuggaccaguuacuggaggcuugggaaaauaaaagcgcacuaauggggcuccggaagggaaacugcaaacugggugccauggagcagguagauuguaaucuugaccugauguccaacuacgugucuaaugucuaugauaacccccauggcuugggggcgaugauguacaaugacaagcgcaucgaagugcucaacgaucagauuccugacucgaugaucccaggaggccacaauugcucacugcuggagcgaaagccguucugggcugaucucauacccagcaaaaaggagaacccucguccaaguuuaaucucccugguucccacuccuagaucugacuuuaaaaggaaguucgaagaggccgaagaggagaugaaaaagauucggaaggaacuucaagaugagcgccaggcacaguugagcgugaucgaagaggguagaaaaaggaugcgggaccuggaagauaagcuaaugcgccaguggaaugaggagaaacaaaagaaagggcuccuggaagagacccuugaaaagaaacgacagcugaagaacaaggccuugcucgacgcucauaaucuggauaaacaguuaaaggagaaagacagagaauuuaagacagcaauggaggagcaccagaacgaaaggcaucggauuaauuccaacaugauccguccacccauaaccacuccugccgcugucauucugacaucacuccuuagugccagcgugguacugggauucgaguuggaaaaccgcaauaccaaccacgcgcuaaauagaccaggcaacggcggguauucuaucuccgacaauaaccugauugaggcaaaauguaugaucacguacggaaauaagugcccgucaugggaaaugcaacucgaucccguuagcuauccauuuuucaguucuaacuuugagaaguacucccugcuugagagcaucucggaaacuucuccuauuauagguaaauucuccgagguguguguccugucaaauuugcccggcgcccagaagaccugcgcuaaagaagccagucucaucaagaaacaguguagcgacgauaugagggcauacuuuuauauuaacucccuggggaaguuagcuaucgugacaugcccugagaauaacgugcugucucaagacuguaauuucugccuacggaaggccaaaggagagcaguacgucuauaagccaauacaggauggcuuuugccagaacggugggguuagcucagugcccaguauucgauacuccaaagacaucuguagcaucggaccgacuaagguaaagaauugccacaagggcaccucucgcuaugaaagaacagcguucauuucaaccggcgauaagaaaguguaccucgaggaaaucaagauuaggagucggcaagaguaugaaccugaccaguuucuguguuacaaagucaaggauagcuccucuucgccccuugccuacgagaaagugcagguuagcaagugcaaagggauagagacgaacuccccaaagaaguguacuggagacgaauauuucugcucaaaauacccuugugagaguacaucucccgaagcaaacugcuucuugcgcaagcauagcgcuauccuggaggugaauauugguggcauguggaucaaaccaaaguguaucggguaugaaauggcccucgucaaaagagugggacugagguccgaggauguaucaagcaaggagugcgcuaccugucuuugggaaugcagcuccggcuacauuaguauaacuacacacggucccaagaucagcuaugccaccgcaugcucucauggguccuguaaaucaauuguucagaacccuaguacgagcauccguauuucguacccaggcaauuccgagaucgugggaggcgacauagggauccaccugaccgaagacucuagcccgauuaacuugcaccucaagauccauugcucacccaaagauaguugugaggucuccgacugcaucuuuugugugcacggacuguuaaauuaucaaugccauucugucgccagcgcucugcuacucuccacaauuacugcgucacugauagugcuuaugauuuacauguugagcaagaccaaauucguuaugaagaagcugaucccuauuaugcucacaccacuguguuggugcuuuguguuacuggcauggcuuacuaaaaguuggaaggguaaaaugcggaacgccauccagucugcuaauuccaccauaggcuggacagaacgagaggagagaaucguagccgaaaggccccgcagccggaacaccgucagauacucguucuauggggugguuauuuuggcaaugcucgagucagccuuuggauguucugaaagucugaucgcugaguccaaggugaugcagugcaauauugccaacggcaaaacuagcuguagggcaucugguacgaucauaaugaagcuagggccuauuggcagcgaggcgugccugauccucaagggacugcgcgauuccgacaaacaguacaucucagucaagacagaaaguagcgagcuuauuugccgagaaggcgagucuuucuggaccuccuuguauacuccagugugucugucaagucggcguugccacuuaaugggggaauguaccggagaucucugccugaaauggaagucuaauaaaacaucccuugaguuugcugguaagaccagaucugacguaaucaacgagaauaaauguuucgaacaaucgggcgggcugggauacggcugcuuuaacgugaaucccagcuguuuguauacucaugccuaccucaagucaguuuauaggaacgguuuccgcgucuuuaagugcgcauccuggacacaccgggugaaacugacgauuaccacucacaguagaacauucccgaugacccuagccgcuaugucuacacagccuacugauugggggagcauaggccugauccucgacuccgagggaauuucaggcaccaacucuuuuagcuucaugaagcaugggcugggaaguuucgccaucauugaugaaccauacuccauggagcccaggaaaggcuuuaucggugaagugcgauguccuacggaggaggcagcuauaaaggccagcacccuuugcaaaacagcgccccaguugaucgaauaccagccagagauggacucugccgaauguacuaccaauaugauugauccuaugucagucuucaaccgcgggucccugccccaaguucgggagggaaugacauuuacucagaguauggaaaagaauaccgugcaggcuaugacgacaggcgaggugcacgcaagcaucagaauuguauuagacgauuaugaggucgaauaccucucgucucaaguggacugcgacgccaccuucaagaaccugacugguugcuauuccugugaugagggcgcuaggguuugcaugcagaucauagcccauggggacacaauuuuucacuuccguaauccagaugugagcaucaacauccuucagaaagucaauaccaacacucugauuuacuguucagugguucacuuuaguaagccggugauaaaagaagagggaaccuaugacugcggcgcaggggagaagccuaugauccuaaaaggaacacucguagcggucucuccccauaaugaucgccuggaacagggcgguuccagcauugugaucaacccaaaagggggaggcguggacuucuuggguuggcugucaggcuuuaguagcugguucgggggacccuuaaaggccauucucauggucaucggcuuucugcuucugggguugauacucuucguuacgaucgcuauuggacugaaauuugcccuacggcaaaugaucgugaagagaaugaaauga

SEQ ID NO: 11403 - RNA, 3873 nt, Artificial Sequence; identical to SEQ ID NO: 11086
  derived and/or modified CDS sequence (opt3) from SFNV(Namru)__HM566169.1__GP

SEQ ID NO: 11404 - RNA, 3990 nt, Artificial Sequence
  derived and/or modified CDS sequence (opt3) from SFNV/SFNV-like(Poona)__HM566177.1__GP
augcugaacgucaagagcgugauccucauuaccugccuuguucagcaagcccaccugaaauacacaauaaucuccgagguggcuaagggcgcaagagaaguaucuuguuauucaaguacuacgagguuggaccaguuacuggaggccugggaaaauaaaagcgcgcuaauugggcucaagcggggaaacugcaaacugggugcuauggagcagaucaauuguaaccuugaucugauguccaauuacgugucuaacgucuaugacaauccccauggcuugggggccaugauguacaacaccgauucggacaagcgcauugaagugcucaaugaucagaucccugacucaaugauaccaggaggccacaacugcagccugcuggagcgaaagccguucugggcagaucucauacccccuaaaaaggagaaagaauuagacccaaagcccagucugauuucccuuguuccuacaccacgugaugacuuuaaaaagaaguucgaggaagccgaggaggaaaugaaaaagaucagaaaagaguugcaaaaugaaaggcaggcucagcugucugugauggaggauagccggaagaaaaugcgcgaccuagaagauagacucaugaggcagugggaggaggaaaagcaaaagaagggucugcuugaggaaacucuggagaaggaacggcaguugaaaaacaaggcacuccuggacgcccaugacuuagauaaacagcugaaggagcgcgaccgagaguuuaaaaccgcuauggaggaacaccagaaugaaagaaggcggauuaacuccaauaugauccgucccuaugucacaaccccugccgcgauaauucucacuucacuucugagugcaagcgugguaguuggguucgaguuggaaaaccgcaacacaaaucaugugcuaaacagaccaggaaauggcggcuacucuaucuccgauaacaaucugauugaggccaaguguaugaucaccuaugggacgaagugccucucaugggagaugcaacugaacccggucagcuaccccuuuuucaguucuaauuuugaaaaauacucccuucuggagagcgugucggaaacuaccccuaucauuggaaaguucucugaggugugugucuuguccaaccucucaggugcucagaaaacaugcgccaaggaggcaagucugaucaaaaagcaguguccagacgauaucagggcuuauuuuuacauuaauagcuuaggcaagcuggccaucguuacuugccccgaaaacaaugugcuaucccaagacuguaacuucugcguaccuaaagcgaagggggagcgguauauauacaaaccaauucaggauggauuuugccagaauggcggugugucuaccguccccagcgugcgauauucaaaggacaucuguaguaucgggccgcucaaaguuaagaacugccacaagggaacaucccgcuacgaaagaaccgccuucauuagcacgggcgauaaaaagguguaucuggaggaagucaaaaucaggucucggcaggaguacgagccugaccaauuucuuuguuacaaggugaaagauggcucaaguagccccuugguauaugaaaagguucagguguccaaaugcaaggggauugagacuaauucuccaaagaaauguacaggagacgaauacuucugcucgaaguauccuugugagagcaccucccccgaagcaaacugcuaccugcgcaaacacucagcuauaaucgaggucaacauugguggcaugugggugaagccaaaaugugucggguaugagauggcccucgugaagagaguuggacugaggagugaagacgugucucuuaaggagugcgcuacuugucugugggaaugcagcuccucauacaucagcaucacaacccauggccccaaaauuucuuaugccacggcaugcucccacgguaguuguaagagcguaguccagucuccuuccaccucaauaaaaaucaguuacccagggaauagcgagauugugggcggagauaucggcauucauuugacagaagacucguccccgguuaaccuccaccugaagauccacugucccccuaaagauucuugcgaggugagcgacugcauauuauguguccaugggcugcuaaauuaccagugccacucaguggccagugcucuccugcuuuccacuaucauugcgucuuugaucgcacugguaguguauaugcucagcaagacccguuucguuaugcggaagauugucccaaucauguuuauacccuucuguuggugcuuugugcuguuagccuggcugacacgauccuggaaaggaaaggugagaaacgcuauucaaucagccaauaacacuaucgguuggaccgagagggaggaacgcgucauugcagaacggccuggcgggagaaauacaaucagguacagcuucuauggaguugugauacuugccaucuuggagagugcuuuuggcuguucugagucccucauugccgaaagcaaaaucaugcagugcaacauugcaaaugguaagaccucgugucgcgcgucagggacuaucauaaugaaacugggcccaauuggaucugaggcuugccuaauccugaagggccuccgagauagugacaagcaguacaucuccgugaaaacggaaagcucugagcugauuugccgggaaggggagagcuucuggacaucccuuuauacccccguauguuugucaagucguagaugccaucugaugggagaguguacuggugauuuaugccucaaguggaaaagcaacaagaccucucuggaauuugccggcaaaacacacuccgaggucaugaaugaaaacagguguuucgagcagucagggggacuuggcuacgguugcuuuaauaucaacccgaguugucuguauacccaugcauaccucaagagcguguaccgcaauggguuccggguuuuuaaaugcgccuccuggacucacagagugagguugacaauuacgacccacucucgaacuuucccuaugacacuggcugccaugucgacccaaccaacagacuggggcagcauaggacuaauccuggauucagaaggcauuuccgggacuaacaguuuuucuuucaugaagcauggacucggcagcuucgcaaucauugacgagcccuauuccauggagccucgcaaggguuuuaucggggaaguccggugucccaccgaggaagcugccauaaaagcgucaacgcugugcaagaccgccccacagcuuaucgaguaccagccugaaauggauucuguggaguguacaacuaacaugauugaccccaugagcaucuucaauagaggaaguuugccacagguuagggagggcaugaccuuuacacaauccauggagaaaaacacugugcaggcuaugaccacgggugaaguacacgcaagcauucgucuggucuuagaugacuaugaaguggaguaccucucuaaucagguggacugcgaugccacauucaagaaccugaccggcugcuauucaugugacgagggggcucgcgucugcaugcaaaucaaagcccauggagauacuauauuucacuucaaaaauuccgacaugaguaugaacauucuucagaagguuagcacaaauacccugaucuacuguucggugguacacuuuucuaaaccggugaucaaggaagagggcgucuaugauugcggggcaggagaaaaaccuaugauucuaaagggcacucucguggcgguuagcccccauaacgaccggcuggagcaggguggguccucaauagugaucaauccaaaaggaaguggcgucgauuucuuggguuggcugucuggcuuuuccagcugguucgggggacccuuaaaggccauucucaccgugaucggcuuucugcuucugggguucuugcucuuuaugcugguuacaauuggacuaagauacgcucugucacagguggucacgaagaaaaugaaguga

SEQ ID NO: 11405 - RNA, 4002 nt, Artificial Sequence
  derived and/or modified CDS sequence (opt3) from Arrabida virus(PoSFPhlebV/126/2008)__KP863800.1__GP
auguucuacgccaaguuuauccugcuccuuugcuucgugcagggcgcucuguugaaauauaccauuauaagcaaggucggguccucuacauacaaaagaguuuguuuaucacacacuacggaccuggauacccuacucgacaugacaaguagggagaugagcaacaucaagcugacuggagguuccugcucucuuggcgaucugaccaaacccgacuguucgccugacuuuuucucaaauuauguggcaaacauucaaagcaguaauacaaagaucaccgggaaguuucaggauauuaucggagaacgggagauggaaguaacuaacgauguggucccagacuccuucggcccggguccccaugauugcgugucuuuugacaaaaagccuuucuggagcgauuugcucccaacauccguuucaaaagaggaacccaagccuauaaucaguacccugagcgugcugccagccgcgcccccuauuaaagacuuuucucacaaggucguggaggcugaggaaaugguaaaggagaucgaaggggagcucaugaaagagaaggaacgcaauuccgccaaagaggaagaggcacgacagcguaugagagaauuagaggaugaccugaggaagcagugggccgcugagcggauggcaaaacaaaacaugucaagcguucuugaacgcgagagacaggaaaagcagaguuuggagaggcggaugcaugaaguggacaaaaagcugcgcgccucugaggaucgagcucagaaguaccaagagagagccgaacaggcggagaaaucccacagcaagcuacucucgaggucuggagcagccacgacuauggcuaccgucguguucacaucccugcuugccucaggccuggcaguggucacugaauuggagaaacgggacaccaaucaucuccugaaccguccaggcaaugggguuuauauggcuaacgccgauaguuuaauucagacagaauguacccugaauuacggacagcgcugccucgcgugggagcuucaaaucacgccggugagauaucccuuuuucacuagcaacguagacaaguacucccuguuggagucuauaacagaaaccccuagcauucuagagaaaaauaacgaaucaugucagcuggccacuacaagugguucccucaagaccugcgcaaaggaggcuagcacgaucaaaaagcacuguaccgaugacgugagggccuuuuucuucauuaauucugucggcaaacugacaaucgugcggugcgcugauaaccacauccuuucagaggacuguaacuuuugcauuaguaaggcccgaaauagcaaccagaauauguucaugccaguucaagaugcauuuugccagcgccagggguccgacacugcccccgcuauaagauacucuaaagauaucuguucgauuggagcgaucaagauaaagcagugccauaaagcaaccagcaaguucgaaaggaugggcuuuauuuccgugggucagaaaaagcuguauaucgaggaauugaaacuccgguaccgccaagaguaugacccugaccaguucauguguuacaagaucaagucaaguucuccacugaaauaugaaaaggucagcuccaaaaagugcaaagagguggauacagggggaaaccagaaguguucaggcgacgagcacuuuugcaauagauaccccugugauacugccaacccggaagcucauugcuuaaccaggaaacacagcgccauugcagagguaaauaucggcgggguuuggauucguccuaagugugugggauaugaaaugguccuggugaagcggucuggucuaaaauccgaggaccucaguauacgagauugccccagcugucugugggaaugcaagaaaucuagaaucacaauuaagacccacggcccaaaaaucgucuccgccacugcuugcucacaugggaguuguaagagcgugaugcaaaagccuucgacguucguugagauccccuacccaggaaacuccgagauuauaggcggugacaucggggugcacaugacagaaaggggcucucccagcaauauucauguacgcacccacugcccuccacgggauucaugugacgucagugauugcauguuuugugugcauggaauccuuaacuaccagugccacacuuuggccuccgcacugaccauugcgacaaucguuucugcugugcucgucgugguauauuuccugcuugccagaagcaaaagggcagugaaguuuauaaccucccuguugaucguuccguucaaauggcucacucuguuaucaauuugggucgugaagaauuggaaacgcaagaugagcaagcuggcccgagcuacaaacaaugccaucggcugggaccaggauguggagcgggggcgucccagagcagcugccggacaccagaaccaagucgcgagguacacguuuuauggugccaccauucuaagucucaugacuucuggccuguguugcacagaauccguuaucgcugagagcaauauaaugcaguguaccacaucggacucaacuaccacgugcaaagcaucugggaccauuauccuucgcuugggaccuauuggcagugaauccugucugauccucaagggucugcgggauagcgagaaacaguucauaucuaucagaacagugagcuccgaguuaacuugcagggaaggggacucauucuggaccagucuguacacaccaauuugccuuagcucucgacgcugucauuugaugggcgagugcacuggagacaacugucucaaguggcaggauaacaaaaccuccucagaauuuacgggccggacacacagugaggugcugcaugagaauaagugcuucgaacaaagcgggggaaucgguuauggcuguuuuaacguaaaucccuccugccuaaugguccacucuuaccugaagccuauuuauaaaaacgccuucaagguguuuagauguguugcuuggaaucacagggugaaacucgccaucaccacucauaagaaaucguucgacgucacacugauggcaaugagcacccagccaacugauugggggucaauaggacuuauuuuggacuccgagggcaucaccgguacaaacaguuacucuuuuaugaaguacggggugggcagcuucgcgaucauugaugaacccuuuuccaucgagccgcguaaaggauuccugggcgaaguucgcugcccuacggaggagaccgccgugaaggcuucaccaucuuguaaggccgcaccccagauuauagaauaucacccugagauggacacuguagaaugcaucacaaauaugauggaucccauggcuauuuuuaaccgggggagcuuaccacaagucagagacggagugaccuucgcccagaguaucgagaaaaauuccgugcaggcacucacaacuggcgaaauuaaggccagcgucaggcugguucuugaugacuacgagguggaguauaaaguaucugaaaacgauugugacucaaccuuuaucaauauaacggguugcuacuccugcgaugagggggcucgacugugugugcggauccgcacauugggagacaguauuuaucauuucaccgacagcgaagauaugaugaacgucauguucaagguuaauucgucugugacugaguacugcaccgugcuccacuuuuccaaaccugucgugaacuucgaaggcaaguaugacugugguaagagcagaaaacccaugaucauuaagggcacacugaucgcgauggccccacaugaugacaggguucacucagggggaaguucuauaguggucaauccgaaauccaagggcguagauuuucuaggguggcugagcggacucucaaguuggcugggcgguccucuuaaaacuguguugaccguucugggguucuuaauucucggacugguguuugucaucgugguaaucuuccuugugcgggucggcauucgacaggcacugcuaaagaagaugaaauga

SEQ ID NO: 11406 - RNA, 4005 nt, Artificial Sequence
  derived and/or modified CDS sequence (opt3) from Massilia virus(127)__KT906100.1__GP
auguucuacgccaaguuugugaucagccugugccucgagcccggcuucucccuuaaauauaccauuauaucuaagucagggaguggaacaaucagacagauuugucugagccacuccacugacaucgauaaagucuuggaauuaucuucgggugagaugaacacgauuggcauccuagggggacuaugcaccuuuggcgaacucaagagggaggacuguucaccugauguuuucagcaauuacguggcuaacauguaugguacagcacauccaaguuccugcaaauuuguagacauaacuggggaucggucuaucgaagugcugaaugacgccgucccggauagcuucacccccggagcgcacaacuguuccucauuugagaagaagccuuucuggacagaccuuauuccagcuaaaaauaguagcggcgccauccccucugugguuuccgugcugccuucagucgcagagcaugauuuuaacuugaaggugaaagaagccaaugacaagcucgagguaauucaacgcgaacuggcugcagagaaagcccgaagcggccgucuggaggaugaagcuagagccaagaugaaggcgcucgaggacgaauuaaggaacggguggcuggcagagcgggaagccaaagagcuugcuaagagugccuuggagaaagaacgcaucaauaagcuggagguugaaagaaaacuacacgaucucggaaagaaacugaggcagucugaggacgacguggaaaagaugcggguccaucacaagaaaggucgcaaggaguccgaugaggaaaugaaaauagcacgaaccacugcuccaagcgugucgacaacccuugccacgguggucuucacuucucuguuggcgaccggccucgccgcaauugagcccaucgaagacagaaacguuaaucacauucugaacaggccuggguccggaguguacauggcuucaccaacauuaacucagaaugagugcagucuggauuauggcaaggaauguaaagccugggagcuccagguaagcccgcuucauuaccccuuuuucaccuccaacguggacaaguauacauuucuggagucuaucaccuugcuaccuccaauccugcucauuaauaacgaguucugcgaacugacgacuagcucagguccccuuaagcaaugucagaaagaaaguucccugauaaagaaaugcuguacagaggaugcucgggccuacuucuuuaucgacuuggaggggaagcucagcauuguccacugcucuaacaaucaggugcugucagaagauugcaacuucuguguuaccaaaaguggaggcgugagccauaagaucuuuaugccuauacaggacgcauucugccaaaagggcggguccgagucuauuccagucgugcguuacucgaaagauaucuguagcaucggauuauccaagguaaaaucaugccacaagaguacuucucgcuaugaaagaauggguuuuauuguugccggcaaaaagaagcuguacaucgaggaccuaaaaaugagguaucggcaggaauacgaugaggaccaguucuuuuguuauaaggugaauaaaacaagcccccucgaguacgggaaggaauccccgucaaaaugcaagggagucggcagcaacgagcagaaauguaauggugacgaauauuucugcaaccgauacccuugugagaccaauucucccgaagcucacugcucccugcgcagacaugcggcaguggucgagguguacguugggggcgccuggauuaagccaaagugugugggauaugagaaaguacuugucaagaggggcggguugaaaacggaagaucugagugugcgggagugcaccagcugccucugggaaugugagaagaacaaaauaguuaucaagacacacggaccuaagauugugucugcuacugccugcgguggccgcuccuggaaaucagucaugcaaaagcccaguaccuuucuggaccuuccauaccccgggaauagcgaaaucaucggaggcgauagagguaaccaucugucggagaggggguccccuuauaauauucacucuacaauacauagcccaccggaggacucacgugaugcaagugacuguaucuacugccggcacggcuugcucaacuaucagucccacucuguggaaagcgccauucuguuauccacuguaguggcuaccauccuggcccuaacaggaguuguccucucacgaagcaaaagugcagugagauuccuggcgucugcuguggccguccccuuuagguggguuucccuuuuggugguguggguaaugaagaaauggaaggcacgcgucgccaccgcuauucgggccacuaauaacgcaaucggcugggauaaugggcuggagcaggcuagaguggaaaacgccgcgaggcgccaacagacggccggacgauggcggagccucgacgcuucgacaauacugucaguuuuaucuaccggucuguguugcacugagagucuuaucgcagaguccagcauuaugcaguguaccacaggcgaagggucuaccacuugcaaggccacaggaacgguggucuugaaacucggcccuaucgguagcgaguccugucugauucuaaaggggcugcgugauaacgaaagacaguucaucucaauaaaaaccauuaguagcgagcucacuugcagggaaggcgagucuuuuuggacaccacuguacacccccgugugucuuuccucacgccggugccauuugaugggagagugcacaggcgacaugugucugaaguggaaaaguaauaagacuagcuccgaguucaccgggaagacgcacucugaaguuauccaugaaaacaaaugcuucgagcaaucgggaggcauugguuauauguguuuuaaugugaacccuagcugcuuaaugguacacucauaccucaagccaaucuacaaaaaugcuuucaaggucuuuagauguauagccuggaaccacagggugcgacuggggaucaccacacauaaacgcaaguucgaagugacucuuauggcaauguccacccagcaggcggauuggggaaguauuggccugaucuuggacucugaggguauuagcggcacaaauuccuauucauuuaugaaacacgggcucggaucuuacgccaucauagaugagcccuauagcgucgaaccgcggaagggcuaccugggggagguuagaugcccuacugaagagaccgcuauuaaggccaguccauccuguaaaguggcacccggacugguagaauaucagccugagauggacacgcuggagugcacaaccaacaugauggaccccauggcuaucuucaauaggggcagccucccacaagugcgugguggguggacuuuuucucagucaaucgaaaagaacucccgccaggcccugaauacaggagcaauuaacgccaguguccggcaugugcuugaugaguacgaguucgacuauaaaguuaagaccaaugauugugacagcacuuuugugaacaucaccggcugcuacucgugugaugaaggugcuagauugugcgucaaagugaggacaucuuccgaggcgauuuaccacuucacggacagcggcuauaauauaaacguucuguuuaagguggaaucagggguccaugaucacugcaccaucuuacacuucaguaagccuguaauuucuaucgagggaaaauacgacuguggcaagaacaaaaagcccaugcucauuaaagggacucugaucgccauggcaccacaugaugaccgagugguuuccggaggcagcucaacaguggucaauccgaagggucaggggguggauuuucuuggauggcugagucggcuaagcuccugguucggcgguggcccucucaagaccuuccugaugguaacaggguuuuugaugacuggagugauaggcgggaucgucaccauuauccugauucgcaucguuuuacaacaggcucucgccaaaaaggugaaauga

SEQ ID NO: 11407 - RNA, 4005 nt, Artificial Sequence
  derived and/or modified CDS sequence (opt3) from Massilia virus(130)__KT906101.1__GP
auguucuacgccaaguuugugaucagccugugccucgagcccggcuucucccuuaaauauaccauuauaucuaagucagggaguggaacaaucagacagauuugucugagccacuccacugacaucgauaaagucuuggaauuaucuaggggugagauggacacgauuucgauccugggcgggcuaugcaccuuuggagaacucaagcgggaggauuguucaccugacguuuucagcaacuacguggcuaauauguauggcacaacucauccaaguuccugcaaauuuguagauauaaucggugaccgcucuauugaagugcugaacgaugcagucccggacagcuucacccccggggcccacaauuguuccucauuugagaagaagccuuucuggacagaucuuaucccagcgaaaaacaguagcggagcuauucccucugugguuuccgugcugccuucagucgccgagcaugacuuuaauuugaaggugaaagaagcaaacgagaagcucgaaguaauccaacgagagcuggccgcugagaaagcacguagcggcagacuggaagaugaggccagggcuaagaugaaggcccucgaagacgaguuacggaauggcuggcuggcggaacgcgaggcaaaagagcuugccaagagugcuuuggaaaaagagagaauaaacaagcuggaaguugagaggaaacuacacgaucucgggaagaaacugcggcagucugaagacgacguggagaagaugcgcguccaucacaagaaacgaagaaaggaguccgaugaagagaugaaaauugccaagaccacugcaccaagcgugucgacaacccuugcuacgguggucuucacuucucuguuggccaccggacucgcggccaucgaacccauugaggacaggaauguuaaccacauccugaaucggccugguuccggcguguacauggcaucaccaacauuaacucagaacgaaugcagucuggauuaugggaaagaguguaaggcuugggagcuccagguaagcccgcuucauuaccccuuuuucaccuccaauguggacaaguauucuauccuggaaagcauuacacaaucaaguccuauauugcugaaaaacaauaacuccugcgagcuaaccacgagcccaggaacucagaagcagugucagaaagaaucuucaacaaucaagaaauacugcaccgaugacgcccgugcuuacuuuuucauugaucucgagggcaagcugaguaucguccacuguacuaacaauuauauacuuagcgaggacugcaacuucugcguguccaagcugggugaaguugggcauaaaauuuuuaugcccauccaagaugccuucugucagaagggaggcucugagucgaucccuauugugcgcuacagcaaagacaucugcuccauuggcuuguuuaagaucaaaaauugucacaagucaacaaguagauaugaaaggaugggguucauagucgcaggaaagaaaaagcucuacauugaggaacugaaaaugcgguaucgacaggaguacgaugaggaccaguuuuucugcuauaaggugaaaaagaccucuccauuagaauacgccaaaguaagccccuccaaguguaaggguguuggcucaaacgagcaaaaaugcaauggggacgaauacuuuuguaaccgcuauccgugcgagacgaauagcccugaagcucacuguucucugagaaggcaugcggcaguggucgagguguacgucggaggcgccuggaucaagcccaaaugcguggguuaugagaagguucuagugaaacggggcgggcucaagaccgaagaucuguccguacgcgaguguacaaguugccuuugggaaugcgagaagaacaaaaucgucauuaagacucacggaccaaaaauagugagcgcuaccgccuguggccaugggucuugcaaguccguuaugcagaaaccuucaacauucuuggaccugcccuacccaggaaauagugaaaucauugguggcgauagagggaaccaccucagcgagaggggaucgcccuauaauauccauuccacuauucacuguccuccagaggacucucgugaugcaagcgacugcaucuacugucggcacggccugcuuaacuaucagucacauaguguggccuccgcuauacuguugucuaccgucguggccacaauccucgcacugaccgguguaguguuaagccgauccaagucagcgguuagauuucuggcuagcgccgucgcagugccguucaggugggugagucuacucgucguuugggugaugaagaaauggaaggcccgcgugacuacggcuauucgggccacaaauaacgcaaucgggugggauaauggccuggaacaaguaagagucgagaacgcugccaggcgccagcagcccgcggugcgauggcggucucuugacgccuccaccauuuugagcauccugggaacuggccucugcuguaccgaaucgcugauagcugagucaucuauuaugcagugcacaaccgaggaagggaguacuacauguaaagcaacgggaaccguuguguuaaagcuggguccuaucggcuccgagagcugccuuauuuugaaagggcuccgugauaacgaaaagcaauuuaucucuauaaagacuaucagcuccgagcugacauguagagaaggagagucauucuggaccagucuauacacaccagucugccugagcucuaggcgcugccaccucaugggcgaguguacuggugacauuugccugaaauggaaguccaauaaaaccucaagugaauuuacggggaagacccauagcgaggugauccacgaaaacaaauguuucgagcaguccggcggaauuggcuacaugugcuucaauguuaaccccucuugucuuauggugcacucguauuugaagccuaucuacaaaaaugccuuuaagguauuccggugcauagcuuggaaccauagagucaggcuggggauuacaacucacaagcgaaaauuugaaaucaccuuaauggccaugagcacacagcagacugauuggggaucaaucggccucauucuggacuccgaggguguggcagggaccaaugcguauaguuucaugaagcauggacuuggcucuuuugccaucauugaugagccauacagcguggaaccccgcaaagguuaucugggcgaggucaaggggccgcgggaagagacggcuauaaaagccuccccuucaugucaaguugcaccaggauugguggaauaccagcccguaauggacacaguggagugcaccacuaacaugauggacccucucgcuaucuucaauagaggcucucugccccagguccgugggggauggacauuuagccagaguauugagaagaacucccuacaagcccugaauaccggcgcaauccacgccagcgugaggcauguucucgaugaauaugaguucgaauacaaggugaaaucuaacgacugugauucaacuuuugucaauauuaccgguugcuacuccugugacgagggggcucgccugugcgugaagguucggacaaguagcgaggcgaucuaucacuucacggauucgggauacaacauaaaugugcuuuuuaaagucgacucuggcguacacgaucauugcaccaucuugcacuucuccaagccagugauuagcaucgaagguaaauaugacuguggcaagaacaagaaaccuaugcugauuaaggggacuuuaaucgccauggcaccccaugaugacagaguugugucaggaggcaguucuacagucgugaacccaaaagggcagggaguagauuuucucggcuggcuguccggucuuagcucaugguucgggggaggcccgcugaagaccuuccuaauggugacagguuuucucaugacuggcgucauaagugggauuguuaccaucauccugauuaggauaguguugcagcaggcucuggccaaaaaggugaaguga

SEQ ID NO: 11408 - RNA, 3999 nt, Artificial Sequence
  derived and/or modified CDS sequence (opt3) from Massilia virus(W)__EU725772.1__GP
auguucuacgccaaguuugugaucauucugugccucguccagggcuucagccuuaaauauaccauaaucuccaagucugggucaggaacaauuagacaaaucugucugagucacagcacugacauugauaaaguuuuggaguuauccucuggugaaauggacacgaucaacauacagggcgggcugugcaccuuuggagagcuaaagagggaagauuguucgcccgacguguucucaaauuacaucgcuaacauguauggcacaacucauccuagcaguugccgguuucucgauauuaucggugaccgcuccauugagguaaugaaugaugcaucuccagacagcuucaccccgggggcccacaacuguuccucauuugaaaaagcgcccuucuggagugaucugaucccugcuaagaauggaagcggcccaucucccuccguggucucagugcuuccuagcgccacagagagugacuuuucucugaagguuaaaaaggcaaacgagcgauuggaagugauacagcgugagcucgccgcugaaaaagcaagauccggcaggcuggaggaugaggcccggaccaagaugcgcgcucuggaagacgagcucagaaaugggugguuagccgaaagggaggcgaaagaacuggcaaagagcgaucuugagaaggagcgggucaacaaauuggaaguggagcgcaagcugcaugaccuaaauaaaaagcuccgacagucggaagacgaggccgaaagacugagggaguaccacaacaaacggcguaaggagucugaugaaaagaugaagaugacuaagacaguagcuccaaauguuuccaccacgcuugccacugugguccugaccucauugcucgcaacaggacuggcugccauugagcccaucgaagaccgcaacacuaaucauauuuuaaacagaccugguaccggcguguauauggcgaguccaacacugaccgagaaugauugcagccucgacuacgggaaagaauguaaggccugggagcuucaaguguccccgcugcacuaucccuucuuuacgucuaacgucgauaaauacagcuugcuagagucaaucacucaggcaaguccuauccugauuaagaacaauaacuccugcgaacucacaaccagcccaggaucucagaaacagugucaaaaggagucaaguacuauaaagaaauacugcacagacgaugcuagggccuauuucuuuguugaccuggaaggcaaucuuagcaucgugcacuguuccaacaauaacauucugucugaggauugcaauuucugcaucucgaaaagcgguguaaccgggcagaaaauauucaugcccauucaggacgcuuuuugucagcggggaggcuccgagucauugccugugauccgauacaguaaggauaucugcucuauuggccucuucaaaaucaagagcugucauaaguccacgucacgcuaugaaagaaugggguuuauugucgugggaaggaaaaagcuguacuuagaggaacugaaaaugcgguaucgccaagaguacgacgaagaccaguucuauugcuacaaggccaaaaccacaagccagcuacaauaccagaagguuucuccauccaaguguaaaggugugggcaguaaggaucagaaaugcaacggggacgaguauuuuuguaauagauuccccugcgagacuaacaauccggaugcacacuguagccucaggcgucaugccgcugucguggaaguaaacguuggaggcgcgugggugaagccuaaaugcgucgguuacgagaaggugcuggucaaacgagggggccuuaagaccgaagacuugucugugcgggaguguacauccugccugugggaaugcgagaagaauaaaauaguuaucaagacucacggacccaaaauugugucagcaaccgccuguagucacggcagcugcaagucgguaaugcagaaaccauccacauuucucgaucugccuuaucccgggaacucugagaucaucggaggugacauuggcauacauaugagcgaaagagggucaccaaguaauauccacauuaccauccauugucccccuaaggauuccugcgacgucucugauuguauuuucugcaggcacggaauccuuaacuaccaaugucauagcguggcuuccgccauacuguugucaacuguuguggcaacgauccucgcccugacaggcgucauuaucagccgcaguaaguuugcugugcgguucuuagccucugcaguagcgauuccauuuagaugggugucccugcuaguugucugggugaugaaaaaguggaaaagcaggaucgcuaccgccauacgcgcaacuaacaaugccauugguugggacaacgggcucgaacaggugcgagucgaaaaugcugcccggcguccgcagcccgcaguuagauaugcuuucuacgccaccacaauccugucgauucuuggcucaggauugugcuguaccgagucucugaucgcggaaaguuccauaaugcagugcacuacagaggauagcucuacgaccuguaaggccacuggcacaguggugcucaaacuggggccuaucggaagcgaguccugcuuaauucugaagggucuuagggacaacgaaaagcaauuuaucucaauuaaaaccaucaguagcgaguugacaugccgcgaaggcgagucuuucuggacuucccucuauaccccaguaugucugucaagucggagaugccaccuaaugggggaguguacgggagauauaugccugaaguggaaaagcaauaagaccuccucugaguucacaggcaaagcucacucggaggucauucaugaaaacaaguguuuugagcagagcggugggaucggcuacggaugcuucaaugugaaccccucaugucucaugguucacuccuaccugaagccuaucuauaaaaaugcauuuaggguguuccgaugcauugccuggaaccaucgcguccggcuuggcgugacuacccacaagagaaaauuugaaaucacauugauggcuaugaguacucagcagaccgacugggggucuauuggacugauauuagacagcgagggcaucgaggguacgaaugccuacuccuucaugaagcacgggcucggaucauuugcaauuguugaugaaccauauucuguggagcccaggaaaggcuaccugggugaaguacguuguccgacagaggaaaccgcgaucaaggccagcccuaguugcaaagucgcuccaggccuuauugaguaucaacccgagauggacacuguggaauguacaaccaacaugauggauccuauggccaucuucaaucgcgggucccugccccaggugcgggagggaaagacuuuuacccagagcauagaaaagaacucuguccaggcauugacaacgggcgagauccaugcuucaguuagacucgugcuggacgaauacgagauugaguauaaaguaaccuccaaugauugcgacaguacuuucgugaacaucacagggugcuacagcugugaugaaggagccaggcuaugcgucaaggugaaaucgucuuccgaggcaauuuaccacuuuaccgacagcucauucaguguuaacgugcuguuuaaggucacaccaucugugcaugauuauuguacuauccuccacuucucccgaccuguuauaagcauugaaggcaaauacgacugcgguaagaauaagaaacccaugcugaucaaggggacccuuaucgccauggcuccacaugaugaccgggugauuaacggaggcucaaguacggucguaaauccgaaaggucacggcguggauuucuugggguggcugagcggauuauccucuugguuuggcgggccucucaagacauuccugaugguuaugggauuucuuaugauaggcgugaucauugucaucgugaccauuauccugauacgcaucggucuacaacaggcgcucgccaaaaaguucaaguga

SEQ ID NO: 11409 - RNA, 3996 nt, Artificial Sequence
  derived and/or modified CDS sequence (opt3) from Punique virus(PI-B4-2008)__JF920134.1__GP
auguucuacgccaaguuugugaucauucugugccucguccagggcuucagccuuaaauauaccauaaucuccaagcuggggucuggaacaacuagacaaguuuguuugucacacaguacggacuuagauaaagugcuggagauuagcaacauggaaauggacgcuaucaaucuacucgguggcuuuugcacccugggggagcuuaggcgggaagauuguucccccaacguauucucuaauuacguggucaacgugcauggaacaauucacucgucaaauugcaaguuuguugacaucgugggcgaucgcagcauagagguccugaacgacgcaacuccugauaguuucaccccaggugcccauaauuguuccucuuuugaaaaaccgcccuucuggacagacuuggugccuaagaagaacgauaccgacccaagccccucccuccugucaguacugccugcggcugccgagcucgauuuuaauuuaaaacugaaggaggcaaacgacaaaguugaagccauccagcgagagcuuguggcugaaaaggcacguagugggagaauugaggaugaggccaggacuaaaaugcgggaauuggaggacgaacugcgcagaggauggaucgcugagagggaagccaaggagcuagcgcacaagaaucucgaggaggagcgggucagcaaacuggaaauugagcgccgaaugcaugaccuugauaagaaacugagacagucugaaaacgacgcagauagguugcgggagcaguauaauaagaaacguaaguccgaggaagaggugaaaacaccaaaggccucaacccucaacgcuacgacuacccuggccacaguggucuuaacuagccugcucgcaaccggccuugcugccaucgaacaaauagaggaacgcaauacaaaccacauucugaacagacccggcaccgggguuuacauggcgaguccuacguugacucagacagagugcucucuaggauaugguaaggaguguaaauccugggaacuccaggugagcccacugcacuacccguucuuuaccucgaauguagacaaguauucuauccuggaguccauuacucaggaacccacacuucugaucaaaaacaauaacucaugcgaguugaccacgaguccuggcagccaaaagcagugucagaaagaguccucuaccaucaagaaguacugcacagaugacgccagggcauacuucuuuauugaucucgggggaaaucugagcauagugcauuguucaaacaauuucgucuuaagugaagacugcaacuucugcaucuccaaaagcggcgguguggggcagaagauuuuuaugccaauccaagaugcuuucugucagcggggaggcucugagucacccccuguugugcgauauaguaaagaccugugcagcauaggccuauuuaagauuaaauccugucacaagucuacuucgcgcuacgaaagaaugggguucaucgucgccggacagaagaaacucuaucuggaggaacuuaagaugagguaccggcaagaguaugaugaggaccaguuuuucugcuacaaaguaaagagcaauuccccauugcaguaugaaaaagugucacccaguaaguguaaggguguuggcucucaggaccaaaaaugcaacggggaugaguacuuuuguaaucgcuacccgugcgacaccaacaauccugaugcucauuguagccugagaaggcacgccgcaguggucgaagugaacgucggaggcguguggaucaagcccaaaugcguugguuaugagaaggugcucguaaaacgugggggccugaagacagaagaccuuuccguccgggaguguacuucaugccugugggagugcgaacgaaauaaagugguugugaagacccacggaccaaagauugucagcgccacagcuuguucucauggcuccugcaaaagugugaugcagaagccuagcaccuucuuggagauccccuacccagggaacucugaaauuauaggaggugauaucggcauucacauguccgagagagggucacccaguaacauccauguagugguucacuguaaaccuaaggacagcugcgauaucucggacuguauuuucugcaaacauggaauacucaauuaucagugucacuccgucgcgucugcagugcuguuaagcacuaugaucgccgcuugccuggcccuagugggcgucauuguuucaaggaguaagcacgcagugaaguuccucgccuccgugguagcuaucccauuuaaaugggucucucugcuuacgguguggguugugaagaacuggaaauugcgcauuacacgggucaucagagccaccaaugaugcaauagguugggaaaacaaucuggaacaggugaggguugagaacgcggcucgccgaccgcaacccgccgugcgguacgcauucuaugggacuaccauccucagcauucuguccacaggcuuauguugcucagaaagccugaucgccgagaguucuauuaugcaguguaccacugaagacuccagcacaguaugcaaggcuacgggaaccgucgugcuuaaauugggcccuaucgggucggagucaugccucauacugaagggacuacgugauaaugagaagcaguuuauuucuaucaaaacuauuaguuccgaacugacauguagagagggugagagcuucuggaccucucucuacacaccagugugccugagcuccaggcgcugucaucuuaugggcgaaugcacuggggacaucuguuugaaguggaaaaccaacaagacgucagccgaauuuaccggaaaaacacacagugaggucauacaugagaauaagugcuuugaacagagcggcgguaugggguauggcuguuucaacguuaaucccucuugccugauggugcacuccuacuuaaagccuaucuacaaaaacgcauuuaagguauuccgguguguggcuuggaaucacagagucaggcucggaauuacuacccauaaacgaaacuuugagaucacacugauggccaugucaacucaacagaccgauuggggcaguauugggcuuauccuggacagcgaaggaauaacgggcacaaauuccuauucuuucaugaagcacgguuuggggucguuugcgauuaucgacgagccauacgugaccgaaccccgcaaaggauaucucggcgagguucggugcccgacugaggaaacagccgugaaggcuagcccuucauguaaagucgcaccaggucugaucgaguaccagcccgaaauggaugugguugagugcaccacuaacaugauggacccuauggccauuuucaacagaggcucccuaccccaggugagggaugggaagaccuuuacacaaaguaucgaaaagucuagcguccaggcucugacgaccggagagauucaugccuccguacgucucgugcuggacgaguaugaaguugaguacaaaguggucaauaacgauugcgacucaacuuucgugaauauaacaggcuguuauucuugcgaugaaggggcacgccuuuguguaaaggugaaagcgagcagugacgucaucuaccacuuuaccgauuccgacaacagcaugaauguuuuguucaaggugucuucaaacauucaggauuacugcaucgugcugcauuuuuccaaaccagucgugaauguugagggaaaguaugacuguggccggaguaagaaaccuauguuaauuaaggguacacucaucgccauggcuccccacgaugacagaguaacuaacgggggaagcucgauaaucauuaauccaaaaggcgguggcguggacuuccugggguggcuuucuggacuguccagcugguucggcgggccgcuaaagaccuuucucaucauugccggauuccugaucgucggcauaauuaucgugaucauuauaaucauuuuggcaaggcuggguauccaacaggcuuuagccaaaaagcucaaguga

SEQ ID NO: 11410 - RNA, 4020 nt, Artificial Sequence
  derived and/or modified CDS sequence (opt3) from TOSV(9028)__KU904264.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaaugucaccgagucuaucggucucacaucgggcacuugcaagguugggucacuggaaaaccgggauugucgcaaagacauuaugagcaauuauguggccgagguacacagugaucuucauggacugggcgcgaugaugcacaacuacggugacgauaagcgaguggaaaucuugaaugacgucauacccgaugagcucaacccugggcaucacaauugcuccgaccuggaucguaaaccauucuggaccgaguuuaucaacguggcuaagccgcugucugaaauuguucccaugagcgugaucccuccacccgucgugaagcuccaaccuccagccgagcccuccucaaagaagcauguaccuuucgacguuuuacugagugaagcagagaaagagcuuaaucagacaaagauuagauuggaagaugagaggaaaagcaacgccgaagagaccgcuaaggaacgggcacgcaugaaggagaucgaggacgaacugagaagggagugggaacuagagcggaaacgcaaggaugccauggcugacgaccucgccaaagaaacugcgcgaagaagggagauagagcggaaggcacacgaacuggauaaaaugcuuaagaaaaaggagcgugaaucucugauugccaaggagaaagcugacgaagauaugcgcucccacgugcauaagccaaauacaaccagagccccggcacccacgaucauuacuaccuugcucauggcuucagccgcgcuggccggaccuuuagagaacagggagacaaaucaucugcucaaccggccaggcaauggcgcauauacucuuagcgacuuugcugaaaguaccuguacacuggccuacgggucugagugcaaauccugggaacacuugcuaaacgaggagcuguuccccuuuuuccacagcaaccucgauaaguauucgaugcuggaagcugccaccgagacggucccuauccuuaauaaaucuuccgcaguguguacuaucucaccaaguacacacagcuccaacgccugcggacgagaggcuucugugauucgcaagaaguguuacagcaauaugucagcguuuuucuacauaaaccuggcaggucagaucaccgucauuaaaugcgaaacuaaucauguuuugaguuccgacuguggcaacugcaucagcaagucucucucagggcaaaaaguguauacacccguacaggauguguuuugccagaagggauggacccagaguauaccgagcacgagauacuccaaagacauuuguucuaucggccugcacaccgucaaggaaugcaagaucgguacaacuucguucgagagggugggguuuauuguugugaaaggacggaagauguauaucgagcaaaugaaaaugcgcagcagacaggaauacuccgaggaucaguucuuauguuauaagucagaaaguggcucuggcagcuccgucaaacugaagaaguucaaaguggagucaugcaaggggguaaccacaagcucugccuccaaauguaguggagacgaauacuuuugcagcagguauccuugugagacugcuaauguugaggcccauugcauucuacgucggcacucugcaauaguggaagucaacgugaauggugucugggugguuccccgauguaucggcuacgaggaagugcucguaaagagaaccucccugaaagucgaggauacaaccgggagggaaugcgacucaugucuuugggagugcggaaagaacaaauugauugugaagacucauggcccaaagguuguguacgccacggcuugcagucacgguagcuguaaaucggucaugcagaagccugccacauucguguaucugcccuacccaggcaauuccgagaucguagggggagacaucggcauucacaugaccgaagagucuagccccucaaacauacaucucguggcacacugcccugcgcgcgauaguugugacguuuccgauugccuguuuuguguccaugggcuucugaauuaucaaugccacacuuuguucucugcucuccugaucagcaccacagugauguccauuuuaacccugcuacuccugcuugugaaaggagccaaggacuuggucaaaaagcuguuucacuggcucaucacuccacuguguugguuaucaguuuucugcuguuggguggugaaaagcuggaaacggagaguagguagugcaauuucuaggacaaacgauacgaucggcuggcgcgaaaaucgacggcaugcccaggacauagagcgugcucaguacaccgggggagccccgggcgcaaaguauuccuuuuacggugucaugauccuggggcuuuugagcucggcucaaucaugcucugagagugugauugccgauuccaaaaucaugcaguguacuacaagcggcucuagcacccucugcaaggcguccggaacaguuauuaugagacugggccccaucgggucagaaaguugccuaauacugaaaggacucaaggacagcgagaagcaguucauuucuaucaaaacuauuuccucagaacugaccuguagggagggugaaaguuuuuggacgacccuuuauacaccuaucugcuugagcucccgccggugucaccugaugggcgagugcgugucugauagauguuuaaaguggaaaacuaaccagaccucggccgagcucacagggaaggcucauggagacgucaugcacgaaaacaggugcuucgagcaaagcggcgguauaggguacggcuguuuuaaugugaacccaucaugccuguacguucauuccuaucuuaaaaguguguaccgaaauggauucaagguauuucgcugugucgcauggaaccaccggaucagacuggaagugacuacccacucuaggaaguuccccaugguguugauggccaugagcacgcagccuacagauuggggcuccauugggcucauccuggacucagagggaauuaccggcacuaauucuuauagcuucaugaaacaugguaguggguccuuugcuaucauagaugacccauacagccccgaaccgcguaagggauuccuaggcgagguccgcugcccuacagaggaaaccgccaugcgggcaucuccaucauguaaaauggcgcccaaccugauugaguaucagccugaaauggacacugccgagugcaccacaaauaugaucgaucccauggcuaucuuuaacagagguucccucccacagguuagggacggcaugacguucacccaaaguauugaaaagaauacugugcaggcccugacaaccggggagguaaaagcaagcauccgacuuauuuuggaugacuacgauguggucuaucagaacucgcagucugacugcuccgcuacauuuaagaaucugacuggauguuacagcugcgaugagggcucacgguuauguuaccaagugaaagccgaaggggagaccauauuccacuuuaucaacgaagaggagaguauuaauguuaucaacaaggugucuccuggagucuccgacuauugcacggugcuccauuucagccgccccguuauuucaaucgaaggcacauacgauuguggucugaguaagagaccaauggugauaaaagggacccuuaucgcaacugccccgcacgacgauaggaagcaugagggaggcagcucccuggucguaaauccuaaagguggcucuguggacuuuuucggguggcuaagcggacucaccuccuggcugggcgggcccuugaagacauuucugacuauuuuaggauuccucgcuguuggccugcuucugguggucaucauuaucauaauuauccggaccgguaugcagcaggcguugaaaaagaagaucaaauga

SEQ ID NO: 11411 - RNA, 4020 nt, Artificial Sequence
  derived and/or modified CDS sequence (opt3) from TOSV(A189)__KP694241.1__GP
auguucaucgccaagcugcuccuuauuagcugccuggugcagcaggcuuacuugaaauauaccauaaucuccgagauuggcaacgggacaagaacuucuucauguuacaguagcaggacguccuuaggaucucugcuagaagcaugggauaauaucaccgagucgauuggucucacaucaggcacuugcaaggucgggagccuggaaaaccgggauuguaaacgcgacaucaugaguaauuauguugccgaggugcacuccaaccuucauggacugggcgcgaugaugcacaauuacggugaugacaagcgaguagaaguguugaacgaugucauacccgacgagcucaauccugggcgucauaacugcucugaucuggacagaaaaccauuuuggaccgaguucaucaauguggcuaggccgacaaacaagauggcccccaugagcguuauuccuccacccaucgugaagccuauuccagucgcagaacccaccaucgagaaaacuauaccuuuugauaagcugcucuccgaagccgagaaagaguuaaaucaaacaaagauucggcuggaagcugagcgcagaucaaacgcagaagaggccgcuaaagaaagggcccggaugcgcgagaucgaggacaaacuucgaaaggauugggaauuggagagagaaaggaaggacgcgguggcagaugaccuggccaaggagauugcucggcgucgcgaaaucgagagaaaagcccacgagcuagacaagaugcucaaaaagaaagaaagggaggaucugguagcacgggaacgaguuagugaggacaugcgcaaucaugugagaaggccaaacaccacgaucgcuccggcccccacuauuauaaccacacuucugauggcgagcgccgucauggcaggaccuuuggaaaaucgggagacuaaccaccuccugaaccgcccaggcaauggcgcuuauaccuuaucugauuucgccgaguccacauguacccuggcuuacgggucagaaugcaagagcugggagcaccagcucgacgaacuuaguuuucccuucuuucauucuaaccuggauaaguauuccauguuggaggccgcaacggagacugugccuauccuaaauaaaagcucggccguguguacaauuuaccacccaagaauccauaggauggcuugcggacgugaagcgucucugauaaagaaaaagugugguuccaacaugucagcauucuuuuacgucaaucucgccggccagauuaccguugugaaaugcgacacuaaccacguacugaguaaugauugugggaacugcaucagcaagacacuuuccggacaaaagaucuauacccccgugcaggacauguucugccagaaaggcuggacggagucuauuccgaauacccgguacagcaaggaucuguguucaaucgguuugcacacagucaaagaaugcaagacugggaccacaaacuuugagcgagugggauucauuguugugaaaggcagaaagauguauauagaacagaugaagaugaggagucgccaagaguuuuccgaggaccaguuccucuguuacaaaagcgaaucuucaaguggcagcuccgucaagcugaaaaaggugaaaguagagucuugcaaggggguuacuaccucgagcgcuuccaaguguucaggagaugaauauuucugcagucgguacccuugugagacagccaauguggaagcacauugcaucuuaagaaggcacucugccgucauugaggugaacgucaaugguguguggguugugccccgcuguaucggcuaugaggaaguacugguccgacggaccagccuaaaaguggaggacacuuccucacgugaaugcgacacgugucucugggagugcgggaagaacaaacugaucguuaagacacauggaccaaaaauuguguacgcuaccgccugcagccacggcucuuguaaguccgucaugcagaaaccugcaacuuuuguguaccuucccuauccagguaauagugaaauaguagggggcgauaucggagugcauaugaccgaggagagcucucccuccaacauucacaugguugcgcacugcccugcuaaggacucaugugaagucaguagcugcuuguucugugugcauggccugcucaacuaccagugccacacacuguuuucggcccuucugaucuccaccacugugaugucuauuuugacacuccuguuacugcuaaugagaggggcaaaggaucucgucaaaaggcuguucuauuggcuuaucacgccauuguguuggcugagcguguuuugcucauggaugauaaagaguuggaaaaagcgcguuggauccgccaucucucggaccaaugacacuauugguuggagagauaacaggcgauacggccaagacguggagcgcgcucaguauacagggggagccccgggcgcaaaauacagcuucuaugguguaaugauccucgggcuguuaggcaauguccauuccuguucagaaagcgugcuggcugauaguaagauuaugcagugcaccacaucuggauccagcacucuuuguaaggccucgggcaccguuaucaugaaauuggggcccauaggaucagagucuugccucauucugaagggucuaaaagacagugagaagcaauuuaucuccauuaaaacgaucagcucugaacugaccugccgggagggcgagagcuucuggacaacucucuacaccccugugugucuguccucaagaaggugccaccuuaugggggaaugugucagugaucguugcuugaaguggaagacaaacgaaacuagcgcggaguuuaccggaaaagcccacggcgaggugaugcaugaaaaucgcuguuucgagcagucuggugggauaggcuacggaugcuuuaacguuaauccauccugucuguaugugcacucauacuuaaagaguguauauaaaaacggcuucaagaucuuucggugcgucgcuuggaaucauagaauuaggcucgaagugacgacacacagccgaaaauuccccauggugcugauggcaauguccacccagccuacugacugggggucuaucggacuuauucuggauucggagggcaucacagguaccaacgccuacagcuucaugaagcaugggucaggauccuuugcuauaauugacgauccauauagucccgaaccgcggaagggcuucuugggugagguccgcuguccuacugaggaaaccgccaucagagcaucuccaagcugcaaaauggcgcccaaucucaucgaguaccagccugaaauggacacagccgaguguacgaccaacaugauugaccccauggcuaucuuuaauaggggcucccugccacaaguucgggaugggaugacuuucacacagucaauugaaaagaacaccgugcaggcccuaacaacuggagagguacgagcaucuauaagacugacccucgacgauuaugacguggucuaccagaauagccaaagugauugcuccgcuacguuuaaaaaccugacaggcugcuacagcugugacgaggggucucgcaugugcuaucaggugaaggccgaaggagagaccaucuuccacuuuguuaacgaagaugagucaauuaaugugaucaacaaagucuccccugacgugagugauuacuguacuguucuucacuucagcaggcccgugauuucgaucgagggccguuaugacugcgguuugucuaagcggccaauggucauaaaagggacccugaucgcaacagccccgcaugaugacagaaagcacgaaggaggcuccagcuuaguagugaauccuaaggguggcacuguugacuuuuucgggugggugucaggacucaccaguuggcugggcgggccccuuaaaacauuucugacgauucuaggauuccucgcucugggcuugcuguuagucgugaucauuaucauaauugcgaggaccgguguacagcaggcccucaagaaaaagaacaaauga

SEQ ID NO: 11412 - RNA, 4020 nt, Artificial Sequence
  derived and/or modified CDS sequence (opt3) from TOSV(AR)__EF656362.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaaugucaccgagucuaucggucucacaucgggcacuugcaagguugggucacuggaaaaccgggauugucgcaaagacauuaugagcaauuauguggccgagguacacaguaaccuucauggacugggcgcgaugaugcacaauuacggugaugacaagcgaguggaaaucuugaacgaugucauacccgacgagcucaauccugggcaucacaacugcuccgaucuggaccguaaaccauucuggaccgaguuuaucaauguggcuaagccgucuagcgaaauuguucccauguccgugaucccuccacccgucgugaagcugcaaccuccagccgagcccucaaguaaaaagcauguaccuuucgauguucucuuaagcgaagcagagaaagagcugaaccagacaaagauuagacuugaagacgagaggaaaucuaaugccgaagagaccgcuaaggaacgggcacgcaugaaggagaucgaggaugaauugagaagggagugggaacuggagcggaaacgcaaggacgccauggcugaugaccuagccaaagaaacugcgcgaagaagggagauagagcggaaggcacacgaacucgaccguaugcugaaaaagaaagagcgcgaaucccuuauugccaaggagaaggcugaugaagacaugagaucacacgugcauaaaccaaacacaaccagggccccggcacccacgaucauuacuacccuguugauggcuagcgccgcgcucgccggaccucuggagaaucgggagacaaaccacuuacugaaucgaccaggcaacggcgcauauacucucagugauuuugcugaaucuaccuguacacuugccuacggguccgagugcaagagcugggaacaucuguugaacgaggagcuauuccccuuuuuccacucgaaucuggacaaauauucuaugcucgaagcugccaccgagacggucccuauccugaacaaguccucagcaguguguacuaucaguccaagcacacacuccucuaaugccugcggacgcgaagcuagcgugauuagaaagaaguguuacucaaacaugagugcguuuuucuacauaaaucuugcaggucagaucaccgucguuaagugcgagacuaaccaugugcuguccagcgauuguggcaauugcauuucuaaaucauugagugggcaaaagguauauacacccgugcaggacgucuuuugccagaaaggauggacccagagcaucccguccacgagguacucuaaggauauauguucgauuggccuccacaccgugaaagaaugcaagaucgguacaacuagcuucgagcggguuggguuuaucguggucaagggacgcaaaauguauauugagcaaaugaagaugagauccaggcaggaauacucagaggaccaguuccuguguuauaaaagugaaucuggcagcggcuccucagugaagcugaaaaaguucaagguagagagcugcaaagggguuaccacaucuuccgccaguaaguguagcggagaugaauacuuuugcaaccguuauccuugugagacugcuaauguggaggcccauugcaucuuacggcgacacucugcaauugucgaagugaacgucaaugguguguggguugugcccagauguauaggcuacgaggaaguccuaguaaaaaggaccucccucaagguggaggacacaaccgggcgcgaaugcgauucaugucugugggagugcggaaaagacaaacuuaucguuaaaacucauggcccaaagguggucuacgccacggcuugcagucacgguagcuguaagucggugaugcagaaaccugccacauucguauauuugcccuacccagggaacuccgagauugugggcggagacaucggcauccacaugaccgaagagucuagccccucaaauauucaucugguugcacacugcccugcgaaggauaguugugacgucuccgauugccucuuuugugugcaugggcugcuuaacuaucaaugccacacucuguucucugcuuugcucauaagcaccacagugauguccauccugaccuuacugcuacuccuggucaaaggagccaaggaccuuguuaaaaaguuguuuuacuggcugauuacuccacucuguuggcugucaguguucugcuguugggugguaaagagcuggaaacggagagucgguagugcaaucucuaggacaaaugauacgauuggcuggcgcgaaaaccgacggcacgcccaggacaucgagcgugcucaguauaccgggggagccccgggcgcaaaguacuccuuuuauggugugaugauauuagggcugcuuagcucggcucaaucaugcucugagaguguuaucgccgauuccaaaauuaugcaguguacuacaagcggcucuagcaccuugugcaaggcguccggaacagugaucaugagacucggccccauugggucagaaaguugccugauccuaaaaggacugaaggacagcgagaagcaguucauaucuauuaaaacuaucuccucagaacucaccuguagggagggugaaaguuuuuggacgacccuguacacaccuauuugccuuagcucccgccggugucauuugaugggcgagugcgucucugauagaugucugaaguggaaaacuaaccagaccucggccgaguucacagggaaggcucacggagacgugaugcaugaaaauaggugcuuugagcaaagcggcgguaucggguacggcuguuucaacguuaauccaucaugcuuauaugugcacuccuaccucaaaaguguauaucgaaacggauuuaaggucuuccgcuguguggcauggauacaucggaucagacuggaagugacuacccacucuaggaaguuccccaugguccuuauggccaugagcacgcagccuacagauuggggcuccauugggcugaucuuggacucagagggaauuaccggcacuaauucuuacagcuuuaugaaacacgguaguggguccuucgcuaucauagaugacccauauagccccgaaccgcguaagggauuucucggcgagguucgcugcccuacagaggaaaccgccaugcgggcaucuccaucauguaaaauggcgcccaaccugauugaguaccagccugaaauggacacugccgagugcaccacaaauaugaucgaucccauggcuaucuucaacagagguucccuaccacaggugagggacggcaugacguuuacccaaaguauugaaaagaauacuguacaggcccugacaaccggggaggugaaagcaagcauccgacucacacuggaugacuaugaugucguguaccagaacucgcagucugacugcuccgcuacuuucaagaaucuuaccggauguuacagcugcgaugagggcucacgguuguguuaucaaguuaaagccgaaggggagacgguguuucauuucauuaacgaagaggagaguauaaaugucaucaacaaggugucuccuggaguuuccgacuacugcacagugcugcacuuuagccgccccgucauuucaaucgaaggcaccuaugauugugguuuaaguaagagaccaaugguaauuaaagggacucucaucgcaaccgccccgcaugacgauaggaagcacgagggaggcagcucccuggugguuaauccuaaagguggcucuguggacuucuuugggugggucagcggacuuacauccuggcugggcgggccccuaaagacuuuccucaccauacugggauuuuuggcugugggccuguuacucguagugaucauuaucauuaucauacggacagguaugcagcaggcgcugaaaaagaagauuaaauga

SEQ ID NO: 11413 - RNA, 4020 nt, Artificial Sequence
  derived and/or modified CDS sequence (opt3) from TOSV(EsPhGR40)__FJ153283.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggauaaugucaccgagucuaucggucucacaucgggcacuugcaagguugggucacuggaaaaccgggauuguggaaaagacauuaugagcaauuauguggccgagguacacaguaaccuucauggccugggugcgaugaugcacaauuacggggaugacaagcgcguggaaaucuugaacgaugucauacccgacgagcucaauccuggacaucacaacugcuccgaucuggaccgaaaaccauucuggaccgaguuuaucaauguggcuaagccgcugucugaaauugcccccaugagcguuaucccuccacccguggucaagcuccagccuccagcagagcccuccaguaaaaagcaugugccuuucgauguauuacugucagaagccgagaaagagcuuaaccagacaaagauucguuuggaagacgagagaaaaagcaaugcugaagagaccgcaagggaacgggcccgcaugagagauaucgaggaggaacugaggaaggagugggaacuagagcggaagcgcaaagacgcuauggccgaugaccucgcgaaggaaacugcaaaacgaagagagauagagaggaaggcccacgaacuggaccggaugcuuaaaaagaaagagcgugaaucucugauugcuaaggagaaggaagaugagaacaugcgcuccagaguucacaaaccaucaacaaccagggccccggcacccacgaucauuacuaccuugcucauggcuagcacagcccuggcgggcccuuuagagaaucgggaaacuaaccaucugcucaaucgaccaggcaacggggccuauacccuuagugacuuugcagagucuacauguacccuggcuuacggauccgaaugcaagagcugggagcacuugcuaaacgaggaacuguuccccuuuuuccauucgaaucucgauaaauauucuaugcuggaggccgcuacggaaacugugccuauccuuaacaaguccucagccgucuguacaaucaguccaagcacccacuccucuaaugcaugcggucgcgaggccagcgugauuaggaaaaaguguuacucaaacaugagugcucuguuuuacauaaauuuggcgggccagaucacuguggucaagugcgaaacaaaccacguucucuccagcgacugugggaauugcauuucuaaaucacugaguggacaaaagguguauacccccguacaggauguguucugccagaaaggcuggacggagagcaucccguccaccagauacucuaaggacauauguucgauugguuuacauacagucaaagagugcaagaucgggacuaccagcuuugaacgggugggauucaucguugugaagggccgcaaaauguauauugagcagaugaagaugagauccaggcaagaauacucagaggaucaguuucuguguuauaaaagugaaucuggcagcggguccucagucaagcucaaaaaguucaagguggagagcugcaaaggaguaacaacuucuuccgcaaguaaguguagcggugacgaguacuucugcucucguuauccuugugaaaccgccaacguugaggcucacugcauccuacggcgacauuccgccauuguggaagucaaugugaacggcgucugggugguucccagauguauaggguacgaggaagugcugguaaaaaggacaucacuuaaggucgaggauaccacugagcgcgaaugcgacaguuguuugugggagugcggcaaaaauaagcugaucgugaaaacgcacggaccaaagguuguguacgcaacagccugcagccaugguucguguaaguccgucaugcagaaaccuaccacuuuuguguaucuccccuacccagggaacucugaaauuguaggcggagauaucggcauccacaugaccgaggagagcucacccaguaauauucaccugguggcucauugcccugcccgggacuccugugacguuucugauugccuuuucuguguccacgggcuguugaacuaucagugccauacacucuuuagcgcacuguuaauauccaccacugugaugucaauccugacacuacuccugcuuuuggugaagggagcgaaagaccuggucaagaaacucuucuacuggcugauuacgccauuauguuggcugagcguguuuugcuguuggguugugaagaguuggaagagaaggguagguucugcuaucucccgcaccaaugauacuauuggcuggcgagaaaaccggcguuaugcccaagacaucgagagagcacaguacacagggggagccccgggcgcuaaauauagcuucuacggugucaugauacuuggguugcucucgucagcccagucuugcagugaauccgugaucgcagauagcaagauuaugcaauguaccacaucuggcagcuccacucugugcaaggcuucaggaaccguuaucaugaggcuaggccccauugggagugagagcugccugauccucaaaggacugaaagacucugaaaagcaguuuauauccauuaagacgaucucaagugagcuuaccugucgcgagggugagagcuucuggacaacuuuguacaccccuauuugccuguccucucggagaugucacuuaaugggcgagugcgugucggauaggugucucaaauggaagacaaacgaaacuagcgccgaguuuaccgggaaagcgcacggagacgucaugcaugaaaauaagugcuucgagcagucaggcgguaucggguauggcuguuuuaacgugaauccauccugccuguacguucacaguuaucuuaaaucuguguaccgaaacggauucaagauauuucgcuguguagccuggaaucaucggaucagacuggaggucacgacacagagcaggaaguuccccaugguguugauggcuauguccacccaaccuacugauuggggcucaauugggcucauccuggacucugaaggaauuacaggcaccaacagcuauaguuucaugaaacacgguuccgggagcuuugcaaucauagaugacccauacucucccgagccgcguaagggauuccuaggcgaagugcgcugcccuacugaggaaaccgccaugcgggcuucaccauccuguaaaauggcccccaaucugauugaguaucagccugagauggauacagcagaaugcacgaccaacaugaucgaccccauggcgaucuuuaauagagguagucucccacaggucagggacggcaugacuuucacacagagcauugagaagaacaccguucaagcccugacaacuggggaagugaaggcuucgauccgacuuaccuuggaugacuacgauguaguguaccaaaauucucaguccgacugcagcgccacguuuaaaaaccugacaggauguuauucaugcgaugagggcagucgguuauguuaccaggucaaagcagagggggaaaccguguuccauuuuauuaaugaggaagagucuauaaacguuaucaauaagguguccccugacgucagcgauuauugcacugugcuccacuucucacgccccauuaucaguauugaaggaaccuacgacuguggccugagcaagagaccaaugguuaucaaagguacacuuauagcuacugccccgcacgaugacaggaagcaugaagggggauccucucugguggucaacccuaaaggcgguagcguagacuuuuucggcuggcuauccgggcucaccucauggcugggaggccccuugaagacauuucugacgaucuuaggguuccucgcagugggacugcuucugguugugauuaucauuaucauaauucggaccggcaugcaacaggccuugaaaaagaagaucaaauga

SEQ ID NO: 11414 - RNA, 4014 nt, Artificial Sequence
  derived and/or modified CDS sequence (opt3) from TOSV(SI-121283)__JF330279.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggauaauaucaccgagucuauuggucucacaucgggcacuugcaaggucgggucacuggaaaaccgggaguguaaacgcgauaucaugagcaauuauguugccgaagugcacaguaaccuucauggacugggcgcgaugaugcacaauuacggugacgauaagcgaauagagguauugaacgacgugauccccgaugagcucaauccugggcgucauaacugcuccgaccuggauagaaaaccauucuggaccgaauuuauuaaugucgcuaagccggccaacgagauggcacccaugucugugaucccuccacccauuguuaagccuaucccaguggccgaaagcacaaccaaaaagacuauacccuucgacaaacugcucuccgaggcugagaaggaauuaaaucagacaaaaauuaggcuggagaccgaacggcgcucaaacgcagaggaagccgcuaaggagagagccaggaugcgggagaucgaagauaaacuucgcaaagacugggaguuggaacgagagagaaaggaugcggucgcagaagaccuggccaaagagauugcuaggcggcgugagaucgaacgcaaggcccacgagcuagauaaaaugcucaagaaaaaggaaagagaggaccugguggcaagggaacggguagacgaggauaugcgaaaucauguucgcagaccuaacacgacuaucgcuccaaccauuauaacaacucuucugaugggaagugccgugauggcgggcccguuggagaauagggaacccacccaccuccugaaccggccuggcaacggggccuauccauuaagcgacuuugcagagcccacauguacccuggcuuacggaucugaaugcaaguccugggagcaccagcucgaugagcuuucauucccuuucuuccauagcaaucuggacaaauauaguauguuggaagccgcuacggagacuaucccaauucuaaacaagucuuccgccgucuguacaaucagccccucgacccacucuuccaaugcaugcggucgcgaagccucacugauaaagaagaaauguggcagugauaugagcgcguuuuucuacgugaaccucgcugggcagauuacuguggucaagugcgacacaaaucauguucuguccaacgauuguggaaauugcaucucuaagacccuuagcggccaaaagaucuacacgccggugcaggacauguuuugccagaaggguuggucagagaguauuccuuccaccagauauagcaaagaucuguguucuaucggguugcacacaguaaaggaaugcaaaauuggaacuaccaacuucgagagggugggcuuuauagucgugaagggccguaagauguacaucgagcagaugaaaaugcggucacgacaagaauuuagugaggaccaguuccucuguuauaagagcgaaggguccucuggaucgagcguuaaacugaagaaagugaaggucgaguccugcaagggugugacaacuucaagugcaucuaaauguagcggcgaugaauacuuuugcuccagauaucccugugagaccgccaauguagaggcucacugcauuuuaaggcgccauucagccguuaucgaagugaacgucaauggggugugggucgugccacgguguaucggauacgaggaaguucuggugagaaggacaagccuaaagguagaggacaccucuucccgcgaaugcgacacuugucucugggagugcggcaaaaacaagcugauugucaaaacgcacgguccuaagauaguguaugcaacagccugcagucaugggagcuguaaaucuguuaugcagaagcccgcuaccuucguguaccuuccauaccccggcaauuccgagaucgucggaggcgauauuggggugcacaugacugaagagucaaguccuagcaacauccauaugguagcccacugcccagcaaaggacucgugugaaguguccucuugcuuguuuuguguucacggacugcucaauuaucagugccauacccuguucagcgcgcuucugauuucaacaaccgucaugaguaucuugacucuccuguuacugcuagugaaaggugcuaaggaucucgugaaacgacuguuuuacuggcuuauaacaccguuguguuggcuguccgucuucugcggcuggaugauccggucuuggaagaaacguguugggagcgccauuuccagaacgaacgacaccaucggauggagggauaacucacgccggggccaagacauugagagagcacaguauacugguggggcccccggcgcuaaguacagcuuuuauggagugaugauccucggccuguuagggaaugugcacaguuguucugaguccauaauugccgauagcaagaucaugcagugcacaaccucgggaucaucuacacuguguaaagcaagugguacuguaauuaugaaacuuggcccuaucggguccgaaagcugcuugauacucaaaggacugaaggacucugagaaacaauucaucagcauuaagaccaucuccucagaacuaacgugcagggagggcgaaaguuuuuggaccacacuguacacuccagucugucucagcucucgacgcugccaucugaugggugaguguguguccgaucggugccuuagauggaagaccaacgagacaucagcugaguucacugggaaagcccacggcgaaguuaugcacgaaaauagguguuuugagcagaguggaggcauuggguauggaugcuucaacgugaaucccagcuguuuguacguccauuccuaccugaagucuguguauaaaaacggcuuuaagaucuuccguugcguugcguggaaucaccgcauacgguuagaagugaccacgcauucgagaaaauucccuaugguacucauggccaugagcacacagccaaccgacugggguucaauugggcugauccuugauuccgagggaaucacuggcacaaacgcuuacaguuuuaugaagcacggucugggcucuuucgcaauuaucgacgaucccuauagcccggagccuaggaagggguuuuugggagaaguccgauguccaaccgaggaaacugccauucgggcuucccccucaugcaaaauggccccuaaucucauagaguaccagcccgaaauggacaccgcagaguguacaacgaacaugaucgacccaauggcgauuuucaaucgcggcucucugccucaagugagagaugggaugaccuuuacucagagcaucgagaagaacacagugcaggcccuaaccacaggagaagucagggcuaguauucggcugacucucgacgauuaugacguuguguaccaaaauucccaauucgauugcagcgccaccuuuaaaaaccugacgggcugcuauucuugugacgaggguucacgaaugugcuaccagguaaaggcagaaggggagacaaucuuccauuuugugaaugaggaugaauccauaaacgucaucaacaaagugagucccgacguuagcgauuacuguaccgugcuucacuucucgagaccagucauuucuaucgagggacgcuaugacugcggcuuguccaagaggccgauggugauuaaagguacucugaucgcuaccgccccucacgaugaccguaagcaugaaggcgggagcucauuaguugugaaucccaagggaggcacagucgacuuuuucggguggguaaguggacucacuucuuggcugggcgguccacuuaaaaccuuucugacaauacuaggguuccucgcacugggauugcuguuagugguuauuaucaucauuauagcccggacgggcguggagcaggcucucaagaaaaagaacaaauga

SEQ ID NO: 11415 - RNA, 4014 nt, Artificial Sequence
  derived and/or modified CDS sequence (opt3) from TOSV(SI-121487)__JF330280.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggauaauaucaccgagucuauuggucucacaucgggcacuugcaaggucgggucacuggaaaaccgggaguguaaacgcgauaucaugagcaauuauguugccgaagugcacaguaaccuucauggacugggcgcgaugaugcacaauuacggugacgauaagcgaauagagguauugaacgacgugauccccgaugagcucaauccugggcgucauaacugcuccgaccuggauagaaaaccauucuggaccgaauuuauuaaugucgcuaagccggccaacgagauggcacccaugucugugaucccuccacccauuguuaagccuaucccaguggccgaaagcacaaccaaaaagacuauacccuucgacaaacugcucuccgaggcugagaaggaauuaaaucaaacaaaaauuaugcuggagaccgaaaggcggucaaacgcagaggaagccgcuaaggagcgcgccagaaugagggagaucgaagauaaacuucggaaagacugggaguuggaacgcgagcgaaaggaugcggucgcagaagaccuggccaaagagauugcuagaaggcgggagaucgaacguaaggcccacgagcuagauaaaaugcucaagaaaaaggaacgcgaggaccugguggcaagagaaaggguagacgaggauaugcggaaucauguucgacgcccuaacacgacuaucgcuccaaccauuauaacaacucuucugauggccagugcggugauggccggaccguuggagaauagagaaaucaaccaccuccugaacuggcccggcaauggcgcauauaccuuaagcgacuuugcugagucuacauguacccuggccuacggguccgaaugcaagucaugggagcaccagcucgaugagcuuagcuucccauuuuuccauaguaaccuggacaaauauucuauguuggaagcugccacggagacuauuccuauccuaaauaaguccagcgcagucuguacaauaucgcccucuacccacuccucaaacgccugcggaagggaagcuagucugauuaaaaagaaaugugguagcgauauguccgcguuuuucuacgugaaucucgcaggccagaucacuguggucaagugcgacacaaaccauguucugucuaaugauugugggaacugcaucagcaagacccuuucaggacaaaagauuuacacgccugugcaggacauguuuugccagaagggcuggagugaguccaucccaagcacccgguauucuaaagaucuguguucaauugguuugcacacaguaaaggaaugcaaaauagggacuaccaauuucgagcgcgugggauuuaucgucgugaagggcagaaagauguacauugagcagaugaaaaugaggagucgucaagaguucagcgaagaccaguuccucuguuauaaguccgaaggaucuucggggagcuccguuaaacugaagaaagugaaggucgagucaugcaagggagugacaaccaguucugccagcaaauguuccggugaugaauacuuuugcucacgguaucccugugagacugcuaacguagaggcccacugcaucuuacgaagacauagcgcaguuaucgaagugaaugucaacggcgugugggucgugccgagguguauuggguacgaggaaguucuggugcgccggacaucucuaaagguagaggacaccuccaguagagaaugcgacacuugucucugggagugcggcaaaaauaagcugauagucaaaacgcacggcccuaagaucguguaugccacagcuugcagccaugguucuuguaaauccguuaugcagaagcccgccaccuucguguaccuuccauacccugggaacucagagauugucggcggagauaucggcgugcacaugacugaagagaguagccccucgaauauucauaugguagcacacugcccagcgaaggacuccugugaagugucuagcugcuuguuuuguguucacgggcugcucaacuaucagugccauacccuguucucagcccuucugaucaguacaaccgucauguccauauugacucuccuguuacugcuagugaaaggagcuaaggaucucgugaaaaggcuguuuuacuggcuuaucacacccuuguguuggcugucugucuucugcgguuggaugauucgcagcuggaagaaacgaguuggcuccgcaaucucacggacgaacgacaccauuggguggcgugauaauagcagaaggggacaagacaucgagcgcgcccaguauacuggcggugcuccuggggccaaguacaguuuuuauggcgugaugauacucggacuguuaggcaacgugcacucuuguuccgagagcauuaucgcagauucgaagauuaugcagugcacaaccucagggucuaguacacuguguaaggcuuccggaacuguaaucaugaaacuugguccaauaggcagcgaaucuugcuugauccucaaagggcugaaggacagcgagaaacaauucauuuccaucaagaccauuucaagugaacuaacgugccgggagggagagagcuuuuggaccacacuguacacuccggucugucucucuuccagaaggugccaucugaugggcgaaugugugucagaucgaugccuucgcuggaagaccaaugagacaagugccgaguucacugguaaagcgcacggggaaguuaugcacgaaaaccgguguuuugagcagagcggcggaaucggcuaugggugcuucaaugugaaccccuccuguuuguacguccauucuuaccugaagucgguguauaaaaauggauuuaagauauucagaugcguugccuggaaccacaggauucguuuagaagugaccacgcauagccgcaaauucccuaugguacucauggcuaugucaacacagccaaccgacuggggcuccaucggucugauccuugauagugaggggauuacuggaacaaaugcauacucuuuuaugaagcacggcagcgguuccuucgccaucauugacgaucccuauucaccugagccacggaagggcuuucugggggaagucagaugucccaccgaggaaacugcuauaagggccucuccgagcugcaaaauggcaccuaacuugaucgaguaccagccagaaauggacaccgcggaguguacaacgaauaugauugaccccauggccaucuucaaccgaggaagucucccucaagugcgggauggcaugaccuuuacucaguccauugagaagaauacagugcaggcucugaccacaggggaaguccgcgccagcaucagacuaacucuggacgauuaugacguuguguaccagaacucucaauucgauugcucagcaaccuuuaaaaaucucacgggaugcuauuccugugacgagggcaguaggaugugcuaccagguaaaggcugaaggugagacaauauuccauuuugugaacgaggaugaaagcaucaacgucauuaauaaagugucgcccgacguuucugauuacuguaccgugcugcacuucucccggccagucaucagcauugaggggcgauaugacugcggacuuucaaagagaccuauggugaucaaaaguacuuugauagccaccgcaccccacgaugaccgcaagcaugaaggcgguucuucccugguugugaacccaaagggcgggacagucgacuuuuucggauggguaagcggcuuaacuucauggcucgggggaccgcugaaaaccuuucuuacaauucugggcuuccuagcccucggucuguugcuggugguuaucaucauuauaaucgcuaggacgggggugcagcaggcguuaaagaaaaagaauaaauga

SEQ ID NO: 11416 - RNA, 4014 nt, Artificial Sequence
  derived and/or modified CDS sequence (opt3) from TOSV(SI-21137)__EU003173.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaauaucaccgagucuauuggucucacaucgggcacuugcaaggucgggucacuggaaaaccgggaguguaaacgcgauaucaugagcaauuauguugccgaagugcacaguaaccuucauggacugggcgcgaugaugcacaauuacggugacgauaagcgaauagagguauugaacgacgugauccccgaugagcucaauccucguagacauaacugcuccgaccuggauaggaaaccauucuggaccgaauuuauuaaugucgcuaagccggccaacgagaucgcacccaugucugugauuccuccacccaucguuaagccuauaccaguggccgaaagcacaaccaaaaagacuauucccuucgacaaacugcucuccgaggcugagaaggaauuaaaucaaacaaaaauccggcuggagaccgaacgcagaucaaacgcagaggaagccgcuaaggagagggcccggaugcgcgagauugaagauaaacuucgaaaagacugggaguuggaaagagagaggaaggaugcggucgcagaagaccuggccaaagagaucgcucggcgucgcgagaucgaaagaaaggcccacgagcuagauaaaaugcucaagaaaaaggaaagggaggaccugguggcacgggaacgaguagacgaggauaugcgcaaucauguuagaaggccuaacacgacuauugcuccaaccauaaucacaacucuucugauggccagugcggugauggccgggccguuggagaaucgggaaaccaaccaccuccugaaccgccccggaaauggcgcauauacauuaagcgacuuugcugagucuaccuguacgcuggccuacggcuccgaaugcaagucaugggagcaccagcucgaugagcuuagcuucccauuuuuccauaguaaccuggacaaauauucuauguuggaagcugccacugagacaauuccuauccuaaauaaguccagcgcagucuguaccauaucgcccucuacucacuccucaaacgccugcgggagagaagcuagucugauuaaaaagaaauguggaagcaauauguccgcguuuuucuacgugaaccucgcaggucagaucacaguggucaagugcgauaccaaucauguucugucuaacgacuguggcaauugcaucagcaagacgcuuucagggcaaaagauuuacaccccugugcaggauauguuuugccagaagggauggagugagacaaacccauccacuagguauagcaaagaccuguguucuaucggcuugcacaccguaaaggaaugcaaaauugguacaacuaauuucgagcgugagggguuuauaguggucaagggacggaagauguacaucgaacagaugaaaaugcgaucaagacaagaguucagugaagaucaguuccucuguuauaagagcgagggcuccucuggcucgagcgugaaacugaagaaaguuaagguggaauccugcaagggggucaccacaucaagugccucuaaauguagcggagacgaguacuuuugcuccagguaucccugugagaccgcuaacguggaagcccacugcauuuuacgccggcauucagcaguaaucgagguuaaugugaacggugucuggguggucccgagauguaucggcuacgaagaggugcugguuaggcgcacuagccuaaagguggaagauacgucuucccgagagugcgacacaugucucugggagugcgggaaaaauaagcugauuguaaaaacccacggaccuaagauagucuaugccacugcuugcagucauggcagcuguaaaucugugaugcagaagcccgccaccuucguuuaccuuccauacccugguaacuccgaaaucgucgggggcgacauuggagugcacaugacagaggaaucaagucccagcaacauccauaugguggcacacugcccagcgaaggauucgugugagguauccucuugcuuguuuugugugcacggccugcucaauuaucagugccauacccuguucagcgcccuucugauuucaacuacaguuaugaguaucuugacgcuccuguuacugcuagucaaaggggcuaaggaccucgugaaacggcuguuuuacuggcuuauaacccccuuguguuggcuguccguguucugcggauggaugauccguucuuggaagaaaagagucgguagcgcaauuuccaggacuaacgauacaaucggcuggcgcgacaauucacggagagggcaagauauugagagggcccaguauaccggaggcgcuccuggugccaaguacagcuuuuaugggguuaugauccucggccuguuaggaaacgugcacaguuguucugaauccauaauugcagacagcaagaucaugcagugcacaacuucgggcucaucuacccuguguaaagcuagugggacggugauuaugaaacuuggaccaaucgguuccgagagcugcuugauacucaagggccugaaggauucugaaaaacaauucaucagcauuaagaccaucuccucagagcuaacaugccgagaaggggagaguuuuuggacuacccuguacacaccgguaugucucagcucucgccggugccaucugaugggagagugugucuccgacagaugccuuagguggaagacuaaugaaaccucagccgaguucacgggcaaagcgcacggugaagugaugcacgagaaccguuguuuugaacagagugggggcauuggauauggcugcuucaauguuaaccccagcuguuuguacgugcauuccuaccugaagucugucuauaaaaauggguuuaagaucuuccgcugcguggccuggaaccaccggauaagauuagagguuacaacccauucgaggaaauucccuauggugcucauggcuaugagcacucagccaacagauuggggaucaauuggccugauccuugacuccggugggaucaccggaacuaaugcauacaguuuuaugaagcacggccuggguucuuucgccauuaucgaugaccccuauagcccugagccacgaaagggcuuuuugggggaaguacggugucccaccgaggaaacagcuauucgcgccuccccgucaugcaaaauggcaccuaaccucauagaguaccagccagaaauggauacggcggaguguaccacuaauaugaucgaccccauggccauuuucaacagaggaucucugccucaagucagggacggcaugacauuuacccagagcaucgagaagaauacagugcaggcucuaacuaccggggaagugcgggccaguauucgacugacgcucgaugacuaugaugucguuuaccagaacucccaauucgacugcagcgcaacauuuaaaaaccugaccggaugcuauucuugugaugagggcucaagaaugugcuaccaggugaaggcugaaggugagacuaucuuccauuuuguaaaugaggacgaauccauaaacgugaucaauaaagucagucccgaugugagcgacuacuguaccguucuucacuucucgcgcccagugauuucuaucgaggggagguaugauugcggauuguccaagcguccuauggucauuaaaggcacacugaucgccacugcaccccacgacgaucggaagcaugaagguggcagcucauuagugguuaacccaaaagggggaaccguggacuuuuucggcugggucagugggcucacaucuuggcugggaggcccgcuuaagacguuucugaccauacuagguuuccucgcccugggguugcuguuaguagugauuaucaucauuauagcuagaacuggaguugagcaggcgcucaagaaaaagaauaaauga

SEQ ID NO: 11417 - RNA, 4014 nt, Artificial Sequence
  derived and/or modified CDS sequence (opt3) from TOSV(SI-31051)__EU003174.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaauaucaccgagucuauuggucucacaucgggcacuugcaaggucgggucacuggaaaaccgggaguguaaacgcgauaucaugagcaauuauguugccgaagugcacaguaaccuucauggacugggcgcgaugaugcacaauuacggugacgauaagcgaauagagguauugaacgacgugauccccgaugagcucaauccugggcgucauaacugcuccgaccuggauagaaaaccauucuguaccgaauuuauuaaugucgcuaagccggccaacgagauggcacccaugucugugaucccuccacccauuguuaagccuaucccaguggccgaacccacaaccaaaaagacuauaccuuucgacaaacugcucagcgaggcugagaaggaauuaaaucaaacaaaaauuaggcuggagaccgaacggcgcuccaacgcagaggaagccgcuaaggagagagccaggaugcgggagaucgaagauaaacuucgcaaagacugggaguuggaacgagagagaaaggaugcggucgcagaagaccuggccaaagagauugcuaggcggcgugagaucgaacgcaaggcccacgagcuagauaaaaugcucaagaaaaaggaaagagaggaccugguggcaagggaacggguagacgaggauaugcgaaaucauguucgcagaccaaacacgacuaucgcuccgaccauuauaacaacucuucugauggccucagcggugauggccggacccuuggagaauagggaaaccaaccaccuccugaaccggccuggcaauggcgcauauacauuaagugacuuugcugagucaaccugcacgcuggccuacgggucugaauguaaguccugggagcaccagcucgaugagcuuucauucccauuuuuccauagcaaccuggacaaauauaguauguuggaagcugccacugagacaauccccauucuaaauaagucuuccgcagucugcaccaucagcccuucgacucacucuuccaacgccuguggacgcgaagcuagccugauaaagaagaaaugcgguagugauaugagcgcguuuuucuacgugaaucucgcaggccagauuacaguggucaagugugacaccaaccauguucuguccaaugauugcgggaacugcaucucuaagacgcuuagcggacaaaagaucuacaccccagugcaggacauguuuugucagaagggcuggucagagaguauucccuccacaagauauagcaaagaucugugcucuaucgguuugcacacuguaaaggaauguaaaauugggaccacaaauuucgagagggugggauuuauagucgugaagggccguaagauguacaucgagcagaugaaaaugcggucacgacaagaauuuagugaggaccaguuccucugcuauaagagcgaaggcuccucugggucgagcguuaaacugaagaaagugaaggucgaguccuguaagggagugacuaccucaagugccucuaaaugcagcggugaugaauacuuuuguuccagauauccgugcgagacagcuaacguagaggcccacuguauuuuaaggcgccauucagcaguuaucgaagugaaugucaacggcgugugggucgugccucggugcaucggguacgaggaaguucuggugagaaggaccagccuaaagguagaggacacuucuucccgcgaaugugacacgugccucugggagugcggcaaaaauaagcugauugucaaaacacacggacccaagauaguguaugccaccgcuuguagucaugguagcugcaaaucuguuaugcagaagccagccacuuucguguaccuuccuuaccccgggaacuccgagaucgucggcggagauauuggcgugcacaugaccgaagagucaaguccaagcaauauccauaugguagcacacugucccgcgaaggacucgugcgaaguguccucuuguuuguuuugcguucacgggcugcucaacuaucagugucauacacuguucagcgcccuucugauuucaaccacugucaugaguaucuugacacuccuguuacugcuagugaaaggagcuaaggaucucgugaaacgacuguuuuacuggcuuauaacgccuuugugcuggcuguccgucuucugugguuggaugauccggucuuggaagaaacguguuggcagcgcaauuuccagaaccaacgacacuaucggguggagggauaauucacgccggggacaagacauugagagagcccaguauacaggcggugcuccaggggccaaguacagcuuuuauggcgugaugauccucggacuguuaggcaacgugcacaguugcucugaguccauaauugcagauagcaagaucaugcaguguaccacaucggggucaucuacucugugcaaagcuaguggaaccguaauuaugaaacuugguccgaucggcuccgaaagcugcuugauacucaaagggcugaaggacucugagaaacaauucaucagcauuaagacgaucuccucagaacuaaccuguagggagggagaaaguuuuuggacaacucuguacacccccgucugccucagcucucgacgcugucaucugaugggcgagugcguguccgaucggugucuuagauggaagacaaaugagacuucagccgaguucaccgguaaagcgcacggggaaguuaugcacgaaaacaggugcuuugagcagaguggcggaauuggcuauggguguuucaaugugaacccuagcugcuuguacguccauuccuaccugaagucuguguauaaaaauggauuuaagaucuuccguuguguugccuggaaccaccgcauacgguuagaagugacgacacauucgagaaaauucccaaugguacucauggcuaugagcacccagcccacugacuggggcucaauuggucugauccuugauuccgggggaaucacaggcaccaaugcauacaguuuuaugaagcacggucugggcucuuucgccauuaucgacgauccuuauagcccagagcccaggaagggguuuuugggagagguccgaugcccgacugaagagaccgcuauucgggccuccccuucauguaaaauggcaccaaaccucauagaauaccagcccgagauggacacagcggaaugcacgaccaauaugaucgacccuauggccauuuucaaccgcggcucucugccccaagugagagaugggaugacuuuuacacagagcaucgagaagaauaccgugcaggcucuaacaacuggagaggucagggccaguauucggcugacccucgacgauuaugacguuguguaccagaacucccaauucgauugcagcgcaacguuuaaaaaucugacaggcuguuauucuugcgacgaagguucacgaauguguuaccagguaaaggcugagggggaaaccaucuuccauuuugugaacgaggaugaguccauaaacgucaucaauaaagugaguccagacguuagcgauuacugcacugugcuucacuucucgagaccugucauuucuaucgaaggacgcuaugacuguggcuuguccaagaggcccauggugauuaaagguacccugaucgccacagcaccacacgaugaccguaagcaugagggcgggagcucauuaguugugaacccgaagggaggcacugucgauuucuucggguggguaaguggacucaccucuuggcugggcgguccucuuaaaacauuucugacgauacuaggguuccucgcccugggauugcuguuagugguuauuaucaucauuauagcucggaccggcguggaacaggcgcucaagaaaaagaauaaauga

SEQ ID NO: 11418 - RNA, 4014 nt, Artificial Sequence
  derived and/or modified CDS sequence (opt3) from TOSV(SI-39538)__EU003175.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggauaauaucaccgagucuauuggucucacaucgggcacuugcaaggucgggucacuggaaaaccgggaguguaaacgcgauaucaugagcaauuauguugccgaagugcacaguaaccuucauggacugggcgcgaugaugcacaauuacggugacgauaagcgaauagagguauugaacgacgugauccccgaugagcucaauccugggcgucauaacugcuccgaccuggauagaaaaccauucuggaccgaauuuauuaaugucgcuaagccggccaacgagauggcacccaugucugugaucccuccacccauuguuaagccuaucccaguggccgaaagcacaaccaaaaagacuauacccuucgacaaacugcucuccgaggcugagaaggaauuaaaucaaacaaaaauuaggcuggagaccgaacggcgcucaaacgcagaggaagccgcuaaggagagagccaggaugcgggagaucgaagauaaacuucgcaaagacugggaguuggaacgagagagaaaggaugcggucgcagaagaccuggccaaagagauugcuaggcggcgugagaucgaacgcaaggcccacgagcuagauaaaaugcucaagaaaaaggaaagagaggaccugguggcaagggaacggguagacgaggauaugcgaaaucauguucgcagaccuaacacgacuaucgcuccaaccauuauaacaacucuucugauggccagugcggugauggccggaccguuggagaauagggaaaccaaccaccuccugaaccggcccggcaauggcgcauauacauuaagcgacuuugcugagucuaccuguacgcuggccuacggguccgaaugcaagucaugggagcaccagcucgaugagcuuagcuucccauuuuuccauaguaaccuggacaaauauucuauguuggaagcugccacugagacaaucccuauucuaaauaaguccagcgcagucuguaccaucucgcccucuacucacuccucaaacgccugcggacgcgaagcuagucugauaaagaagaaaugugguagcgauauguccgcguuuuucuacgugaaucucgcaggccagauuacaguggucaagugcgacaccaaccauguucugucuaaugauugugggaacugcaucagcaagacgcuuucaggacagaaaaucuacaccccugugcaagacauguuuugccagaagggcuggagugaguccauuccaagcacaagauauucuaaagaucuguguucaaucgguuugcacacuguaaaggaaugcaaaauugggaccacaaauuucgagagggugggauuuauagucgugaagggccguaagauguacaucgagcagaugaaaaugcggagucgacaagaguucagcgaagaccaguuccucuguuauaaguccgaaggaucuucggggagcuccguuaaacugaagaaagugaaggucgagucaugcaagggagugacuaccaguucugccagcaaauguuccggugaugaauacuuuugcucaagauaucccugugagacagcuaacguagaggcccacugcauuuuaaggcgccauagcgcaguuaucgaagugaaugucaacggcgugugggucgugccgcgguguaucggguacgaggaaguucuggugagaaggaccucucuaaagguagaggacacuuccagucgcgaaugcgacacgugucucugggagugcggcaaaaauaagcugauugucaaaacacacggcccuaagauaguguaugccaccgcuugcagccaugguucuuguaaauccguuaugcagaagcccgccacuuucguguaccuuccauacccugggaacucagagaucgucggcggagauauuggcgugcacaugaccgaagagaguagccccucgaauauccauaugguagcacacugcccagcgaaggacuccugugaagugucuagcugcuuguuuuguguucacgggcugcucaacuaucagugccauacacuguucucagcccuucugauuaguaccacugucauguccaucuugacacuccuguuacugcuagugaaaggagcuaaggaucucgugaaacgacuguuuuacuggcuuauaacgcccuuguguuggcugucugucuucugcgguuggaugauccggagcuggaagaaacguguuggcuccgcaauuucaagaaccaacgacacuaucggguggagggauaauagccgccggggacaagacauugagagagcccaguauacaggcggugcuccuggggccaaguacaguuuuuauggcgugaugauccucggacuguuaggcaacgugcacucuuguuccgagagcauaauugcagauucgaagaucaugcagugcaccacaucagggucuaguacucuguguaaggcuuccggaaccguaauuaugaaacuugguccaaucggcagcgaaucuugcuugauacucaaagggcugaaggacagcgagaaacaauucaucuccauuaagacgaucucaagugaacuaaccugcagggagggagagagcuuuuggacaacucuguacaccccggucugucucucuucccgacgcugccaucugaugggcgaaugugugucagaucggugccuuagauggaagacaaaugagaccagugccgaguucacugguaaagcgcacggggaaguuaugcacgaaaacagguguuuugagcagagcggcggaauuggcuaugggugcuucaaugugaaccccuccuguuuguacguccauucuuaccugaagucgguguauaaaaauggauuuaagaucuuccguugcguugccuggaaccaccgcauacggcaugaagugacgacacacagcagaaaauucccuaugguauuaauggcuaugucaacccagccaacugacuggggcuccauuggucucauccuggauagugggggaaucacaggcaccaaugcauacucuuuuaugaagcauggucuuggcagcuucgccauuaucgacgaucccuauuccccugagccaaggaagggguuucugggagagguccgaugucccacugaagagaccgcuauucgggccucaccgucuugcaaaauggcaccuaacuugauagaauaccagccagagauggacacagcggaauguacgaccaauaugaucgaccccauggccauuuucaaccgcggcagccucccucaagugagagaugggaugacuuuuacacagaguaucgagaagaauaccgugcaggcucugacaacuggagaggucagggccuccauucggcuaacccuggacgauuaugacguuguguaccagaacagccaauucgauugcucugcaacguuuaaaaaucucacaggcugcuauucaugugacgaagguucccgaaugugcuaccagguaaaggcugagggggaaaccaucuuccacuuugugaacgaggaugagaguauaaacgucaucaauaaagugagccccgacguuucggauuacuguacugugcugcacuucucuagaccagucauuuccaucgaaggacgcuaugacugcggccuuagcaagaggccuauggugauuaaagguaccuugaucgccacagcaccccaugaugaccguaagcacgagggcgggucaagucugguugugaacccaaagggaggcacugucgacuuuuucggguggguaucuggauuaaccuccuggcucggcgguccgcugaaaacauuucuuacgauacugggguuccuagcccucggacuguugcuggugguuauuaucaucauuauagcucggaccggcguggaacaggcguuaaagaaaaagaauaaauga

SEQ ID NO: 11419 - RNA, 4014 nt, Artificial Sequence
  derived and/or modified CDS sequence (opt3) from TOSV(SI-40463)__EU003176.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggauaauaucaccgagucuauuggucucacaucgggcacuugcaaggucgggucacuggaaaaccgggaguguaaacgcgauaucaugagcaauuauguugccgaagugcacaguaaccuucauggacugggcgcgaugaugcacaauuacggugacgauaagcgaguagagguguugaacgacgucauacccgaugagcucaauccugggcgucauaacugcuccgaccuggauagaaaaccauucuggaccgaauuuaucaauguggcuaagccgguuaacgagauggcccccaugucugugauuccuccacccaucgucaagccuauuccaguggcagaaagcacaaccaaaaagacuauccccuucgacaaacugcucuccgaggccgagaaggaauuaaaucaaacaaaaauaaggcuggagaccgaacggcgcucaaacgcugaggaagcagccaaggagagagcuaggaugcgggagauugaagauaaacuucgcaaagacugggaguuggaacgagagagaaaggaugccguagcggaagaccuggcaaaagagaucgccaggcggcgugagauugaacgcaaggcucacgagcuagauaaaaugcucaagaaaaaggaaagagaggaccugguugccagggaacggguggacgaggauaugcgaaaucauguccgcagaccuaacacgacuaucgcaccaaccaucauuacaacucuucugauggcuagugccgugauggcgggaccguuggagaauagggaaaccaaccaccuccugaaccggcccggcaauggcgccuauacauuaagcgacuuugcagagucuaccuguacgcuggcuuacggguccgaaugcaagucaugggagcaccagcucgaugagcuuagcuucccauuuuuccauaguaaccuggacaaauauucuauguuggaagccgcuacugagacaauaccuauccuaaauaaguccagcgccguguguaccauuucgcccucuacucacuccucaaacgcaugcggacgcgaagccagucugaucaaaaagaaaugugguagcgauauguccgccuuuuucuacgucaaucucgcgggccagauaacaguugugaagugcgacaccaaccauguacugucuaaugauugugggaacugcauuagcaagacgcuuucaggacaaaagaucuacaccccugugcaggacauguuuugccagaagggcuggagugaguccaucccaagcacaagauauucuaaagaucuguguucaauugguuugcacacugucaaggaaugcaaaaucgggaccacaaauuucgagagggugggauuuauuguugugaagggccguaagauguacauagagcagaugaaaaugcggagucgacaagaguucagcgaagaccaguuccucuguuauaaguccgaaggaucuucggggagcuccgucaaacugaagaaagugaagguagagucaugcaagggaguuacuaccaguucugcaagcaaauguuccggugaugaauacuuuugcucaagauaucccugugagacagccaacguggaggcucacugcaucuuaaggcgccauagcgccgucauugaagugaaugucaacggcguguggguugugccgcgguguaucggguacgaggaaguacuggucagaaggaccucucuaaagguggaggacacuuccagucgcgaaugcgacacgugucucugggagugcggcaaaaauaagcugaucguuaaaacacacggcccuaagauuguguaugcaaccgccugcagccaugguucuuguaaauccgucaugcagaagcccgcuacuuucguguaccuuccauacccugggaacucagagauaguaggcggagauaucggcgugcacaugaccgaagagaguagccccucgaauauucauaugguugcccacugcccagcaaaggacuccugugaagucucuagcugcuuguuuugugugcacgggcugcucaacuaucagugccauacacuguucucagcgcuucugaucaguaccacugugauguccauuuugacacuccuguuacugcuagucaaaggagcuaaggaucucguuaaacgacuguuuuacuggcuuaucacgcccuuguguuggcugucuguguucugcgguuggaugauacggagcuggaagaaacgugugggcuccgccaucucaagaaccaacgacacuauuggguggagggauaauagccgccggggacaagacaucgagagagcacaguauacaggcggugccccuggggcuaaguacaguuuuuauggcguaaugauucucggacuguuaggcaacguccacucuuguuccgagagcaucauagccgauucgaagauuaugcagugcaccacaucagggucuaguacucuguguaaagcauccggaaccgugaucaugaaacuugguccaauuggcagcgaaucuugcuugauccucaaggggcugaaggacagcgagaaacaauucauauccaucaagacgauuucaagugaacuaaccugcagggagggagagagcuuuuggacaacucuguacaccccgguuugucucucuucccgacgcugccaucugaugggcgaaugugugucagaucggugccuuagauggaagacaaaugagaccagugcugaguucacugguaaagcccacggggaagucaugcacgaaaacagguguuuugagcagagcggcggaaucggcuaugggugcuucaaugugaaccccuccuguuuguacguucauucuuaccugaagucgguguauaaaaauggauuuaagauuuuccguugcguagcguggaaccaccgcauccgguuagaagucacgacacauagcagaaaauucccuauggugcucauggccaugucaacccagccaacugacuggggcuccauaggucugauucuugauagugggggaaucacaggcaccaaugcuuacucuuuuaugaagcacggucugggcagcuucgcaaucauugacgaucccuauuccccugagccaaggaagggguuuuugggagaggugcgaugucccacugaagagaccgccauccgggcuucaccgucuugcaaaauggccccuaaccucauugaauaccagccagagauggacacagcagaauguacgaccaauaugauagaccccauggcgaucuucaaccgcggcagccugccucaagucagagaugggaugacuuuuacacagaguauugagaagaauaccguucaggcccuaacaacuggagaggugagggcuuccauccggcugacccucgacgauuaugacguaguguaccagaacagccaauucgauugcucugccacguuuaaaaaucugacaggcugcuauucaugugacgaagguucccgaaugugcuaccaggucaaggcagagggggaaaccauuuuccauuuugugaacgaggaugagaguaucaacguuauaaauaaagugagccccgacgucucggauuacuguacugugcuucacuucucuagaccaguuaucuccauugaaggacgcuaugacugcggcuugagcaagaggccuauggugaucaaagguacccugauugcuacagcuccccacgaugaccguaagcaugagggcgggucaaguuuagucguaaacccaaagggaggcacuguggacuuuuucggguggguuucuggacucaccuccuggcugggcgguccgcuuaaaacauuucugacgauccuaggguuccucgcacugggauugcuguuaguggucauaauuaucaucauugcccggaccggcguggaacaggcucucaagaaaaagaauaaauga

SEQ ID NO: 11420 - RNA, 4020 nt, Artificial Sequence
  derived and/or modified CDS sequence (opt3) from TOSV(SI-40614)__EU003177.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaauaucaccgagucuauuggucucacaucgggcacuugcaaggucgggucacuggaaaaccgggauuguaaacgcgacaucaugagcaauuauguugccgaggugcacaguaaccuucauggacugggcgcgaugaugcacaauuacggugaugacaagcgaguagaaguguugaacgaugucauacccgacgagcucaauccugggcgucauaacugcuccgaucuggacagaaaaccauucuggaccgaguuuaucaauguggcuaagccggccaacaagauugcacccaucucuguuauuccuccacccaucgugaaaccuauaccaauugccgaaagcacaaucaagaaaaccauucccuucgauaagcugcucuccgaggcugaaaaagaguuaaaucaaacuaagaucaggcuggagacagaacggcgcucaaacgcaggagaggccgcuagagaaagggcccggaugcgcgagaucgaagacaaacuucgaaagaauugggaguuggagagagaaaggaaggaugcggucgcagacgaucuggccaaagagauugcucggcgucgcgaaauagagagaaaggcccacgaacuagacaaaaugcucaagaaaaaggagagggaggaccagguggcaaucgaacggguaagugaggauaugcgaaaccauguucgcagaccuaauaccacgauugcuccagccccgacuaucauaaccacacugcuuauggcgagcgccgugauggcaggcccccuggaaaacagggagacuaaccacuugcucaaucggccuggcaacggggcuuauacccugucugacuuugccgaauccacauguaccuuagcuuacggaucagagugcaagagcugggagcaccagcuggaugaacucaguuucccauuuuuccauucuaaucuugacaaauauuccaugcuggaggccgcaacggaaacuauucccaucuugaacaagagcucggccgucuguacaaucucuccuuccacccacucaaguaaugcuugcggucgcgaggcgagccuaauuaaaaagaaauguggcaacaauauguccgcauuuuucuacgugaaccuggccgggcaaaucacuguggucaagugcgauacaaaucauguucucucuaacgacuguggaaauugcauuagcaagacccugucaggccagaaaauauacacgccagugcaggauauguuuugccagagagguuggaccgagaguauccccuccacaagguauagcaaggaccuuuguucuauugggcugcacacuguaaaagaaugcaagaccggagcuacaaacuucgagcgugugggcuuuaucgucgugaaaucacggaagauguacaucgaacaaaugaagaugcgaaguagacaggaguucagcgaagaucaguucuuguguuauaaauccgagucuucgagcggcuccucaguuaagcucaaaaaggugaaagucgagaguugcaagggggugacuaccucuagcgccuccaaguguucaggagacgaauacuuuugcagcagguauccgugugagacagcaaauguagaagcccacugcauucugcgccggcauucugcuguuauagaggugaacgucaauggugugugggucgugccuagauguaucggcuacgaagagguuuuagugaggcgcaccucccugaaaauggaggauacgaguagccgagaaugcgacacuugucuaugggagugcgggaagaacaaacucauuguaaagacacacggacccaaaaucgucuaugccaccgcaugcucucauggcuccuguaagucagugaugcagaaaccagcgacuuucguuuaccugccuuaccccgguaacagugaaauugucgggggcgacaucggagugcacaugaccgaggaaagcucgccauccaauauacauaugguggcucacugccccgccaaggauucuugugagguaagcucaugcuuguuuugugugcacggccuucugaacuaucaaugccauacacucuucagugcacugcuuaucuccaccacuguuaugucuauucugacauugcuccuguuacuggucaagggggccaaagaccuagugaagaaacucuuuuacuggcugaucacgccucuuuguugguugagcguguucugcggauggaugauuaaguccuggaaaaagcgggucgguucagcuaucagccguaccaaugauacuauaggcuggagagacaacaggcgcuaugggcgggauguugagagagcccaguacacaggaggcgugccaggugcaauuuauaguuuuuacggggugaugauccugggccuccugggaaauguacacucuuguuccgaaagcgucauugcugacucgaaggugaugcagugcaccacaucaggcucuaguacuuuauguaaagccuccgggaccguuaucaugaagcugggaccgauagguagcgagucuugccuuaucuugaaaggccucaaggauaacgaaaaacaauucauuagcaucaagacgauuuccucagagcugaccugcagggagggggaaaguuuuuggacaacucuauauacccccgugugucugagcucucgacgcugccaucucaugggagagugugucuccgaccggugccugaaguggaaaacaaaugaaacuucaccugaguucaccggcaaggcgcacggugaagugaugcacgagaacagauguuuugagcagagugggggcaucggauacggcugcuucaauguuaacccaagcugucuuuacgugcauuccauauugaaaucuguauauaagaauggguuuaaaauuuucaggugcgucgccuggaaccaccguauccgccuggaagugacgacacauucgcggaaguuccccaugguguuaauggcuaugagcacccagccuacugauuggggaucaaucggccucauucuggacuccgaggguaucacagggaccaaugcauacaguuuuaugaagcacggaucuggcagcuucgccauuauagaugacccauauucccccgaaccgagaaaagguuuucuuggcgaggucagguguccuacugaagagaccgcuauccgagccucaccaucuugcaagauggcacccaaccugauugaguaccagccugaaauggauacagcggaguguacgaccaauaugaucgaccccauggccauuuucaaccgggggagcuugccacaaguucgcgacggaaugacuuuuacacagaguaucgagaaaaacaccgugcaggcucucacaacuggcgaaguaagagccuccauaaggcugacccuagaugacuaugauguggucuaccagaauagccaaucugacugcucagcaacguucaagaaccugacagggugcuauuccugugaugaaggaagucggaugugcuaccaggugaaagcugagggcgagaccaucuuucauuucguuaaugaagacgagagcauuaacgugaucaauaaggucucgccugaugugucugacuacuguacuguucuccacuuuucccgacccgugauuagcaucgaagguagauaugauugcgggcugucaaaacgcccaauggucauaaagggaacccuuauugccacagcaccgcacgacgauaggaagcaugagggcgguaguucuuugguagugaacccuaaaggcgggacuguugacuucuuuggauggguguccggccugaccagcugguuagggggaccccucaagacauuccugacgauccuuggcuuucuggcccuaggucuccuguuggucgugaucauuauaaucauugcucguaccgggguagagcaggcgcugaaaaagaaaaauaaguga

SEQ ID NO: 11421 - RNA, 4014 nt, Artificial Sequence
  derived and/or modified CDS sequence (opt3) from TOSV(SI-51903)__EU003178.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaauaucaccgagucuauuggucucacaucgggcacuugcaaggucgggucacuggaaaaccgggaguguaaacgcgauaucaugagcaauuauguugccgaagugcacaguaaccuucauggacugggcgcgaugaugcacaauuacggugacgauaagcgaauagagguauugaacgacgugauccccgaugagcucaauccugggcgucauaacugcuccgaccuggauagaaaaccauucuggaccgaauuuauuaaugucgcuaagccggccaacgagaucgcacccaugucugugauuccuccacccaucguuaagccuauaccaguggccgaaagcacaaccaaaaagacuauucccuucgacaaacugcucuccgaggcugagaaggaauuaaaucaaacaaaaaucaggcuggagaccgaacggcgcucaaacgcagaggaagccgcuaaggagagagccaggaugcgggagauugaagauaaacuucgcaaggacugggaguuggaacgagagaagaaagaugcggucgcagaagaccuggccaaggagaucgcuagaaggcgggagaucgaacguaaagcccacgagcuagauaagaugcucaaaaagaaggaacgcgaggaccugguggcaagagaaaggguagacgaggauaugcggaaucauguucgacgcccuaacgcuacgauugccccaacuauaaucaccacacuucugauggcgagugccgugauggcaggaccguuggagaauagagaaacuaaccaccuccugaacaggcccggcaauggcgcuuauaccuuaagcgacuuugccgagucuacauguacccuggcuuacggguccgaaugcaaaucaugggagcaccagcucgaugagcuuagcuucccuuucuuccauaguaaccuggacaaguauucuauguuggaagccgcaacggagacuauuccaauccuaaauaaauccagcgccgucuguacaauaucgcccucuacccacuccucaaacgcuugcggacgggaagcgagucugauuaagaaaaagugugguagcgauauguccgcauuuuucuacgugaaucucgccggccagaucacuguggucaagugcgacacaaaccauguucugucuaaugauugugggaacugcaucagcaaaacccuuucaggacaaaagauuuacacgccugugcaggacauguuuugccagaaaggcuggagugaguccaucccaagcacccgcuauucuaaggaucuguguucaauugguuugcacacaguaaaagaaugcaagauagggacuaccaauuucgagagagugggauuuaucgucgugaagggcaggaaaauguacauugagcagaugaagaugcguagucggcaagaauuuagcgaggacgaauuucucuguuauaaauccgagggcaguucggggagcuccguuaagcugaaaaaggugaaggucgaaucaugcaaaggagugacaacuucuucugcuagcaaguguuccggugaugaguacuuuugcucacgauaucccugugagaccgccaacguagaagcacacugcaucuuaagaaggcauagcgccguuaucgaggugaaugucaacggcgugugggucgugccgcgcuguauuggguacgaagagguucuggugcggagaacaucucuaaaaguagaagacaccuccaguagggagugcgacacuugucucugggagugcggaaagaauaaacugauagucaagacgcacggcccuaaaaucguguaugcuacagccugcagccaugguucuuguaaguccguuaugcagaagcccgcaaccuucguguaccuuccauacccugggaacucagaaauugucggcggagauaucggcgugcacaugacugaggaaaguagccccucgaauauucauaugguagcgcacugcccagcuaaagacuccugugaggugucuagcugcuuguuuuguguucacgggcugcucaacuaucagugccauacccuguucucagcccuucugaucaguacaaccgucauguccauauugacucuccuguuacugcuagugaagggagcaaaagaucucgugaagcgccuguuuuacuggcuuaucacacccuuguguuggcugucugucuucugcgguuggaugauucgaagcuggaaaaagcggguuggcuccgccaucucacguacgaacgacaccauuggguggagagauaauagcaggcgcggacaggacguggagcgggcucaauauacuggcggugccccuggggcaaaguacaguuuuuauggcgugaugauccucggacuguuaggcaacguacacucuuguuccgaaagcauaauugcugauucgaaaaucaugcagugcacaaccucagggucuaguacacuguguaaggccuccggaacugucauuaugaaacuugguccaaucggcagcgagucuugcuugauacucaaggggcugaaagacagcgaaaagcaguucaucuccauuaagaccaucucaagugagcuaacgugcagagaaggagagagcuuuuggaccacacuguacacuccggugugucucucuuccaggcgaugccaucugaugggcgaguguguuucagaucgcugccuucgguggaaaaccaaugaaacaagugcggaguucacugguaaggcccacggggaagugaugcacgagaacagauguuuugaacaaagcggcggaauuggcuaugggugcuucaaugucaaccccuccuguuuguacgugcauucuuaccugaaaucgguuuauaagaauggauuuaaaaucuucaggugcguggcuuggaaccaccguauacgcuuagagguaaccacgcauagccggaaguucccuaugguccucauggcaaugucaacacagccaaccgacuggggcuccauuggucugauccuugauagugggggaaucacuggcacaaaugccuacucuuuuaugaagcacggucugggcagcuucgcuauuaucgacgaucccuauuccccugagccaagaaaaggguuuuugggagaagugaggugucccaccgaggaaacugccauucgagcaucaccgucuugcaagauggcgccuaaccucauagaguaccagccagaaauggacaccgccgaguguacaacgaauaugaucgaccccauggcuauuuucaaccggggcagccugccucaggugcgcgaugggaugaccuuuacucaaaguaucgagaaaaauacaguccaggcccuaaccacaggagaaguuagagcauccauuaggcugacucucgacgauuaugacgugguauaccagaacagccaguucgauugcucugcuaccuuuaagaaucugacgggcugcuauucaugugacgaggguccccggaugugcuaccaagugaaagccgaaggggagacaaucuuccauuuugucaacgaggaugaauccauaaacgugaucaauaagguuaguccagacgugagcgauuacuguaccguccuucacuucucgcgaccugugauuucuaucgagggaagauaugacugcggcuuguccaaacgccccaugguuauuaaggguacucugaucgcaaccgccccacacgaugacaggaagcaugaaggcgggagcucauuaguggucaacccgaaaggaggcacaguagauuucuucgggugggugaguggacucacuucuuggcugggcgguccucuuaagaccuuucugacaauacuaggguuccucgcucugggauugcuguuaguugugauuaucaucauuauagcgcguacgggcgucgagcaggcccucaaaaagaaaaauaaguga

SEQ ID NO: 11422 - RNA, 4014 nt, Artificial Sequence
  derived and/or modified CDS sequence (opt3) from TOSV(SI-68809)__EU003179.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaauaucaccgagucuauuggucucacaucgggcacuugcaaggucgggucacuggaaaaccgggaguguaaacgcgauaucaugagcaauuauguugccgaagugcacaguaaccuucauggacugggcgcgaugaugcacaauuacggugacgauaagcgaauagagguauugaacgacgugauccccgaugagcucaauccugggcgucauaacugcuccgaccuggauagaaaaccauucuggaccgaauuuauugacgucgcuaagccggccaaugagaucgcacccaugucugugauuccuccacccaucguuaagccuauaccaguggccgaaagcacaauuaaaaagaccauccccuucgauaaacugcucuccgaggcugaggaagaguuaaaccaaacuaagauuaggcuggaaacagagcggcgcucaaaugcagaagaggccgcuaaagagagagccaggaugcgggaaaucgaggacaaacuucgcaaggauugggaauuggagcgagaaagaaaagacgcggucgcagaggaucuggccaaggagaucgcuaggcggcgugaaauugagcgcaaagcccacgaacuagacaagaugcucaaaaagaaagagagagaagaccugguggcaagggagcggguaaacgaggauaugcgaaaucauguucgcagaccuaacaccacgauagcuccaacuaucauuaccacacuucugauggccagugcggugauggccggaccguuggaaaauagggagacuaaccaccuccugaaccggcccggcaauggcgcauauaccuuaagcgacuuugcugaaucuacauguacccuggccuacggguccgagugcaagucaugggagcaccagcucgaugaacuuagcuucccauuuuuccauaguaaccuggacaaguauucuauguuggaggcugccacggaaacuaucccuauacuaaauaaauccagcgcagucuguacaauuucgcccucuacccacuccucaaacgccugcggacgcgaggcuagucugaucaagaaaaagugugguagcaauauguccgcguuuuucuacgugaaccucgcaggccagaucacuguggucaaaugcgauacaaaucauguucugucuaacgacugugggaauugcauuagcaagacccuuucaggacaaaagaucuacacgccugugcaggauauguuuugccagaaaggcuggagugaauccauuccaagcaccagauauucuaaggaccuguguucaauagguuugcacacaguaaaagagugcaagacugggaccacaaacuucgagagggugggauuuaucgucgugaaaggccguaagauguacauugaacagaugaagaugcggagucgacaagaguucagcgaagaucaguuccucuguuauaaauccgaggggucuucggggagcuccguuaagcugaaaaaggugaaagucgaaucaugcaagggagugacuaccaguucugccagcaaguguuccggugacgaguacuuuugcucaagauaucccugugagacagcuaauguagaagcccacugcaucuuaaggcgccauagcgcaguuaucgaggugaacgucaauggcgugugggucgugccgcgguguauuggguacgaagagguucuggugagaaggaccucucuaaaaguagaagauacuuccagucgcgagugcgacacgugucucugggagugcggaaagaacaaacugauagucaagacacacggcccuaaaaucguguaugccaccgcuugcagccaugguucuuguaaguccguuaugcagaaacccgccacuuucguguaccuuccauacccuggcaauucagaaauugucggcggagacaucggcgugcacaugaccgaggaaaguagccccucgaacauucauaugguagcacacugcccagcgaaggauuccugugaggugucuagcugcuuguuuuguguucacgggcugcucaacuaucagugccauacacuguucucagcccuucugaucaguaccacugucauguccauauugacacuccuguuacugcuagugaagggagcuaaagaccucgugaagcgacuguuuuacuggcuuaucacgcccuuguguuggcugucugucuucugcgguuggaugauucggagcuggaaacguagaguuggcuccgcaaucucaaggaccaaugauacuauuggguggcgcgacaacagccggagaggacaagauguggagagggcccaguauacaggcggugcuccuggggccaaguacaguuuuuauggcgugaugauccucggacuguuaggcgaaguacacucuuguuccgagagcauaauugcagacucgaaaaucaugcagugcaccacaucagggucuaguacucuguguaaggcuuccggaaccgucauuaugaaacuugguccaaucggcagcgaaucuugcuugauacucaaggggcugaaggauagcgagaaacaauucaucuccauuaagacgaucucaagugaacuaaccugccgagagggagagagcuuuuggacaacucuguacaccccggugugucucucuucccgccggugccaucugaugggcgaauguguuucagacagaugccuuaaauggaagacaaaugagaccagugccgaguucacugguaaggcgcacggggaagugaugcacgaaaacagguguuuugagcagagcggcggaauuggcuaugggugcuucaaugucaaccccuccuguuuguacgugcauucuuaccugaaaucgguuuauaagaauggauuuaaaaucuuccguugcguggccuggaaccaccgcauacgguuagagguaacgacacauagcagaaaguucccuaugguccucauggcuaugucaacccagccaacugauuggggcuccauuggucugauccuugacagugggggaaucacaggcaccaaugcauacucuuuuaugaaacacggucugggcagcuucgccauuaucgaugaccccuauuccccugaaccaaggaagggguuuuugggagaggugcgaugucccacugaagagaccgcuauucgggccucaccgucuugcaagauggcaccuaaccucauagaauaccagccagagauggauacagcggaguguacgaccaauaugaucgaccccauggccauuuucaaccgcggcagccugccucaagugagagacgggaugacuuuuacacagaguaucgaaaagaauaccguccaggcucuaacaacuggagagguuagggccuccauucggcugacccucgaugacuaugaugugguauaccagaacagccaauucgacugcucugcaacguuuaagaaucugacaggcugcuauucaugugaugaagguucccgaaugugcuaccaggugaaagcugagggggagaccaucuuccauuuugucaacgaagacgagaguauaaacgugaucaauaagguuagccccgaugugucggacuacuguacuguccuucacuucucuagaccagugauuuccaucgaaggacgcuaugauugcggcuugagcaaaaggccuaugguuauuaaggguacccugaucgccacagcaccccacgacgaucguaaacaugagggcgggucaaguuuaguggucaacccaaagggaggcacuguagacuuuuucgggugggugucuggacucaccuccuggcugggcgguccgcuuaagacauuucugacgauacuaggguuccucgcccugggauugcuguuaguugugauuaucaucauuauagcucggaccggcgucgaacaggcgcucaaaaagaaaaauaaguga

SEQ ID NO: 11423 - RNA, 4014 nt, Artificial Sequence
  derived and/or modified CDS sequence (opt3) from TOSV(SI-76082)__EU003180.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggauaauaucaccgagucuauuggucucacaucgggcacuugcaaggucgggucacuggaaaaccgggaguguaaacgcgauaucaugagcaauuauguugccgaagugcacaguaaccuucauggacugggcgcgaugaugcacaauuacggugacgauaagcgaauagagguauugaacgacgugauccccgaugagcucaauccugggcgucauaacugcuccgaccuggauagaaaaccauucuggaccgaauuuauuaaugucgcuaagccggccaacgagauggcacccaugucugugaucccuccacccauuguuaagccuaucccaguggccgaaagcacaaccaaaaagacuauacccuucgacgagcugcucuccgaggcugaaaaagaguuaaaucaaacaaagauuaggcuggaaaccgagcggcgcucaaacgcagaagaggccgcuaaagagagagccaggaugcgggaaaucgaggauaaacuucgcaaggacugggaauuggagcgagaaagaaaggaugcggucgcagaggaccuggccaaggagauugcuaggcggcgugaaaucgagcgcaaagcccacgaacuagauaagaugcucaaaaagaaagagagagaagaccugguggcaagggagcggguagacgaggauaugcgaaaucauguucgcagaccuaacacgacuaucgcuccaaccauuauaacaacucuucugauggccagugcggugauggccggaccguuggaaaauagggagaccaaccaccuccugaaccggcccggcaauggcgcauauacauuaagcgacuuugcugaaucuaccuguacgcuggccuacggguccgagugcaagucaugggagcaccagcucgaugaacuuagcuucccauuuuuccauaguaaccuggacaaguauucuauguuggaggcugccacugaaacaaucccuauucuaaauaaauccagcgcagucuguaccaucucgcccucuacucacuccucaaacgccugcggacgcgaggcuagucugauaaagaaaaagugugguagcgauauguccgcguuuuucuacgugaaucucgcaggccagauuacaguggucaaaugcgacaccaaccauguucugucuaaugauugugggaacugcaucagcaagacgcuuucaggacaaaagaucuacaccccugugcaggacauguuuugccagaaaggcuggagugaauccauuccaagcacaagauauucuaaggaucuguguucaaucgguuugcacacuguaaaagagugcaagauugggaccacaaauuucgagagggugggauuuauagucgugaaaggccguaagauguacaucgaacagaugaagaugcggagucgacaagaguucagcgaagaccaguuccucuguuauaaauccgagggcaguucggggagcuccguuaagcugaaaaaggugaaagucgaaucaugcaagggagugacuaccaguucugccagcaaguguuccggugaugaguacuuuugcucaagauaucccugugagacagcuaacguagaagcccacugcauuuuaaggcgccauagcgcaguuaucgaggugaaugucaacggcgugugggucgugccgcgguguaucggguacgaagagguucuggugagaaggaccucucuaaaaguagaagacacuuccagucgcgagugcgacacgugucucugggagugcggaaagaauaaacugauugucaagacacacggcccuaaaauaguguaugccaccgcuugcagccaugguucuuguaaguccguuaugcagaaacccgccacuuucguguaccuuccauacccugggaacucagaaaucgucggcggagauauuggcgugcacaugaccgaggaaaguagccccucgaauauccauaugguagcacacugcccagcgaaggacuccugugaggugucuagcugcuuguuuuguguucacgggcugcucaacuaucagugccauacacuguucucagcccuucugauuaguaccacugucauguccaucuugacacuccuguuacugcuagugaagggagcuaaagaucucgugaagcgacuguuuuacuggcuuaugacgcccuuguguuggcugucugucuucugcgguuggaugauacggagcuggaaaaagcguguuggcuccgcaaucucaagaaccaacgacacuauuggguggagggauaauagccgccggggacaagacguggagagagcccaguauacaggcggugcuccuggggccaaauacaguuuuuauggcgugaugauccucggacuguuaggcaacguacacucuuguuccgaaagcauuaucgcagauucgaagauaaugcagugcaccacaucagggucuaguacucuguguaaggcuuccggaaccgucauuaugaaacuugguccaaucggcagcgagucuugcuugauucucaaggggcugaaagacagcgaaaagcaauucaucuccauaaaaacgaucucaagugagcuaaccugcagggaaggagagagcuuuuggacaacucuguacaccccggugugucucucuucccgacgcugccaucugaugggcgaguguguuucagaucggugccuuagauggaagacaaaugaaacuucugccgaguucaccgguaaggcgcacggggaagugaugcacgagaacagguguuuugaacagagcggcggaauuggcuaugggugcuucaaugucaaccccuccuguuuguacgugcauucuuaccugaaaucgguuuauaagaauggauuuaaaaucuuccguugcguggccuggaaccaccgcauucgguuagagguaacgacacauagcagaaaguucccuaugguccucauggcuaugucaacccagccaacugacuggggcuccaucggucugauacuugauagugggggaauuacaggcaccaaugcauacucuuuuaugaaacacggucugggcagcuucgccaucaucgacgaucccuauuccccugagccaaggaagggguuuuugggagaagugcgaugucccacugaggaaaccgcuauucgggccucaccgucuugcaagauggcaccuaaccucaucgaguaccagccagaaauggacacagcggaguguacgaccaauaugauugaccccauggccauauucaaccgcggcagccugccucaagugagagaugggaugacuuuuacacagaguaucgagaaaaauaccguccaggcucuaacaacuggagaaguuagggccuccauucggcugacccucgacgauuaugacgugguauaccagaacagccaauucgauugcucugcaacguuuaagaaucugacaggcugcuauucaugugacgaggguucccgaaugugcuaccaggugaaagcugaaggggagaccaucuuccauuuugucaacgaggaugaaaguauuaacgugaucaauaagguuagccccgacgugucggauuacuguacuguccuucacuucucuagaccagugauauccaucgagggacgcuaugacugcggcuugagcaaaaggccuaugguuauuaaggguacccugaucgccacagcaccccacgaugaccguaaacaugaaggcgggucaaguuuaguggucaacccaaagggaggcacuguagacuuuuucgggugggugucuggacucaccuccuggcugggcgguccgcuuaagacauuucugacgauucuaggguuccucgcccugggauugcuguuaguugugaucauaauuaucaucgcucggaccggcgucgagcaggcgcucaaaaagaaaaauaaguga

SEQ ID NO: 11424 - RNA, 4020 nt, Artificial Sequence
  derived and/or modified CDS sequence (opt3) from TOSV(TOSV/Mantova.ITA/2013)__KM507329.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaauaucaccgagucuauuggucucacaucgggcacuugcaaggucgggucacuggaaaaccgggauuguaaacgcgacaucaugagcaauuauguugccgaggugcacaguaaccuucauggacugggcgcgaugaugcacaauuacggugaugacaagcgaguagaaguguugaacgaugucauacccgacgagcucaauccugggcgucauaacugcuccgaucuggacagaaaaccauucuggaccgaguuuaucaauguggcuaagccggccaacaagauugcacccaucucuguuauuccuccacccaucgugaaaccuauaccaauugccgaaagcacaaucaaggagaccauucccuucgaaaaacugcucuccgaggcugagaaggaauuaaaucaaacuaaaaucaggcuggagacagaacggcgcucaaacgcagaggaagccgcuagagagagggcccggguccgcgagaucgaagauaaacuucgaaagaauugggaguuggaaagagagaggaaggacgcgguggcagaugaccuggccaaggaaauugcucggcgucgcgagauagagagaaaagcccacgaacuagauaagaugcucaaaaagaaagagagggaagaccagguagcaaucgagcggguuagugaagacaugcgaaaccaugugcgcagaccuaauaccacgauugcuccagccccgacuaucauaaccacacugcuuauggcgagcgccgucauggcaggaccccuggagaacagggagacuaaccacuugcucaaucggccuggcaacggcgcuuauacccugucugauuuugccgaauccacauguaccuuagcuuacgggucagagugcaagagcugggaacaccagcuggacgagcucaguuucccauuuuuccauucuaaucuugauaaguauuccaugcuggaggccgcaacggaaacuauucccaucuugaacaaaagcucggccguguguacaaucucuccuuccacccacucaaguaaugcuugcggacgcgaggcgagccuaauuaagaaaaagugugguaacaauauguccgcauuuuucuacgugaaccuggccggccaaaucacugucguuaaaugcgacacaaaucaugugcucucuaacgauugugggaauugcuuuagcaagacccugucaggacagaagauuuacacgccaguacaggacauguucugccagagaggcuggaccgaaaguauacccuccacaagguauagcaaagaucuuuguucuaucggucugcacacugugaaggagugcaaaaccgggacaacuaacuuugaacgugucggauucauugugguuaagucacggaaaauguacaucgagcaaaugaagaugcgaaguagacaggaguucagcgaagaccaguuuuuguguuauaaguccgagucuucgagcggcuccucagugaaacucaagaaagucaagguggaaaguugcaaaggcguaaccacaucuagcgcuuccaaguguucaggggaugaguacuucugcagcagguauccgugugaaaccgccaauguugaggcacacugcauccugcgccggcauucugccgugauugaggucaacgugaauggagucugggugguuccuagauguauagguuacgaagagguguuaguaaggcgcacuucccugaagauggaagacacgaguagccgagagugcgauacaugucuaugggaaugcggcaaaaacaagcucaucgucaaaacccacgggcccaagauuguguaugcuacugccugcucucauggauccuguaaaucaguuaugcagaagccagcaaccuuuguguaccugccuuaccccggcaacagugagaucgucgguggggacauuggcgugcacaugacagaggaaagcucgccauccaauauccauaugguagcgcacugccccgcuaaagacucuugugaggugagcucaugccuuuucuguguucacggauugcugaacuaucaaugccauacccucuuuagugcccugcuuauauccacuacagucaugucuauccugacguugcuccuguuacuggugaagggcgcaaaggaucuagugaaaaagcucuuuuacuggcugauuaccccucuuuguugguugagcgucuuuugcggguggaugaucaaauccuggaagaaacggguuggaucagccauuagccguacuaaugacacaaucgguuggagagauaacaggcgcuauggccgggacguggaaagagcucaguacaccgggggagccccaggcgcaaaguauaguuucuacggugugaugauacuggggcuccugggcaauguacacucuuguuccgagagcgucauugcugauucgaaggugaugcagugcacaacuucaggaucuaguaccuuauguaaagccuccggcacgguuaucaugaagcuggggccgauuggaagcgagucuugccuuaucuugaaaggucucaaggacaacgaaaaacaauuuauaagcaucaagaccauuuccucagagcugacaugcagggaaggcgagaguuucuggacuacccuauauacacccgugugucugagcucucgacgcugccaucucaugggggaaugugucuccgaucggugccugaaguggaaaacuaaugagaccucagcggaguuuacgggaaaggcccacggcgaagugaugcacgagaacagauguuucgaacagaguggugggaucggcuacggaugcuuuaauguuaacccuagcugucuuuacgugcauuccuauuugaaaucuguauacaagaauggcuucaaaauuuucaggugcgucgcuuggaaccaccguauccgccuggaggugacaacccauucgcggaaguuuccaaugguguuaauggcaaugagcacucagcccacagacugggggucaauaggacucauucuggauuccgaaggcaucaccgguacuaaugccuauaguuucaugaagcacgggucuggcagcuuugcuaucauugacgauccuuacuccccagagcccagaaaaggauuccuuggugaggucagguguccgaccgaagagacagccauccgagcaucaccuucuugcaagauggcgccaaaccugauugaauaucagcccgagauggacacggccgaauguaccacuaauaugauagauccuauggcuaucuuuaaccggggcagcuugccccaaguucgcgacgggaugacauucacccagaguauugagaaaaacacagugcaggcccucacuaccggagagguaagagcauccaucaggcugacgcuagacgauuacgacguggucuaucagaauagccaaucugauugcucagcuacauuuaagaaccugaccggcugcuacuccugugacgaagggagucggaugugcuaccaggugaaagccgagggagaaacuauuuuccauuuuguuaaugaggaugagagcaucaacgugauaaauaaggucucgccagacgugucugauuauuguaccguucuccacuucucccgaccugugaucagcauugaaggcagauacgacugcggucugucaaaacgccccauggucaucaaggggacacuuauugcaacugccccacacgaugacaggaagcaugagggaggcaguucuuugguagugaacccgaaagguggcaccguugauuucuucggguggguguccggacugacaagcugguuaggcgggccucucaagacguuucugaccauccuuggauuccuggcucuaggccuccuguuggucgugauaauuaucaucauugcgcguacugguguacagcaggcccugaaaaagaaaaauaaguga

SEQ ID NO: 11425 - RNA, 4020 nt, Artificial Sequence
  derived and/or modified CDS sequence (opt3) from TOSV(TOSV/Phl.233/FR/2009)__HQ184337.1__GP
auguucaucgccaagcugcuccuuauuagcugccuggugcagcaggcuuacuugaaauauaccauaaucuccgagacaggcaacgggacuagaacgucuuuuuguuacucaaguaggaccagcuuaggaucccugcuagaagcaugggacaaugucacagagucuauuggucucacuucggggaccugcaagguuggcucacuggaaaaccgggauugucgcaaagacaucaugagcaauuauguggccgagguacacaguaaccuucauggacugggcgcgaugaugcacaauuacggugaugacaagcgaguggaaauuuugaacgaugucauccccgacgagcucaauccugggcaucacaacugcuccgaucuggaccguaaaccauucuggacagaguuuauaaauguggcuaagccgcugucugaaaucguucccaugagcgugauuccuccacccgucgugaagccucagccacccgccgagccuuccucaaagaagcauguaccauucgauguucucuuaagugaagcagagaaagagcugaaccagaccaagaucagacuugaagacgagaggaaaagcaaugccgaagagacugcuaaggaacgggcacgcaugaaggagauugaggaugaauugagaagggagugggaacuggagcggaaacgcaaggacgccauggcugaugaccuagccaaagaaacagcgcgaagaagggagaucgagcggaaggcacacgaacucgacaaaaugcugaagaaaaaggagcgugaaucucuuauagccaaggagaaagcugaugaagacaugcgcucccacgugcauaagccgaacaccacgagagcccccgcaccuacuauuaucaccacacuguugauggcuucagccgcgcucgccggaccacuggagaauagggagacuaaccacuuacugaaucggcccggcaacggcgcauauacccucagcgauuuugcugaaaguacauguacccuugccuacgggucugagugcaaauccugggaacaucuguugaacgaggagcuauucccauuuuuccacagcaaucuggacaaguauucgaugcucgaagcugccacggagacugucccuauucugaacaaaucuuccgcaguguguacaaucucacccaguacccacagcuccaaugccugcggacgagaggcuucugugauccgcaagaaguguuacagcaacaugucagcguuuuucuacauuaaucuugcaggucagauaacugucaucaaaugcgaaacaaaccauguucugaguuccgauuguggcaauugcauuagcaagucuuugucagggcaaaaaguguauaccccgguacaggacguguuuugccagaagggauggacgcagaguaucccuagcaccagauacuccaaagauauauguucuauuggccuccacacagucaaggaaugcaagaucgguacuaccucguucgagagggugggguuuaucguugugaaaggacggaagauguauauugagcaaaugaaaaugcgcagcagacaggaauacuccgaggaccaguuccuguguuauaagucagaaaguggcucuggcagcuccgucaaauuaaagaaguucaaagugcagucaugcaaggggguaacaacuagcucugccuccaaauguaguggagaugaguacuuuugcagcagguaucccugugaaaccgcuaacguugaggcccauugcauccugcgucggcacucugcaauuguggaggucaaugugaacggugucugggugguuccacgauguauaggcuacgaagaggugcuaguaaagagaacaucccucaaagucgaagacaccacugggagggagugcgauucaugucugugggaaugcggaaagaauaaacuuaucgugaagacgcauggcccuaagguuguguacgccacagcuugcagucacgguagcuguaaaucggucaugcaaaagcccgccaccuucguguauuugccauaccccgggaacuccgagauuguaggcggagacaucggcauccacaugacugaggaaucuagcccuucaaauauucaucugguggcacacugcccagcgcgcgacaguugugauguuuccgacugccucuuuuguguccaugggcugcuuaacuaucagugccacacccuguucucugcuuugcucauaagcacaaccgugauguccauccugacuuuacugcuacuccuggugaaaggagccaaggaucuugucaaaaaguuguuucacuggcugauuacaccgcucuguuggcugucaguuuucugcuguuggguggugaaaagcuggaaacggagaguagguagugcaaucucuaggacgaaugacaccauuggcuggcgcgagaaccgacggcaugcccaggauaucgaacgugcucaauacacugggggagcccccggcgcaaaguauuccuuuuacggugucaugauauuagggcugcuuagcucggcucagucaugcucugagagugugaucgccgacuccaaaauuaugcaguguacaaccagcggcucuagcacauugugcaaggcguccggaacuguuaucaugagacucggcccuauugggucagagaguugccugauccuaaaaggacugaaggauagcgaaaagcaguucauaucuauuaaaaccaucuccucagagcucacguguagggaaggugagaguuuuuggaccacacuguauacuccaauuugccuuagcucccgccggugucacuugaugggcgaaugcgugucugacagaugucugaaguggaaaaccaaccaaacaucggccgaguucacugggaaggcucauggagaugucaugcacgagaauaggugcuuugaacagagcggcgguaucggguacggcuguuucaacgugaaucccucaugcuuauacguucauuccuaucucaaaaguguguaccgaaacggauuuaagguauuccgcugugucgcauggaaucaccggauaagacuggaggugaccacgcacucuaggaaguucccuauggugcuuauggccaugagcacacagccaaccgacuggggcuccaucgggcugauuuuggauucagaaggaaucacuggcacaaacucuuauagcuuuaugaaacaugguaguggguccuucgcuauuaucgacgaucccuacagcccggagccucguaagggauuucucggcgaaguccgcugcccaaccgaggagacugccaugcgggcaucucccucauguaaaauggcgccuaaucugauagaauaucagcccgagauggacaccgccgaaugcacaacgaacaugauugacccaauggcuaucuucaauagagguucccuaccucaaguuagggauggcaugaccuuuacucagaguaucgagaagaacacagugcaggcccugaccacaggggaaguaaaagcaagcauucgacucacucuggacgauuacgacguggucuaucaaaauucgcaaucugauugcuccgcuaccuucaagaaccuuacgggauguuacagcugcgacgagggcucacgguuguguuaccaggugaaagccgagggggaaacaaucuuucacuucauuaaugaggaagagaguauaaacguuaucaauaaggugucucccggagucuccgauuauugcaccgugcugcauuuuagccgcccaguuauuucaaucgagggcacuuacgacugugguuuaaguaagagaccgauggugauuaaagggacccucaucgcaacagccccucacgaugacaggaagcaugaaggaggcagcucccuggucguaaaccccaaagguggcucuguggauuucuuuggguggcuuagcggacugacuuccuggcuaggcgggccacucaagaccuuccugacaauauugggauuucuggcuguuggcuuacuccugguggucaucauuaucauuaucauacggacggguaugcagcaggcgcuuaaaaagaagauuaaauga

SEQ ID NO: 11426 - RNA, 4020 nt, Artificial Sequence
  derived and/or modified CDS sequence (opt3) from TOSV(TOSV/Phl.51/FR/2009)__HQ184336.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaaugucaccgagucuaucggucucacaucgggcacuugcaagguugggucacuggaaaaccgggauugucgcaaagacauuaugagcaauuauguggccgagguacacaguaaccuucauggacugggcgcgaugaugcacaauuacggugaugacaagcgaguggaaaucuugaacgaugucauacccgacgagcucaauccugggcaucacaacugcuccgaucuggaccguaaaccauucuggaccgaguuuaucaauguggcuaagccgcugucugaaauuguucccaugagcgugaucccuccacccgucgugaagcuccaaccuccagccgagcccuccaguaaaaagcauguaccuuucgauguuuuacugucagaagcagagaaagagcuuaaccagacaaagauuagauuggaagacgagaggaaaagcaaugccgaagagaccgcuaaggaacgggcacgcaugaaggagaucgaggaugaacugagaagggagugggaacuagagcggaaacgcaaggacgccauggcugaugaccucgccaaagaaacugcgcgaagaagggagauagaccggaaggcacacgagcuggaucguaugcuuaaaaagaaagaacgcgagucucugauugccaaggaaaaggcugacgagaacaugagaucccacgugcaugaaccaaauacaaccagggccccggcacccacgaucauuacuaccuugcucauggcuucagccgcgcuggccggaccuuuagagaaccgggagacaaaucaucugcucaaccgaccaggcaacggcgcauauacucuuagcgauuuugcugaaaguaccuguacacuggccuacgggucugagugcaaauccugggaacacuugcuaaaugaggagcuguuccccuuuuuccacagcaaccucgacaaguauucgaugcuggaagcugccaccgagacggucccuauccuuaauaaaucuuccgcaguguguacuaucucaccaaguacacacagcuccaacgccugcggacgcgaggcuucugugauuagaaagaaauguuacagcaauaugucagcguuuuucuacauaaaccuggcaggucagaucaccgucguuaagugcgaaacuaaucauguguugaguuccgauuguggcaacugcauuagcaagucucucucagggcaaaaaguauauacacccgugcaggacgucuuuugccagaagggauggacccagaguaucccgagcacgagguacuccaaagauauauguucuauuggccugcacaccgugaaggaaugcaaaaucgguacaacuucguucgagcggguuggguuuaucguggucaagggacgcaagauguauauugagcaaaugaaaaugagaagcaggcaggaauacuccgaggaccaguucuuauguuauaagucagaaaguggcucuggcagcuccgugaaacugaagaaauucaagguagagucaugcaaggggguuaccacaagcucugccuccaaauguaguggagaugaauacuuuugcagccguuucccuugugagacugcuaauguggaggcccauugcauccuacggcgacacucugcaauugucgaagugaacgucaaugguguguggguugugcccagauguauaggcuaugaggaaguacucgucaagaggaccucccugaaaguggaggacacaaccgaacgcgagugcgauucaugucuuugggagugcgggaagaacaaauugaucguuaagacucauggaccaaaaguggucuacgccacggcuugcagucacggcagcuguaagucggugaugcagaagccugccacauuuguauaccugcccuauccagguaauuccgaaauuguugggggcgacaucggaauccacaugaccgaggaaucuagccccucaaacauucaucucguggcacacugcccugcgcgggacaguugugaugucuccgacugccuguucugugugcauggccuucugaauuaccaaugccacacuuuguuuucugcucuccugauaagcaccacagugauguccaucuuaacccugcuacuccugcuugucaaaggggccaaggauuugguuaaaaagcuguuccacuggcucauuacuccacuguguugguuaucaguguuuugcuguugggugguaaaaagcuggaagagaagggucggaagugcaaucucucgcacaaacgacacgauugguuggcgagagaaccggcgucaugcccaggauaucgagagagcucaguauaccggcggggccccgggagcaaaguacuccuucuuuggcgugaugauacugggucuuuugagcucggcucaaucaugcucugaaaguguuaucgccgacuccaaaauuaugcaguguacuacaagcgggucuagcacccucugcaaggcguccggcacagugaucaugaggcugggacccauuggcucagagaguugccuaauccugaaagggcucaaggauagcgaaaaacaguucauaucuauuaagacuaucuccucagagcugaccugucgcgaaggagagaguuuuuggacgacccuuuauacaccuauuugcuugagcucccggagaugucaccugaugggugagugcgucucugacagguguuuaaaguggaaaacuaaucagaccucggccgaguucacaggcaaggcucauggggaugugaugcacgaaaaccgaugcuuugaacaaagcggaggcaucgguuacggguguuucaauguuaacccaucaugccucuaugugcauuccuaccugaaaaguguauaccgcaauggcuucaaggucuuucgguguguggcauggaaccacagaauaaggcuugaggugacuacccacucucguaaauuccccaugguccugauggccaugagcacgcagccuacagacuggggauccaucggcuugauucucgauucagaagggaucaccggaacuaauucuuauagcuuuaugaagcauggcagugguuccuucgcuauuaucgacgauccauacagccccgagccgcgcaagggguuucugggagagguucggugcccuacagaagagaccgccaugagagcaucuccaucauguaaaauggcgcccaaccuaguggaauaucagccugagauggacacugccgaaugcaccacaaauaugauagaccccauggcuauuuucaacaggggcucccugccacagguacgagaugguaugacguuuacccaaaguaucgagaagaauacugugcaggcccucacaaccggcgaggucaaagcaagcauccggcugacacuugacgauuacgacgugguuuaucagaacucgcagucugauugcuccgcuacuuucaagaauuugaccggguguuacagcugcgacgaaggaucacgccuguguuaucaagugaaagccgagggcgaaacgauuuuucacuucaucaacgaggaggaaaguauuaaugucauaaacaaggugucuccuagaguuuccgauuacugcacaguguuacauuuuagcaggcccgucaucucaauugaggggaccuacgacuguggacucaguaaacggccaaugguaaucaagggcacucugauugcaaccgccccgcacgaugaccgaaagcaugaaggugggagcucccuugugguuaacccuaaaggaggcucuguggauuucuuugguuggcugagcggccuaacauccuggcucgggggaccccugaagacuuucuugaccauccugggcuucuuagcugucgggcuccugcuugugguaauaaucauuaucauuaucagaacaggaaugcagcaggcgcugaaaaagaaaauaaaguga

SEQ ID NO: 11427 - RNA, 4020 nt, Artificial Sequence
  derived and/or modified CDS sequence (opt3) from TOSV(11368)__KU925897.1__GP
auguucaucgccaagcugcuccuuauuagcugccuggugcagcaggcuuacuugaaauauaccauaaucuccgagacaggcaacgggacuagaacgucuuuuuguuacucaaguaggaccagcuuaggaucccugcuagaagcaugggacaaugucacagagucuauuggucucacuucggggaccugcaagguuggcucacuggaaaaccgggauugucgcaaagacaucaugagcaauuauguggccgagguacacaguaaccuucauggacugggcgcgaugaugcacaauuacggugaugacaagcgaguggaaauuuugaacgaugucauccccgacgagcucaauccugggcaucacaacugcuccgaucuggaccguaaaccauucuggacagaguuuauaaauguggcuaagccgcugucugaaaugguucccaugagcgugaucccuccacccgucgugaagcuccagccuccagccgagcccuccucaaagaagcauguaccuuucgauguuuuacugagugaagcagagaaagagcuuaaccagaccaagauuagauuggaagacgagaggaaaagcaauacugaagagacagccaaggaacgggcucgcaugaaggagaucgaggaugaacugagaagggagugggaacuagagcggaaacgcaaggacgcaauggccgaugaccucgcuaaagaaaccgcccgaagaagggagauugagcggaaggcgcacgaacuggacaaaaugcuuaagaaaaaggagcgugaaucucugaucgcaaaggagaaagccgaugaagacaugcgcucccacgugcauaagccaaacacgacuagagcuuuggccccgaccauaauuacaacucuccugauggcaucagcugccuuagcgggaccccuggagaauagggagaccaaccaccuccuuaaucggccuggcaacggcgccuauacacugagcgauuuugcagaaaguaccuguacguuggcuuacgggucugagugcaaauccugggaacaucuacugaacgaggagcuuuucccauuuuuccacagcaaucuggacaaguauucgaugcuugaagccgcuacugagacaguccccauccugaacaaaucuuccgccguguguaccauuucaccuaguacucacagcuccaaugcaugcggacgagaagccucugugauccgcaagaaguguuacagcaacaugucagcguuuuucuacaucaauuuggcuggucagauuacagucauaaaaugcgagaccaaccauguucucaguuccgauuguggcaauugcaucagcaagucucugucagggcaaaaaguguauacgccaguacaggacguguuuugccagaagggauggacccagaguauucccagcacaagauacuccaaagauaucuguucuauaggcuuacacacugucaaggaaugcaagauugguaccacaucguucgagagggugggguuuaucguugugaaaggacggaagauguauaucgagcaaaugaaaaugcgcagcagacaggaauacuccgaggaccaguuccuguguuauaagucagaaaguggcucuggcagcuccgucaaacuaaagaaguucaaagugcagucaugcaaggggguaacuaccagcucugcauccaaauguaguggagaugaguacuuuugcagcagguauccgugugaaacagccaacguugaggcucauugcauucuccgucggcacucugccaucguggaggucaaugugaacggugucugggugguuccucgauguauuggcuacgaagaggugcugguaaagagaaccucccuuaaagucgaagacacuacggggagggagugcgauucauguuugugggaaugcggaaagaauaaacugauagugaagacacauggccccaagguuguguacgcaaccgccugcagucacgguagcuguaaaucggucaugcaaaagccagcuacuuucguguaucucccuuaccccgggaacuccgagaucguaggcggagacauuggcauccacaugaccgaggaaucuagcccaucaaauauccaucugguggcccacugccccgcacgcgacaguugugauguuuccgacugccucuuuuguguccaugggcuguugaacuaucagugccacacacucuucucugcgcuguuaauuagcaccacugugauguccauacugacacuacuccugcuuuuggugaaaggagcuaaggaucuggucaaaaagcucuuucacuggcugaucacgccuuuauguuggcugucaguuuucugcuguuggguggugaaaagcuggaaacggagaguagguagugccauuucuaggaccaaugacacuaucggcuggcgcgagaaccgacggcaugcacaggauauugaacgugcccaauacacagggggagcuccaggcgccaaguauuccuuuuacggugucaugauccuuggguugcucagcucggcacagucaugcucugagagugugauagcugacuccaaaaucaugcaguguaccacaagcggcucuagcacucugugcaaggccuccggaaccguuauuaugagacuaggcccgaucgggucagagaguugccugauucucaaaggacugaaggauagcgaaaagcaguucaucucuauaaaaacgauuuccucagagcuuaccuguagggaaggugagaguuuuuggacaacuuuguauacccccaucugccugagcucccgccggugucacuuaaugggcgaaugcgugucugacagaugucucaaguggaaaacaaaccaaacuucggcggaguucaccgggaaggcccauggagaugucaugcacgagaauaggugcuuugaacagagcggcgguauuggguacggcuguuucaacgugaauccuucaugccuguacguucauuccuaucuuaaaaguguguaccgaaacggauuuaagguauuccgcugugucgcuuggaaucaccggaucagacuggaggugacgacacacucuaggaaguucccaaugguguugauggcaaugagcacccagcccacugacuggggcuccauagggcucauccuggauucagaaggaauuacaggcaccaacucuuauagcuuuaugaaacaugguaguggguccuucgccaucauugacgauccuuacagcccagagccccguaagggauuucuaggcgaaguccgcugcccgacugaggagaccgcuaugcgggccucuccuucauguaaaauggcaccaaaucugaucgaauaucagcccgagauggacacagcggaaugcacgaccaacaugauagacccuauggccauuuucaauagagguucccucccccaaguuagggauggcaugacuuuuacacagaguaucgagaagaacaccgugcaggcucugacaacuggggaaguaaaagccagcauccgacuuauuuuggacgauuacgacguggucuaucaaaauucgcaaucugauugcuccgcaaccuucaagaaccugacgggauguuacagcugcgacgagggcucacgguuauguuaccaggugaaagcugagggggaaacaaucuuucacuucauuaaugaggaagagaguauaaacguuaucaauaaggugucuccaggagucuccgauuauugcaccgugcuccauuuuagccgcccuguuauuucaaucgagggcacuuacgacuguggucugaguaagagacccauggugauuaaagggacccuuaucgccacagcaccacacgaugacaggaagcaugaaggaggcagcucccuggucguaaacccgaaagguggcucuguggauuucuuuggguggcuaagcggacucacuuccuggcugggcgggccuuugaagaccuuccugacaauauuaggauuucucgccguuggccugcuucugguggucaucauuaucauuaucauacggacggguaugcagcaggcuuugaaaaagaagauuaaauga

SEQ ID NO: 11428 - RNA, 4020 nt, Artificial Sequence
  derived and/or modified CDS sequence (opt3) from TOSV(5904242804)__KU935737.1__GP
auguucaucgccaaguuacuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaauaucaccgagucuauuggucucacaucgggcacuugcaaggucgggucacuggaaaaccgggauuguaaacgcgacaucaugagcaauuauguugccgaggugcacaguaaccuucauggacugggcgcgaugaugcacaauuacggugaugacaagcgaguagaaguguugaacgaugucauacccgacgagcucaauccugggcgucauaacugcuccgaucuggacagaaaaccauucuggaccgaguuuaucgauguggcuaagccgacaaauaagauugcccccaugucuguuaucccuccacccauugugaaaccuaucccagucgcagaaagcaccauaaagaaauccauucccuucgacaagcugcucucagaggccgaaaaagaguuaaaccagacuaagaucaggcuggagacagaacggcgcaguaaugcugaggaagcagccaaggagagagcuaggaugcgggaaauugaggauaaacuucgcaaggacugggaguuggaacgagagagaaaagaugccguggcggacgaccuggcaaaggaaaucgccaggcggcgugagaucgaacgcaaagcucacgagcuagauaagaugcucaaaaagaaggagagagaagaccugguagccagggagcggguuagcgaagauaugcgaaaccaugugcgcaaaccuaauaccacgauugcaccagcuccgacuauaaucaccacacuucugauggccucugcggucauggccggacccuuggagaacagagaaacuaaucaccuccugaacaggccuggcaacggcgcauauaccuuauccgacuuugcugagucaacauguacccuggccuacgggagcgagugcaagaguugggaacaccagcucgaugagcuuucuuucccauuuuuccauuccaaucuggacaaauauagcauguuggaagcugccacggagacuauucccauccuaaacaagucgucugcaguguguacaauauccccuucaacccacaguagcaaugccugcggacgggaggcuucccugauuaaaaagaagugugguucuaacaugagcgcguuuuucuacgugaaucucgcaggccagaucacugucguuaaaugcgauacaaaccaugugcugucaaaugacugugggaacugcaucaguaagacccuuuccggacaaaagauuuacacgccaguacaggauauguuuugccagaagggcuggaccgaaagcauccccaauacacgcuauucuaaagaccuguguucaauugguuugcacacugugaaggagugcaagaccgggacaacuaacuucgaaagagucggauuuauagugguugagggcaggaaaauguacaucgaacagaugaagaugcguagucggcaagaguucagcgaggaucaguuccucuguuauaaauccgaaucuucgagcggcuccucagugaagcugaaaaaggucaagguggagaguugcaaagggguaaccacaucuagcgccuccaaguguucaggagacgaauacuuuugcagccgauauccgugugagaccgcuaauguugaagcccacugcauuuuaagaaggcauucugcagugaucgaggucaacgugaauggugucuggaucgugccucgcuguauuggcuacgaggaaguucuggugcggagaacuucccuaaaaguagaggacacgaguagcagggaaugcgauacaugucucugggagugcgggaagaacaaacugauagucaagacccacggacccaaaaucguguaugccacugcuugcucucauggcuccuguaagucaguuaugcagaagccagccaccuucguguaccuuccuuaccccgguaauagugaaauugucgggggcgacaucggagugcacaugacagaggagagcucgccauccaacauucauaugguagcacacugccccgcgaaagauucuugugaagugagcucaugcuuguuuuguguucacggccugcucaacuaucagugccauacccuguucagugcccuucugaucuccacuacagucaugucuauauugacgcuccuguuacugcuagugaagggggcuaaagaccucgugaagcgccuguuuuacuggcuuaucaccccuuuguguuggcugagcgucuucugcggauggguuauuaaauccuggaagaagcgaguggguucagcaaucagccggacuaaugauacaauuggcuggcgugacaacagaagguaucgccaagauguggagcgggcccaguacaccgggggagcuccaggcgccaaauauaguuuuuacgguguaaugguccucgggcuguuaggcaaugugcacucuuguuccgaaagcaucauagcagacucgaagauuaugcagugcacaacuucaggaucuaguacccuguguaaagcuagcggcacgguuaucaugaaacuugggccgauuggaagcgagucuugcuugauccucaaaggucugaaggauagcgagaagcaauucauauccaucaaaaccauuucaagugaacuaacaugcagagagggcgaauccuuuuggacuacccuguauacacccgugugucucucuuccaggcgaugccaucugaugggggagugugucucagaccgcugccuuaaguggaaaacuaacgaaaccagugccgaguucacgggaaaggcgcacggcgaggugguucacgaaaaucgguguuuugagcagagcggugggaucggcuacggaugcuucaacgugaauccuuccuguuuguacguacauucuuaucugaaaucggucuacaagaacggcuuuaagauuuucagaugcguggccuggaaucacaggauccguuuagaagugacaacccauagccgcaaauucccaaugguccucauggcuaugucaacucagcccacagauuggggguccauaggacugauucuugacagugagggcaucaccgguacuaacgcauauucuuuuaugaagcacgggagcggauccuucgccaucauugaugacccuuacucaccagaaccccggaaaggcuuucugggugagguuagauguccgaccgaggaaacagcuaucagggccucuccuagcugcaagauggcaccaaauuugauugaguaucagcccgaaauggacacggcggaguguaccacuaacaugauagauccuauggccaucuucaaucgaggcagucucccccaagugcgggacgggaugacauuuacccaguccauugagaaaaacacaguacaggcucugacuaccggagaagugcgcgccagcaucagacuaacgcuggaugacuacgaugucguguaucaaaauucucaaucagacugcuccgcaacauucaagaaccucaccggcugcuacaguugugaugaggggagcaggaugugcuaccagguuaaagcugaaggagagacuauuuuucauuucaucaacgaagacgagucgauaaaugugaucaacaaggucaauccagaugugucugacuauuguaccguucugcacuuuucccggccugugauuagcaucgagggccgauacgauugcggucuuucaaagagacccauggucauuaaagggacauugaucgccacugcaccacacgacgaucgcaagcaugaaggaggcaguucucugauaguaaacccgaaagguggcaccguggacuucuuuggguggguuuccggauuaacaagcuggcucggcgggccucugaagacguuccuuaccauucugggauuucuagcccucggccuguugcugguggucaucaucauuauaaucgcuaggacuggugugcagcaggcgcugaaaaagaagaauaaauga

SEQ ID NO: 11429 - RNA, 4020 nt, Artificial Sequence
  derived and/or modified CDS sequence (opt3) from TOSV(5963930705)__KU935734.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaaugucaccgagucuaucggucucacaucgggcacuugcaagguugggucacuggaaaaccgggauugucgcaaagacauuaugagcaauuauguggccgagguacacaguaaccuucauggacugggcgcgaugaugcacaauuacggugaugacaagcgaguggaaaucuugaacgaugucauacccgacgagcucaauccugggcaucacaacugcuccgaucuggaccguaaaccauucuggaccgaguuuaucaauguggcuaagccgcugggagaaauuguucccaugucugugaucccuccacccgucgugaagcuccaaccuccagccgagcccagcuccaaaaagcauguaccuuucgauguuuuacugucagaagcagagaaagagcuuaaccagacaaagauuagauuggaagacgagaggaaaaguaaugccgaagagaccgcuaaggaacgggcacgcaugaaggagaucgaggaggaacugagaagggaaugggagcuagaacggaaacgcaaggaugccauggcugacgaucucgccaaagagacugcgcgaagaagggagauagaacggaaggcacacgagcuggaccguaugcuuaaaaagaaagaacgcgagagccugauugccaaggaaaaggcugacgaggauaugagaucucacgugcauaaaccaaacacaaccagggccccggcacccacgaucauuacuaccuugcucauggcuuccgccgcgcuggccggcccuuuagagaaucgggaaacaaaccaucugcucaaucgaccaggcaacggggcauauacucuuucagacuuugcugagagcaccuguacacuggccuacggaagugaaugcaagucuugggagcacuugcuaaacgaggaacuguuccccuuuuuccacuccaaucucgauaaauauagcaugcuggaggcugccaccgaaacggucccuauccuuaacaagucgucugcaguguguacuaucuccccaucaacacacaguagcaaugccugcggucgcgaggcuuccgugauuaggaaaaaguguuacucuaacaugagcgcguuuuucuacauaaaucuggcaggccagaucaccgucguuaagugcgaaacuaaccauguguugucaagugacugugggaauugcauuuccaaaagccucucuggacaaaagguauauacacccgugcaggaugucuuuugccagaaaggcuggacccagucaaucccgaguacgagauacagcaaggacauauguuccauuggucugcacaccgugaaagagugcaagaucgggacaacuucuuucgagcggguuggauuuaucguggucaagggccgcaaaauguauauugaacaaaugaagaugagaucgaggcaggaguacagcgaagaucaguucuuauguuauaaauccgagucaggcagugggucuagcgugaagcugaaaaaguucaagguagaauccugcaaaggaguuaccacaucaagcgccucuaaguguuccggugacgaguacuuuugcagucguuauccuugugaggcugccaacguggaagcacauugcauccuacggcgacacagcgccauugucgaggugaaugucaacggcguguggguugugcccagauguauaggguacgaagagguacucgucaaaaggacuucucugaagguggaagauaccacagagcgcgagugcgacuccugucuuugggaaugcgggaaaaauaaguugaucguuaaaacccauggcccaaagguggucuacgcuacugccugcucacacgguaguuguaagagcgugaugcagaaaccugcaacguucguauaucugcccuacccagggaacucggagauugugggcggagauaucggcauccacaugacagaagaguccucucccagcaauauucaucucguugcgcacugcccugcucgggacucaugugacgucagugauugccuguuuugugugcaugggcuucugaacuaucaaugccacaccuuguucuccgcccuccugauaucuacuaccgugaugagcaucuuaacacugcuacuccugcuugucaagggagcaaaagacuugguuaagaaacuguuucacuggcucauuaccccacuguguugguuauccguguucugcuguuggauggugaagucauggaagagaaggguagguagcgccaucagucgcacuaaugauacaauuggcuggcgagagaaccggcgucaugcucaggacaucgaaagagcccagcacacgggaggagcaccgggcgcuaaauacucuuuuuauggugucaugauacuggggcuuuuguccagcgcccaaucgugcucagagucugugaucgcggauaguaagauuaugcaguguaccacuuccggcagcucuacacucugcaaagccagcggaaccguuaucaugaggcugggccccauuggguccgaaucaugccuaauccugaagggacucaaagacagugagaagcaguucauaagcauuaagacaaucucuuccgaacugacuugucgcgagggugagucauuuuggaccacgcuuuacaccccuauuugcuugaguagccggagaugucaucugaugggcgaaugcguguccgauagguguuuaaaauggaagacaaaccagacuucugcugaguucaccgggaaagcacacggagacgucaugcaugaaaaucgaugcuuugagcaaucgggcgguaucggguauggcuguuucaacgugaauccaagcugccucuacguucacucauaccugaaguccguguaucgcaacggauuuaaaguauuccggugugucgccuggaaucacagaauaaggcuugaagugacaacucauagucguaaguuccccauggugcugauggcuaugucuacccagccuacggauuggggcagcaucggguugauucucgacuccgagggaaucacaggcaccaacucauacucuuuuaugaagcacgguagcgggaguuucgccauuaucgaugacccauauucccccgagccgcgcaaaggauuucugggcgaaguccggugcccuacugaggaaacagcaaugagagcgagcccaucuuguaagauggcccccaaucuaauagaguaccagccugaaauggauaccgcugagugcacuaccaacaugauugaccccauggccaucuucaauagggguucacugccacagguucgagacggcaugacauuuacgcaauccaucgagaaaaacaccgugcaggcacucacuacaggggaaguaaaggcuaguauucggcugacccuugaugacuaugauguggucuaccagaauagccagucggacugcucugccacauucaaaaacuugacuggauguuauuccugcgaugagggcagccgccuguguuaccaagugaaggcagaaggggagaccaucuuucauuucauuaaugaggaagagucaauaaacguuaucaauaaagugaguccuggagucucugacuacugcacgguguuacacuuuuccagccccguuauuucaaucgaaggcacauaugauuguggucucaguaagagaccaauggugauuaaggggacccugaucgccacugcuccgcaugacgauaggaaacacgagggaggcagcucccuugucguaaacccuaaggguggcucuguggacuucuuuggguggcugagcggacuaaccuccuggcucggcgggccccugaaaacauucuugacuauacugggauuuuuagcgguuggccuccugcuuguggucaucauuaucauuaucauacggaccgguaugcagcaggcccugaagaaaaagauuaaguga

SEQ ID NO: 11430 - RNA, 4020 nt, Artificial Sequence
  derived and/or modified CDS sequence (opt3) from TOSV(H4906)__KU922125.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggauaaugucaccgagucuaucggucucacaucgggcacuugcaagguugggucacuggaaaaccgggauugucgcaaagacauuaugagcaauuauguggccgagguacacaguaaccuucauggacugggcgcgaugaugcacaauuacggugaugacaagcgaguggaaaucuugaacgaugucauacccgacgagcucaauccugggcaucacaacugcuccgaucuggaccguaaaccauucuggaccgaguuuaucaauguggcuaagccgcugucugaaauuguucccaugagcgugaucccuccacccgucgugaagccucagccacccgccgagccuuccucaaagaagcauguaccauucgauguucucuuaagugaagcagagaaagagcugaaccagacaaagauuagacuugaagacgagaggaaaagcaaugccgaagagaccgcuaaggaacgggcacgcaugaaggagaucgaggaugaauugagaagggagugggaacuggagcggaaacgcaaggacgccauggcugaugaccuagccaaagaaacugcgcgaagaagggagauagagcggaaggcacacgaacucgaccguaugcugaaaaagaaagagcgcgaaucucuuauugccaaggagaaggcugaugaagacaugagaucccacgugcauaaaccgaacacaaccagggcccccgcaccuacgaucauuacuacccuguugauggcuucagccgcgcucgccggaccacuggagaaucgggagacaaaccacuuacugaaucgacccggcaacggcgcauauacucucagcgauuuugcugaaaguaccuguacacuugccuacgggucugagugcaaguccugggaacaucuguugaacgaggagcuauucccauuuuuccacagcaaucuggacaaauauucgaugcucgaagcugccaccgagacggucccuauccugaacaagucuuccgcaguguguacuaucucacccaguacacacagcuccaaugccugcggacgcgaggcuucugugauuaggaaaaaguguuacagcaacaugucagcguuuuucuacauaaaucuugcaggucagaucaccgucguuaagugcgaaacuaaccaugugcugaguuccgauuguggcaauugcauuagcaaaucuuugucagggcaaaagguauauacaccggugcaggacgucuuuugccagaaaggauggacccagaguaucccuagcacgagauacuccaaggauauauguucuauuggccuccacaccgugaaagaaugcaagaucgguacaacuucguucgagcggguuggguuuaucguggucaagggacgcaaaauguauauugagcaaaugaagaugagaagcaggcaggaauacuccgaggaccaguuccuguguuauaaaucagaaaguggcucuggcagcuccgugaagcugaaaaaguucaagguagagucaugcaaagggguuaccacaagcucugccuccaaguguaguggagaugaauacuuuugcagccguuuccccugugagacugcuaacguggaggcccauugcaucuuacggcgacacucugcaauugucgaagugaaugucaacgguguguggguugugccaagauguauaggcuaugaggaagugcuagucaaaaggaccucccucaagguggaggacacaaccgaacgcgagugcgauucaugucugugggagugcgggaaaaauaaacuuaucguuaaaacucauggaccuaagguggucuacgccacggcuugcagucacggcagcuguaagucggugaugcagaaacccgccacauuuguauacuugccauaucccgguaacuccgaaauuguagggggcgacaucggaauccacaugaccgaggaaucuagcccuucaaauauucaucugguugcacacugcccagcgcgggacaguugugaugucuccgacugccucuucugugugcauggccugcuuaacuaccaaugccacacucuguuuucugcuuugcucauaagcaccacagugauguccauccugaccuuacugcuacuccuggucaagggggccaaagaucuuguuaagaaauuguuccacuggcugauuacuccgcucuguuggcugucaguguuuugcuguugggugguaaagagcuggaagagaagggucggaagugcaaucucucgcacaaaugacacgauugguuggcgagagaaccggcgucaugcccaggauaucgagagagcucaguauaccggcggggcccccggagcaaaauacuccuucuauggcgugaugauauuaggucugcuuagcucggcucaaucaugcucugaaaguguuaucgccgacuccaagauuaugcaguguacuacaagcgggucuagcaccuugugcaaagcguccggcacagugaucaugaggcucggaccuauuggcucagagaguugccugauccuaaaggggcugaaagauagcgaaaagcaguuuauaucuauuaagacuaucuccucagagcucaccugucgcgaaggagagaguuucuggacgacccuguacacaccaauuugccuuagcucccggagaugucacuugaugggugagugcgucucugacaggugucugaaauggaagacuaaccagaccucggccgaauuuacaggcaaagcucauggggaugugaugcacgagaaucgaugcuucgaacaaagcggaggcaucgguuauggguguuuuaacguuaaucccucaugcuuauacgugcauuccuaccucaagaguguauaucgcaacggcuucaaagucuuccgguguguggcauggaaucacagaauaaggcuggagaugacuacccacucucguaaguuuccuauggugcuuauggccaugagcacgcagccaacagacuggggauccaucggccugauuuuggauucagaagggaucaccggaacuaacucuuacagcuucaugaagcauggcagugguuccuuugcuauuaucgacgaucccuauagcccggagccucgcaaaggguuccucggagagguccggugcccaacagaagagaccgccaugagagcaucucccucauguaagauggcgccuaaucugauagaauaccagcccgagauggacacugccgaaugcaccacaaacaugauugacccaauggcuaucuuuaauaggggcucccuaccucagguucgagaugguaugacguucacccaaaguaucgagaaaaacacugugcaggcccugacaaccggcgagguaaaggcaagcauucggcucacacuggacgauuaugacguggucuaccaaaauucgcagucugauugcuccgcuacuuuuaaaaaccuuaccggguguuauagcugcgacgaaggaucacgcuuguguuaccaagugaaggccgagggcgaaacgaucuuccacuuuauuaaugaggaggaaaguauaaacguuaucaauaaagugaaccccggggucucugauuacugcacagugcugcauuucuccagaccaguuauuagcaucgagggaaccuaugacuguggcuuaucaaagaggccgauggugauuaaggguacucucaucgcaaccgccccucacgaugaccggaaacaugaagggggaaguagccuggucguaaaccccaagggcgguuccguggacuuuuucggcuggcuuucugggcugacaagcuggcuaggaggcccacucaaaacuuuucugaccauauugggguuccuggcuguuggauuacuccugguggucaucauuaucauuaucauacgaacaggcaugcagcaggcgcuuaagaaaaagauuaaguga

SEQ ID NO: 11431 - RNA, 4020 nt, Artificial Sequence
  derived and/or modified CDS sequence (opt3) from TOSV(MRS2010-4319501)__KC776215.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaaugucaccgagucuaucggucucauuucgggcacaugcaagguugggucacuggaaaaccgggauugucgcaaagacaucaugagcaauuauguggccgagguacacaguaaccuucauggacugggcgcgaugaugcacaauuacgcugaugacaagcgaguggaaauauugaacgaugucauccccgacgagcucaauccuggucaucacaacugcuccgaucuggaccguaaaccauucuggacugaguuuauuaauguggccaagccgcugucugaaaucguucccaugagcgugauuccuccacccgucgugaagcuccagccuccagcagagcccuccagcaaaaagcauguaccuuucgauguuuuacugagugaagccgagaaagagcuuaaccagaccaagaucagauuggaagacgagaggaaaagcaaugcugaagagacagcaaaggaacgggcccgcaugaaggagauagaggaugaacugagaagggagugggaacuagagcggaaacgcaaggacgcuauggccgaugaccucgcgaaagaaaccgcacgaagaagggagauugagcggaaggcccacgaacuggaccguaugcuuaaaaagaaagagcgcgaaucucugaucgcuaaggagaaggccgaugaagacaugagaucccacguguauaaaccaaacacuacaagggcaccggcucccaccauuaucacgacuuugcucauggccucagcggcccuggcagggccuuuagagaaucgggagaccaaccaucugcucaaucgaccaggaaacggcgcuuacacacuuagcgauuuugccgaaaguacuuguacccuggcuuauggcucugagugcaaguccugggaacacuugcuaaacgaggagcuguuccccuuuuuccauagcaaucucgacaaauacucgaugcuggaagccgcaacagagaccgucccuauccuuaacaagucuuccgccguguguacgauuucaccaaguacucacagcuccaaugcuugcgggcgcgaagcgucugugauaaggaaaaaguguuacagcaacaugucagcauuuuucuauaucaaucuggccggacagauuacagucguuaagugcgagaccaaccacguguugaguuccgauugugguaauugcaucagcaaaucucucucaggccaaaagguauacacucccgugcaggacgucuuuugccagaaaggguggacacagaguauaccgagcaccaaguauuccaaagauauuuguucuaucggacugcauacggugaaggaaugcaagaucggcauuaccucguucgagagaguugguuuuaucguggucaaagggcggaagauguacauugagcaaaugaaaaugcgcagcagacaggaauauuccgaggaccaguucuuauguuacaagucagaaaguucuagcggauccucagugaaacugaagaaguucaaaguagagagcugcaagggcguuacaacuucuuccgcuaguaaauguagcggcgaugaauauuuuugcucuagguacccuugugagaccgccaacguggaggcacacugcauacuacgucggcauuccgccaucgucgaagugaaugucaacgggguguggguugugccccgauguauuggauacgaggaaguacucgucaagagaacaucacugaaaguggaggacacuaccgguagggaaugcgauaguugucuuugggagugcggcaagaauaaauugaucguuaagacacacgggccaaagguggucuaugcuaccgccugcagccauggaucguguaaauccgugaugcagaagccugcaacuuucguauaccugcccuauccaggcaacucugagaucguggguggggacauuggcauacacaugacggaagagagcucacccaguaauauccaccucguugcgcauugcccugcucgcgacuccugugaugucucugacugccuguuuugugugcacggacuucugaacuaccaaugccauacauuguucagcgcccuccugauuuccaccacugugaugucaaucuuaacccugcuacuccugcuugucaaaggcgcaaaggauuugguuaaaaagcuguuucacuggcucauuacaccacuguguugguuaagcguguucugcuguugggugguaaagaguuggaaacggagagucgggucugccaucuccaggaccaaugacacuauaggauggcgcgaaaaccgacggcacgcucaggauaucgagcgugcccaguauacagguggcgcaccgggggcuaaguacagcuuuuauggagugaugauucugggccuuuugucgucagcccaaucuugcagugaguccguuaucgcggacagcaaaauuaugcaguguacgaccucugguagcuccacucucugcaaggccucagggacagugaucaugagagucggccccauaggaagugaaagcugccugauucuaaaaggccugaaggauucugagaagcaguucaucuccauuaaaaccaucucaagugaacucacauguagggagggggaaucauuuuggacuacccuguacacgccuauaugccuuuccucucgccggugucauuugaugggagagugcgugucggacagaugucugaaguggaaaaccaaccagacaagcgcugaguucacugguaaggcacacggcgauguuaugcaugaaaauaggugcuuugagcaaucagggggaaucggcuacgguuguuucaacgugaauccauccugcuuauauguacacaguuaccucaaaucugucuaucgaaacggguuuaagguguuccgcuguguggccuggaaucaucggauuagacuggaagucaccacacacagcaggaaguuccccaugguucuuauggcuauguccacucagccuaccgacuggggcucaaucggacugauuuuggauucugagggcgugacggggacaaacagcuacaguuuuaugaaacacggauccggcagcuucgccaucauagacgauccauauucucccgaaccgcguaaggguuuucucggggagguacgcugcccuaccgaggaaacugcaaugcgggcgucaccauccuguaaaauggcccccaaucugauugaguaccagccugaaauggacacagcugagugcaccacuaacaugaucgaccccauggccaucuucaauagaggaagucuaccacaggugagggauggcaugaccuuuacacaaagcauugaaaagaacacgguccaggcacugaccacuggugaggugaaggcuucgauccgacucacacuggacgauuaugacguuguguaccaaaauucucaguccgauugcagcgccaccuucaaaaaccuuacaggcuguuacucaugcgacgaggggagucgguuguguuaucaagucaaagcagaaggagagacuauuuuucauuucauaaaugaagaggagucuaucaacgugauuaauaagguuuccccuggcgugagcgauuacugcaccguccugcacuuuucacgccccguaaucaguauugaagggacguaugacuguggauuaagcaagagaccaauggugaucaaaggcacacucauagccaccgcuccgcaugaugacaggaagcacgaggguggguccucucugguugugaacccuaaaggaggcagcgucgauuucuuugguuggcuuuccggccugacuucauggcuagggggaccccucaagaccuuccugacaaucuugggcuuucuggcggugggguuacuccugguagugauuaucauuaucauaauucggacuggaaugcagcaggcccuuaaaaagaagaucaaauga

SEQ ID NO: 11432 - RNA, 4020 nt, Artificial Sequence
  derived and/or modified CDS sequence (opt3) from TOSV(Nice/113)__KU204982.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaaugucaccgagucuaucggucucacaucgggcacuugcaagguugggucacuggaaaaccgggauuguggaaaagacauuaugagcaauuauguggccgagguacacaguaaccuucauggccugggugcgaugaugcacaauuacggggaugacaagcgcguggaaaucuugaacgaugucauacccgacgagcucaauccuggacaucacaacugcuccgaucuggaccgaaaaccauucuggaccgaguuuaucaauguggcucguccgcugucugaaauugcccccaugagcguuaucccuccacccguggucaagcuccagccuccagcagagcccuccucaaagaaacaugugccuuucgauguauuacugagugaagccgagaaggagcuuaaccagacaaaaauuagauuggaagacgagaggaaaagcaaugcugaagagaccgcaaaggaacgggcccgcaugaaggagaucgaggaugaacugagaagggagugggaacuagagcggaagcgcaaagacgcuauggccgaugaccucgcgaaggaaacugcacgaagaagggagauagagcggaaagcccacgaacuggaccguaugcuuaagaaaaaggagcgcgaaucucugauugcuaaagagaaggccgaugaagacaugagaucccacguucauaagccaaacacaaccagggcaccggcucccacgaucauuacuaccuugcucauggccucagcggcccuggcaggcccuuuagagaaucgggagacaaaccaucugcucaaucgaccaggcaacggggcuuauacucuuagcgauuuugccgaaaguaccuguacacuggcuuacggaucugagugcaaauccugggaacacuugcuaaacgaggagcuguuccccuuuuuccacagcaaucucgacaaguauucgaugcuggaagccgcaaccgagacggugccuauccuuaacaaaucuuccgccgucuguacuaucucaccaaguacacacagcuccaaugcuugcggucgcgaagcgucugugauuagaaagaaauguuacagcaacaugucagcauuuuucuacauaaaucuggccggccagaucaccguggucaagugcgagacuaaccauguuuugaguuccgauugugggaauugcauuagcaagucucucucaggacaaaaaguguauacacccguacaggacguguuuugccagaagggcuggacccagaguaucccgagcacgagguacuccaaagauauauguucuauuggucugcacaccgucaaggaaugcaaaaucgggacaacuucguucgagcgggugggauuuaucguugugggcggccgcaagauguauauugagcaaaugaagaugagaagcaggcaggaauacuccgaggaccaguucuuauguuauaaaucagaaagugggucuggaagcuccgucaagcugaaaaaguucaaaguggagucaugcaaggguguaaccacaagcucugcuuccaaguguaguggcgaugaauacuuuugcagccguuauccuugugagacugccaacguugaggcacauugcauccuacggcgacacucugccauuguggaagucaaugugaacggggucugggugguucccagauguauaggauacgaggaagugcucguaaaaaggaccucccugaaggucgaggacacaaccgaacgcgagugcgauucaugucuuugggagugcggcaaaaauaaguugaucgugaaaacucaugguccaaagguuguguacgcuacggccugcagucacgggagcuguaaaucggucaugcagaagccugcaacauucguguaucugcccuacccaggcaacuccgaaauuguaggaggcgacaucgggauccacaugaccgaggaaucuagccccucaaauauucaucucguggcgcacugcccugcucgggacaguugugauguuuccgacugccuguuuuguguccauggacuucugaacuaucaaugccacacuuuguucucugcccuccugauaagcaccacagugauguccaucuuaacccugcuacuccugcuugugaagggugcaaaagauuuggucaagaaacuguuuuacuggcucauuacuccacuguguugguuaucaguuuucugcuguugggugaucaagagcuggaaaagaagggugggcagugccauuucucgcacaaaugacacgaucggguggcgagagaaccggcgucacgcucaggauauagagagagcccaguauaccggaggcgcaccgggugcuaaguacuccuuuuaugggguaaugauccugggccuuuugagcucggcccaaucaugcucugaaagugucauugcggacuccaagaucaugcaguguacuacaagcggaucuagcacccucugcaaagccuccggcacagugauuaugaggcuggggcccaucggaucagagaguugccuaauacugaagggucucaaagauagcgaaaagcaguucauuucuaucaaaacuauuuccucagagcugaccugucgcgaaggcgagaguuuuuggacgacccuuuacacaccuaucugcuugagcucccggagaugucaucugaugggggagugcguuucugacagguguuuaaaguggaagacuaaccagaccucggcugaguucacaggaaaagcacacggcgaugugaugcaugaaaaucgaugcuuugaacaaagcggugggauaggcuacggauguuucaacgucaauccaucaugccucuaugugcacuccuaccugaagaguguuuaucgcaacggcuuuaaaguguuccgguguguagccuggaaucauagaaucaggcuugaggucacuacccacucucguaaguuccccauggugcugauggcuaugagcacgcagccuacagacuggggguccauuggauugauccucgauucagaaggcauuaccgguacuaacucuuacagcuuuaugaaacacgggaguggauccuucgccaucauagacgauccauauagccccgagccgcgcaagggcuuucugggugaggugcggugcccuacagaagagaccgcaaugagagcgucuccaucauguaagauggcccccaaucuaauugaauaccagccugagauggacacugcugaaugcaccacaaacaugaucgaccccauggccaucuucaauaggggcucccugccacagguccgagaugggaugacguuuacccaaaguauugagaaaaacacuguucaggcacucacaaccggagaggugaaggcuagcauccggcugacacuugacgauuaugacguaguguaccaaaauucgcagucugauugcuccgccacuuucaaaaacuugaccggcuguuacagcugcgacgaagggucacgccuguguuaucaagucaaggcagagggagaaacgauuuuucauuucauaaaugaggaggaaaguaucaacgugauuaauaaaguuucuccugagguguccaacuacugcacagucuuacacuuuagcagacccgugaucucaauugaaggcaccuaugauuguggucucaguaagaggccaaugguuaucaaagggacucugauagccaccgcuccgcaugacgaucggaagcacgagggaggcagcucccuuguggucaacccuaaggguggcucuguagacuucuuuggguggcugagcggacuaacauccuggcucggcgggccccugaaaacuuucuugaccauccugggauuuuuagcggugggccuccugcuuguugugauuaucauuaucauaauucgaacagguaugcagcaggcccugaagaaaaagaucaaauga

SEQ ID NO: 11433 - RNA, 4020 nt, Artificial Sequence
  derived and/or modified CDS sequence (opt3) from TOSV(P233)__KU204976.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaaugucaccgagucuaucggucucacaucgggcacuugcaagguugggucacuggaaaaccgggauugucgcaaagacauuaugagcaauuauguggccgagguacacaguaaccuucauggacugggcgcgaugaugcacaauuacggugaugacaagcgaguggaaaucuugaacgaugucauacccgacgagcucaauccugggcaucacaacugcuccgaucuggaccguaaaccauucuggaccgaguuuaucaauguggcuaagccgcugucugaaauuguucccaugagcgugaucccuccacccgucgugaagccucagccacccgccgagccuuccucaaagaagcauguaccauucgauguucucuuaagugaagcagagaaagagcugaaccagacaaagauuagacuugaagacgagaggaaaagcaaugccgaagagaccgcuaaggaacgggcacgcaugaaggagaucgaggaugaauugagaagggagugggaacuggagcggaaacgcaaggacgccauggcugaugaccuagccaaagaaacugcgcgaagaagggagauagagcggaaggcacacgaacucgacaaaaugcugaagaaaaaggagcgugaaucucuuauugccaaggagaaagcugaugaagacaugcgcucccacgugcauaagccgaacacaaccagagcccccgcaccuacgaucauuacuacccuguugauggcuucagccgcgcucgccggaccacuggagaauagggagacaaaccacuuacugaaucggcccggcaacggcgcauauacucucagcgauuuugcugaaaguaccuguacacuugccuacgggucugagugcaaauccugggaacaucuguugaacgaggagcuauucccauuuuuccacagcaaucuggacaaguauucgaugcucgaagcugccaccgagacggucccuauccugaacaaaucuuccgcaguguguacuaucucacccaguacacacagcuccaaugccugcggacgagaggcuucugugauucgcaagaaguguuacagcaacaugucagcguuuuucuacauaaaucuugcaggucagaucaccgucauuaaaugcgaaacuaaccauguucugaguuccgauuguggcaauugcaucagcaagucuuugucagggcaaaaaguguauacaccgguacaggacguguuuugccagaagggauggacccagaguauaccuagcacgagauacuccaaagauauuuguucuaucggccuccacaccgucaaggaaugcaagaucgguacaacuucguucgagagggugggguuuauuguugugaaaggacggaagauguauaucgagcaaaugaaaaugcgcagcagacaggaauacuccgaggaccaguuccuguguuauaagucagaaaguggcucuggcagcuccgucaaauuaaagaaguucaaagugaagucaugcaaagggguaaccacaagcucugccuccaaguguaguggagaugaguacuuuugcagcagguaucccugugaaacugcuaacguugaggcccauugcauucugcgucggcacucugcaauaguggaggucaaugugaacggugucugggugguuccacgauguaucggcuacgaagaggugcuaguaaaaagaaccucccucaaggucgaagacacaaccgggagggagugcgauucaugucugugggaaugcggcaaaaauaaacuuauugugaagacucauggaccuaaaguuguguacgccacggcuugcagucacgguagcuguaagucggucaugcagaaacccgccacauucguguauuugccauaccccgggaacuccgagaucguaggcggagacaucggcauucacaugaccgaggaaucuagcccuucaaauauacaucugguggcacacugcccagcgcgcgacaguugugauguuuccgacugccucuuuuguguccaugggcugcuuaacuaucaaugccacacucuguucucugcuuugcucaucagcaccacagugauguccauucugaccuuacugcuacuccuggugaagggagccaaagaucuugucaagaaguuguuucacuggcugaucacuccgcucuguuggcugucaguuuucugcuguuggguggugaaaagcuggaagcggagaguagguagugcaauuucuaggacaaaugacacgaucggcuggcgcgagaaccgacggcaugcccaggauauagaacgugcucaguacaccgggggagcccccggcgcaaaauauuccuuuuacggugucaugaucuuagggcugcuuagcucggcucaaucaugcucugagagugugauugccgacuccaagaucaugcaguguacuacaagcggcucuagcaccuugugcaaagcguccggaacaguuauuaugagacucggcccuaucgggucagagaguugccugauacuaaagggacugaaggauagcgaaaaacaguucauuucuaucaagacuauuuccucagagcucaccuguagggaaggugagaguuuuuggacgacccuguauacaccaaucugccuuagcucccgccggugucacuugaugggcgaaugcgugucugacagaugucugaaauggaagacuaaccagaccucggccgaguucacagggaaagcucauggagaugucaugcacgagaauaggugcuuugaacaaagcggcgguauaggguacggcuguuucaacgugaaucccucaugcuuauacguucauuccuaucucaagaguguguaccgaaacggauuuaagguauuccgcugugucgcauggaaucaccggaucagacuggaggugacuacccacucuaggaaauucccuauggugcuuauggccaugagcacgcagccaacagacuggggcuccauugggcugaucuuggauucagaaggaauuaccggcacuaacucuuauagcuuuaugaagcaugguaguggguccuucgcuaucauagacgaucccuacagcccggagccucguaaaggauuucucggcgaaguccgcugcccaacagaggagaccgccaugcgggcaucucccucauguaagauggcgccuaaucugauugaauaucagcccgagauggacacugccgaaugcaccacaaacaugaucgacccaauggcuaucuucaauagagguucccuaccucagguuagggauggcaugacguuuacccaaaguauugagaaaaacacugugcaggcccugacaaccggggaaguaaaggcaagcauccgacucacacuggacgauuacgacguggucuaucaaaauucgcagucugauugcuccgcuacuuucaaaaaccuuaccggauguuacagcugcgacgagggcucacgguuguguuaccaagugaaggccgagggggaaacgauuuuucacuucauaaaugaggaagagaguaucaacguuauuaauaaggugucucccggagucuccgauuauugcacagugcugcauuuuagccgcccaguuaucucaauugagggcaccuacgacugugguuuaaguaaaagaccgauggugaucaaggggacucucauagcaaccgccccucacgaugacaggaaacaugaaggaggcagcucccuggucguaaaccccaaggguggcucuguggauuucuuuggguggcuuagcggacugacauccuggcuaggcgggccacucaaaacuuuccugaccaucuugggauuucuggcuguuggcuuacuccugguggucauuaucauuaucauaauucggacagguaugcagcaggcgcuuaagaagaaaaucaaguga

SEQ ID NO: 11434 - RNA, 4020 nt, Artificial Sequence
  derived and/or modified CDS sequence (opt3) from TOSV(T152)__JX867535.1__GP
auguucaucgccaagcugcuccuuauuagcugccuggugcagcaggcuuacuugaaauauaccauaaucuccgagauuggcaacgggacaagaacuucuucauguuacaguagcaggacguccuuaggaucucugcuagaagcaugggacaauaucaccgagucgauuggucucacaucaggcacuugcaaggucgggagccuggaaaaccgggauuguaaacgcgacaucaugaguaauuauguugccgaggugcacuccaaccuucauggacugggcgcgaugaugcacaauuacggugaugacaagcgaguagaaguguugaacgaugucauacccgacgagcucaauccugggcgucauaacugcucugaucuggacagaaaaccauuuuggaccgaguucaucaauguggcuaagccgacaaacaagauugcccccaucagcguuauuccuccacccaucgugaaaccuauaccaauugcagaacccaccacuaagaaaaauaucccuuuugauaagcugcucuccgaggccgaaaaagaguuaaaccaaacaaagauuaggcuggagaccgaacggcgcucaaaugcugaggaagcagccaaggagagagcuaggaugcgggaaaucgaggacaaacuucgcaaggauugggaguuggaacgagagagaaaagacgccgucgcggaugaccuggcaaaggaaaucgccaggcggcgugagauugaacgcaaagcucacgagcuagacaagaugcucaaaaagaaggagagagaagaucugguggccauagagaaaguaagugaagacaugaggaaccauguucggcgaccaaauacgacuaucgcaccggcucccaccauuaucacaacucuucuguuggccagcgcggugauggccggaccucucgagaaccgcgaaaccaaccaccuguuaaauagaccaggcaacggcgcauauacacugucugauuucgcugaguccaccuguacgcucgccuacgggucagagugcaagagcugggaacaccagcuugacgagcugaguuuucccuucuuucauucuaauuuggauaaauauuccaugcuagaagcugccacugagacaauaccuauucugaacaagagcucggcagucuguaccaucucuccauccacucacucaaguaaugccugcggaagggaggcuagccucaucaaaaagaagugugguuccaacaugucugcguucuuuuacgugaaucuggcaggccagauuacaguggucaaaugcgacaccaaccauguucuuagcaaugauugugggaacugcaucucaaagacgcugaguggacagaaaauuuacacccccgugcaagacauguucugccagaagggcuggacagaauccauaccgagcacucgguauucuaaagauuuguguucaaucggucuccacaccguaaaggagugcaagacagggacuaccaauuuugaacgcgugggauucauugucguggagaguagaaaaauguacaucgaacagaugaagaugaggagccgucaagaguuuuccgaggaccaguuccuguguuauaaaucugaaucgagcuccggcucaaguguuaaguuaaagaaagugaaggucgagucuugcaaaggcgugacaaccagcuccgccucaaaguguagcggggaugaauacuucugcucucgguauccuugugagacugcuaacguagaagcccacugcauccugcgaagacauuccgcaguuauugaggugaaugucaacggagugugggucgugcccagguguauagguuacgaggaaguucuagugcgccggacgagucucaaaguagaggacacaagcucuagagaaugcgacaccugucugugggagugcggcaagaauaaacuuaucgucaagacucacgggccaaaaauuguguaugccaccgcuugcucccauggaucauguaagaguguuaugcagaagccugccacauuuguguucuugcccuacccaggcaacagcgaaaucgucgguggggauauuggcgugcacaugaccgaggagucgucccccucuaacauccauaugguagcacacugcccugcgaaagacagcugugaagugucaaguugccuguuuuguguucacggacuccugaauuaccagugccauacucuuuucuccgcucuguugauaucuacaacggucaugagcauccucacccuguuacugcuacucgugaagggcgccaaagaucuggugaagagguuguuuuauuggcuuauuacuccacuguguuggcucuccgucuucugcucauggaugaucaaaagcuggcgcaagcgaguugggagugcaauuucucggacaaacgacaccaucggauggcgugauaauagaagguacggucaagacguggagcgcgcccaguauacaggcggggcuccgggaacuaaguacuccuuuuauggcgugaugauacuggguuuacuggggaacguacacagcuguucggaaucagucauugccgauucuaaagugaugcagugcaccacgaguggcuccagcacccuuuguaaggcaucuggaacaguuaucaugaaauugggccccauugggagcgaguccugccucauccugaagggacuaaaagacucagagaagcaauucauaaguaucaagacuauuagcucugaacugaccugccgggagggugaauccuuuuggacaacucucuacaccccugugugucugucaaguagaaggugccaucuuaugggcgagugugucagcgaucgaugcuugaaauggaagacgaaugaaacauccgcugaguucaccgggaaagcccacggagaggugaugcacgaaaacaaguguuuugagcagucuggcgguaucggguauggcugcuucaauguuaacccaucgugucuguacgugcauagcuacuuaaaaucaguauauaagaauggauuuaagauuuuccgcugcgucgcguggaaccaccggaucagacucgaagugacuacacauuccaggaaauuccccauggugcugauggccaugaguacccagccuacugacuggggcucuauagggcuuauucuggauagcgagggaaucaccggcacaaaugcuuacuccuuuaugaagcacgguucagggucuuucgcaaucauugacgauccauauagccccgaaccgcguaaaggauuuuugggcgagguccgcuguccuacggaggaaaccgccauccgggcuaguccauccugcaagauggcccccaaccucauugaguaccagccugaaauggacacugcagaguguacaaccaauaugauagaccccauggcgaucuucaacagagguagccugccacaaguuagggauggcaugacauuuacucagucuauugagaaaaauaccgugcaggcccuaacgacaggggaaguacgagcuucaauccggcugacccucgacgauuaugacguggucuaccagaacucccaaagugauugcagcgccacuuucaagaaccugaccggaugcuauucgugugacgagggcucucgcaugugcuaccaggugaaagcagaaggggagacaauuuuucauuucguuaaugaagaugaguccaucaacgugauaaauaaggucagcccugacgugucagauuacuguacuguucuucacuuuaguagacccgugaucucuauugagggaagguaugacugcggcuuguccaagcggccaauggucaucaaagguacccugauugcuacagccccgcacgaugaccgaaagcaugaagggggaagcucauuaguagugaacccuaaaggcgguacgguugauuucuuuggcugggugagugggcucaccagcuggcugggaggcccccuuaagacuuuccugacaauccuaggguuucucgcacugggauugcuguuagucgugguaauaauuaucaucgccagaaccggcgugcagcaggcucucaaaaagaagaauaaauga

SEQ ID NO: 11435 - RNA, 4020 nt, Artificial Sequence
  derived and/or modified CDS sequence (opt3) from TOSV(TOSV/P51)__KU204979.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaaugucaccgagucuaucggucucacaucgggcacuugcaagguugggucacuggaaaaccgggauugucgcaaagacauuaugagcaauuauguggccgagguacacaguaaccuucauggacugggcgcgaugaugcacaauuacggugaugacaagcgaguggaaaucuugaacgaugucauacccgacgagcucaauccugggcaucacaacugcuccgaucuggaccguaaaccauucuggaccgaguuuaucaauguggcuaagccgcugucugaaauuguucccaugagcgugaucccuccacccgucgugaagcuccaaccuccagccgagcccuccaguaaaaagcauguaccuuucgauguuuuacugucagaagcagagaaagagcuuaaccagacaaagauuagauuggaagacgagaggaaaagcaaugccgaagagaccgcuaaggaacgggcacgcaugaaggagaucgaggaugaacugagaagggagugggaacuagagcggaaacgcaaggacgccauggcugaugaccucgccaaagaaacugcgcgaagaagggagauagaccggaaggcacacgagcuggaucguaugcuuaaaaagaaagaacgcgagucucugauugccaaggaaaaggcugacgagaacaugagaucccacgugcaugaaccaaauacaaccagggccccggcacccacgaucauuacuaccuugcucauggcuucagccgcgcuggccggaccuuuagagaaccgggagacaaaucaucugcucaaccgaccaggcaacggcgcauauacucuuagcgauuuugcugaaaguaccuguacacuggccuacgggucugagugcaaauccugggaacacuugcuaaaugaggagcuguuccccuuuuuccacagcaaccucgacaaguauucgaugcuggaagcugccaccgagacggucccuauccuuaauaaaucuuccgcaguguguacuaucucaccaaguacacacagcuccaacgccugcggacgcgaggcuucugugauuagaaagaaauguuacagcaauaugucagcguuuuucuacauaaaccuggcaggucagaucaccgucguuaagugcgagacuaaucauguguugaguuccgauuguggcaacugcauuagcaagucucucucagggcaaaaaguauauacacccgugcaggacgucuuuugccagaagggauggacccagaguaucccgagcacgagguacuccaaagauauauguucuauuggccugcacaccgugaaggaaugcaaaaucgguacaacuucguucgagcggguuggguuuaucguggucaagggacgcaagauguauauugagcaaaugaaaaugagaagcaggcaggaauacuccgaggaccaguucuuauguuauaagucagaaaguggcucuggcagcuccgugaaacugaagaaauucaagguagagucaugcaaggggguuaccacaagcucugccuccaaauguaguggagaugaauacuuuugcagccguuauccuugugagacugcuaauguggaggcccauugcauccuacggcgacacucugcaauugucgaagugaacgucaaugguguguggguugugcccagauguauaggcuacgaggaaguacucgucaagaggaccucccugaaaguggaggacacaaccgggcgcgaaugcgauucaugucuuugggagugcggaaagaacaaauugaucguuaagacucauggcccaaaaguggucuacgccacggcuugcagucacgguagcuguaagucggugaugcagaagccugccacauucguauaucugcccuacccagggaacuccgagauugugggcggagacaucggcauccacaugaccgaagagucuagccccucaaauauucaucucguugcacacugcccugcgcgggacaguugugaugucuccgacugccuguuuugugugcaugggcuucugaauuaucaaugccacacuuuguucucugcucuccugauaagcaccacagugauguccaucuuaacccugcuacuccugcuugucaaaggagccaaggauuugguuaaaaagcuguuuuacuggcucauuacuccacuguguugguuaucaguguucugcuguugggugguaaaaagcuggaagagaagggucgguagugcaaucucucgcacaaacgacacgauuggcuggcgagaaaaccggcgucacgcccaggauaucgagagagcucaguauaccgggggagccccgggcgcaaaguacuccuuuuauggugugaugauacuggggcuuuugagcucggcucaaucaugcucugagaguguuaucgccgacuccaaaauuaugcaguguacuacaagcggcucuagcacccucugcaaggcguccggaacagugaucaugaggcugggccccauugggucagaaaguugccuaauccugaaaggacucaaggauagcgagaaacaguucauaucuauuaagacuaucuccucagaacugaccugucgcgagggugaaaguuuuuggacgacccuuuacacaccuauuugcuugagcucccggagaugucaucugaugggcgagugcgucucugacagguguuuaaaguggaaaacuaaucagaccucggccgaguucacagggaaggcucacggagaugugaugcaugaaaaccgaugcuuugagcaaagcggcgguaucggguacggcuguuucaauguuaacccaucaugccucuaugugcacuccuaccugaaaaguguauaucgcaauggauuuaaggucuuccgguguguggcauggaaccauagaauaaggcuugaagugacuacccacucucguaaauuccccaugguccugauggccaugagcacgcagccuacagacuggggcuccaucggguugauucucgauucagagggaaucaccggcacuaauucuuacagcuuuaugaagcacgguaguggguccuucgcuauuaucgacgauccauauagccccgaaccgcgcaagggauuucugggcgagguucggugcccuacagaggaaaccgccaugagagcaucuccaucauguaaaauggcgcccaaccuaguggaguaccagccugaaauggacacugccgagugcaccacaaauaugauagaccccauggcuauuuucaacagggguucccugccacagguacgagauggcaugacguuuacccaaaguaucgaaaagaauacugugcaggcccucacaaccggggaggucaaagcaagcauccggcugacacuugacgauuaugacgugguuuaccagaacucgcagucugauugcuccgcuacuuucaagaauuugaccggauguuacagcugcgacgagggcucacgccuguguuaucaagugaaagccgaaggggagacgauuuuucauuucaucaacgaagaggagaguauuaaugucauaaacaaggugucuccuagaguuuccgauuacugcacaguguuacacuuuagcaggcccgucaucucaauugaaggaaccuaugacuguggccucaguaaacggccaaugguaaucaaggguacucugauugcaaccgccccgcaugaugaccgaaagcacgaagggggaagcucccuugugguuaacccuaaaggcgguucuguggauuucuuuggcuggcugagcgggcuaacauccuggcucggaggcccccugaagacuuucuugaccauccugggguuuuuagcugucggacuccugcuugugguaauaaucauuaucauuaucagaacaggcaugcagcaggcgcugaaaaagaaaauaaaguga

SEQ ID NO: 11436 - RNA, 4020 nt, Artificial Sequence
  derived and/or modified CDS sequence (opt3) from TOSV(TOSV_Italy/BB8/2014/human)__KY626661.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaauaucaccgagucuauuggucucacaucgggcacuugcaaggucgggucacuggaaaaccgggauuguaaacgcgacaucaugagcaauuauguugccgaggugcacaguaaccuucauggacugggcgcgaugaugcacaauuacggugaugacaagcgaguagaaguguugaacgaugucauacccgacgagcucaauccugggcgucauaacugcuccgaucuggacagaaaaccauucuggaccgaguuuaucgauguggcuaagccgacaaauaagauugcccccaugucuguuaucccuccacccauugugaaaccuaucccagucgcagaaagcaccauaaagaaauccauucccuucgacaagcugcucucagaggccgaaaaagaguuaaaccaaacuaagaucaggcuggagacagaacggcgcaguaaugcugaggaagcagccaaggagagagcuaggaugcgggaaauugaggauaaacuucgcaaggacugggaguuggaacgagagagaaaagaugccguggcggacgaccuggcaaaggaaaucgccaggcggcgugagaucgaacgcaaagcucacgagcuagauaagaugcucaaaaagaaggagagagaagaccugguagccagggagcggguuagcgaagauaugcgaaaccauguguguaaaccuaauaccacgauugcaccagcuccgacuauaaucaccacacuucugauggccucugcggucauggccggacccuuggagaaccgcgaaacuaaucaccuccugaacagaccuggcaacggcgcauauaccuuauccgacuuugcugagucaacaugcacccuggccuacgggagcgaguguaagaguugggaacaccagcucgaugagcuuucuuucccauuuuuccauuccaaucuggacaaauauagcauguuggaagcugccacggagacuauucccauccuaaacaagucgucugcagugugcacaauauccccuucaacccacaguagcaaugccuguggaagggaggcuucccugauuaaaaagaagugcgguucuaacaugagcgcguuuuucuacgugaaucucgcaggccagaucacugucguuaaaugugauacaaaccaugugcugucaaaugacugcgggaacugcaucaguaagacccuuuccggacaaaagauuuacacgccaguacaggauauguuuugucagaagggcuggaccgaaagcauccccaauacacgguauucuaaagaccugugcucaauugguuugcacagugugaaggaguguaagacugggaccacaaacuucgaacgcgucggauuuauagugguuaaaggcagaaagauguacaucgagcagaugaaaaugaggagccgucaagaguucuccgaagaucaguuccucugcuauaagucugagucgagcuccggcucaagugugaaacugaagaaggucaaaguggaaucuuguaaggggguaacuaccagcuccgccucaaaaugcagcggagacgaguacuuuuguucucgguauccgugcgaaacagcuaauguugaggcccacuguauuuuacgaagacauuccgcagugaucgaagucaacgugaauggugucuggaucgugccuaggugcauuggcuacgaggagguucuggugcgccggaccagucuaaagguagaagacacuagcucuagagagugugauacgugccucugggaaugcgggaaagacaagcugauagucaaaacacacggacccaagaucguguaugccaccgcuuguucccauggcucaugcaagaguguuaugcagaaaccagccacuuucguguaccuuccuuaccccgguaacagcgagauugucgggggcgauaucggagugcacaugaccgaagagucguccccaucuaauauucauaugguagcacacugucccgcgaaggacagcugcgaggugucaaguuguuuguuuugcguucacggccugcucaacuaucagugucauacacuguucuccgcuuuacugaucucuaccacugucaugagcauauugacacuccuguuacugcuaaugaaaggggccaaggaucucgugaaaaggcuguuuuacuggcuuaucacgccuuugugcuggcuguccguguucuguggaugggucauuaagucauggaagaaacgcguugguagcgcaaucagucgaaccaacgacacuauuggcuggcgggauaaucguagauauaggcaagacguggaacgcgcccaguacacagggggagcuccaggcgccaaguauucuuuuuacggugugaugguacucgggcuguuaggcaacguccacuccugcagcgagucggugaucgcagauucaaaaauaaugcaguguaccacaucuggaaguuccacucugugcaaggcuagcggcaccguuauuaugaaacuugggccgaucggaucugaaagcugcuugauucucaagggucugaaggacuccgagaaacaauucaucucaauaaagacgaucaguagcgagcuaaccugucgggaaggcgagucuuuuuggacaacucuguauacccccgugugccucuccucaagaaggugucaucugaugggggaaugcgucagugaucgaugucuuaaauggaagacaaaugagacuagcgccgaguucaccggaaaagcgcacggcgaagugaugcacgagaaccgcugcuuugaacaguccggugggauuggcuacggauguuucaauguuaacccuucuugcuuguacgugcauucguaucugaaaagcguauacaagaauggcuuuaaaacguuccggugugucgccuggaaccacagaaucagguuagaggugacaacccauucacguaaguucccaauggugcucauggcuauguccacucagcccacagacugggggaguauuggacugauccuugauucugaaggcauaaccgguacuaaugcauauagcuuuaugcgccacggguccggaucauucgccauuaucgacgacccuuacucuccagagccccggaaaggcuuucugggugaagucagaugcccgaccgaggagacagcuaucagggccagcccuaguuguaagauggcaccaaacuugauugaauaucagcccgagauggauacggcggaaugcaccacuaauaugaucgacccuauggccauuuucaaccgaggcucccucccccaaguucgggaugggaugacauuuacccagagcauagagaaaaauacagugcaggcucugacuaccggagaaguacgcgccucuaucagacuaacgcuggacgauuacgacguggucuaucagaacucacaauccgauugcagugcaacauucaagaaucucaccggcuguuacagcugcgacgaggggucgaggauguguuaccaggugaaagcugagggagaaacuauuuuucauuucaucaacgaggaugaaucuauuaacguuaucuccaaggugaauccagacgucagcgauuauugcaccgugcugcacuuuucacggccuguuauaaguaucgagggccgauacgacuguggucuuucuaagagacccauggugauuaaagggacauugaucgccacugcaccacacgaugaccgcaagcaugagggaggcuccagccugauugucaacccgaaagguggcaccguagacuucuuugggugggugucaggauuaacaaguuggcucggcgggccucugaagacguuccuuaccauccugggauuucuagcccucggccuguugcugguugugauaauuaucaucauugcuaggacugguguccagcaggcgcuuaaaaagaagaauaaauga

SEQ ID NO: 11437 - RNA, 4020 nt, Artificial Sequence
  derived and/or modified CDS sequence (opt3) from TOSV(TOSV-54441132704)__KX010933.1__GP
auguucaucgccaagcugcuccuuauuagcugccuggugcagcaggcuuacuugaaauauaccauaaucuccgagauuggcaacgggacaagaacuucuuuuuguuacucaaguaggacgagcuuaggaucccugcuagaagcaugggacaaugucaccgagucuaucggucucacaucgggcacuugcaagguugggucacuggaaaaccgggauugucgcaaagacauuaugagcaauuauguggccgagguacacaguaaccuucauggacugggcgcgaugaugcacaauuacggugaugacaagcgaguggaaaucuugaacgaugucauacccgacgagcucaauccugggcaucacaacugcuccgaucuggaccguaaaccauucuggaccgaguuuaucaauguggcuaagccgcugucugaaauuguucccaugagcgugaucccuccacccgucgugaagcuccagccuccagccgagcccuccaguaaaaagcauguaccuuucgauguuuuacugucagaagcagagaaagagcuuaaccagacaaagauuagauuggaagacgagaggaaaagcaaugccgaagagaccgcuaaggaacgggcacgcaugaaggagaucgaggaugaacugagaagggagugggaacuagagcggaaacgcaaggacgccauggcugaugaccucgccaaagaaacugcgcgaagaagggagauagagcggaaggcacacgaacuggacaaaaugcuuaagaaaaaggagcguaagucucugauugccaaagaaaaggcugauguggacaugcgcucccacguccauaaaccaaacacaaccagagccccggcacccacgaucauuacuaccuugcucauggcuucagccgcgcuggccggaccuuuagagaauagggaaacaaaccaucugcucaaucggccaggcaacggcgcauauacucuuagcgauuuugcugagaguaccuguacacuggccuacgggucugagugcaaguccugggaacacuugcuaaacgaggaacuguuccccuuuuuccacagcaaucucgacaaauauucgaugcuggaggcugccaccgagacggugccuauccuuaacaagucuuccgcaguguguacuaucucaccaaguacacacagcuccaaugccugcggacgagaggcuucugucauucgcaagaaauguuacagcaacaugucagcguuuuucuacauaaaucuggcaggucagaucaccguuauuaagugcgaaacuaaccauguguugaguuccgauuguggcaauugcaucagcaaaucucucucagggcaaaagguauauacacccgugcaggacgucuuuugccagaaaggauggacccagaguauaccgagcacgagauacuccaaggauauuuguucuaucggccugcacaccgugaaggaaugcaaaaucgguacaacuucguucgagaggguuggguuuauuguggucaagggacggaaaauguauaucgaacaaaugaagaugcgcagcagacaggaguacuccgaggaccaguucuuauguuauaaaucagaaaguggcucuggcagcuccgugaagcugaagaaauucaagguagagucaugcaaagggguuaccacaagcucugccuccaaguguaguggagaugaauacuuuugcagcagguauccuugugagacugcuaacguggaagcccauugcauucuacgucggcacucugcaauagucgaggugaaugucaacgguguguggguugugccccgauguaucggcuacgaggaaguacucgucaaaagaaccucccugaagguggaggacacaaccgggagggaaugcgauucaugucuuugggagugcggcaaaaauaaguugauuguuaagacucauggaccaaaaguggucuacgccacggcuugcagucacgguagcuguaagucggugaugcagaaaccugccacauucguauaucugcccuacccagggaacuccgaaaucgugggcggagacaucggcauucacaugaccgaggagucuagccccucaaauauacaucucguugcacacugcccugcgcgcgacaguugugaugucuccgacugccuguuuugugugcaugggcuucugaacuaucaaugccacacuuuguucucugcucuccugaucagcaccacagugauguccauuuuaacccugcuacuccugcuugucaagggagccaaagauuugguuaagaagcuguuuuacuggcucaucacuccacuguguugguuaucaguguucugcuguugggugguaaaaagcuggaagcggagagucgguagugcaauuucuaggacaaaugacacgaucggcuggcgcgaaaaccgacggcacgcccaggauauagagcgugcucaguauaccgggggagccccgggcgcaaaauacuccuuuuauggugugaugauccuggggcuuuugagcucggcucaaucaugcucugaaaguguuauugccgacuccaagaucaugcaguguacuacaagcggcucuagcacccucugcaaagcguccggaacagugauuaugagacugggccccaucgggucagagaguugccuaauacugaagggacucaaggauagcgagaaacaguucauuucuaucaagacuauuuccucagaacugaccuguagggagggugaaaguuuuuggacgacccuuuacacaccuaucugcuugagcucccgccggugucaucugaugggcgagugcgucucugacagauguuuaaaauggaagacuaaccagaccucggccgaguucacagggaaagcucacggagaugugaugcaugaaaauaggugcuuugagcaaagcggcgguauaggguacggcuguuucaacguuaauccaucaugccucuaugugcacuccuaccugaagaguguauaucgaaacggauuuaaggucuuccgcuguguggcauggaaucaucggaucagacuugaagugacuacccacucuaggaaauuccccaugguccugauggccaugagcacgcagccuacagacuggggcuccauuggguugauccucgauucagagggaauuaccggcacuaacucuuacagcuuuaugaagcacgguaguggguccuucgcuaucauagacgauccauauagccccgaaccgcguaaaggauuucugggcgagguucgcugcccuacagaagagaccgccaugcgggcaucuccaucauguaagauggcgcccaaucuaauugaguaccagccugaaauggacacugccgagugcaccacaaacaugaucgaccccauggcuaucuucaauagagguucccugccacaggugagggauggcaugacguuuacccaaaguauugagaaaaacacuguacaggcccucacaaccggggaagugaaggcaagcauccgacugauucuugacgauuaugacgucguguaccaaaauucgcagucugauugcuccgcuacauucaaaaacuugacuggauguuacagcugcgacgaaggcucacggcuguguuaucaaguuaaggccgagggggagaccauauuucauuucaucaaugaagaggaaaguauuaacgugaucaauaaggucucuccuggaguguccgauuacugcacgguuuuacacuuuagccgccccgugauuucaaucgagggcacauaugacuguggucucaguaaaagaccaauggucauaaaggggacccugaucgcaacugccccgcaugaugacaggaaacacgagggaggcagcucccuuguagugaacccuaaggguggcucuguugauuucuuuggguggcugagcggacuaaccuccuggcucggcgggccccugaaaacauucuugacuauucugggauuuuuagcugugggccuccugcuugucgugaucauuaucauaauuauccggaccgguaugcagcaggcgcugaagaagaaaaucaaguga

SEQ ID NO: 11438 - RNA, 3222 nt, Artificial Sequence
  derived and/or modified CDS sequence (opt3) from SFTSV(HB29)__NC_018138.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauguugccuggauggacgugggccacagucauaagaucauuaugcgggagcacaaaacaaaguggguccaggaaagcuccucuaaggauuucgugugcuauaaagaggggacuggaccuuguagcgaaucagaggaaaaggcaugcaaaaccagugguuccugccgcggcgacaugcaguuuuguaagguggccgggugcgagcacggagaggaagcuagcgaggcaaaauguagaugcucuuuaguccauaagccaggcgaaguugugguaucauacggugggacaagggugcggcccaaauguuacggcuucagucgcaugauggccacccuggaggucaacccuccagaacagcgaaucggacaaugcacuggcugucaccuugagugcaucaaugggggagugagauugauuacacugaccagcgagcuaagguccgcuacgguuugugccucucauuuuugcucgagcgcguccucagguaagaagaguacugaaauacacuuccacucuggcagccucguggggaaaaccgcaauccaugucaagggagcccugguggacggcacagaguucacuuuugaagguuccuguauguuccccgaugggugcgacgcuguagauugcaccuuuugucgggaguuccuuaaaaacccgcagugcuauccugccaagaaauggcuguuuauuaucauaguuauuuugcucggcuacgcaggacugauguuacugacaaaugugcucaaggcuaucggcgucugggggucaugggugaucgcccccgucaaacuuauguucgcgauuaucaagaagcugaugcguaccgugagcuguuugguuggaaaacuaauggaccgcgguagacaggugauucacgaagagauaggcgagaacggggaaggaaaucaagaugacguaaggaucgagauggcccggccacgacgcgucagacauuggauguauucuccugugauucugacgauccucgcaaucggccuggcugaagguugcgaugagaugguucacgccgacuccaaacuugugaguuguaggcaggggagcggcaacaugaaggagugcauuacuacaggacgggcucuguugcccgccgucaauccaggccaggaagcaugucuccauuuuaccgcccccgggucuccugauuccaagugccugaagauaaaagugaagcgcaucaacuuaaaauguaagaaaucaaguagcuacuucguaccagacgcuagaucgaggugcacuuccgugcgucggugucgaugggcgggagauugccagucuggcugcccgccccacuuuacaagcaauucauucagugacgacugggcagguaagauggauagagccgggcugggauuuuccggcuguucugacgguugcggcggggcugccuguggaugcuucaacgcagccccuagcuguaucuuuuggaggaaguggguugagaauccacacggcauuauuuggaaagucucccccugcgcugccugggugccuucagcagugaucgaacuaaccaugccaagcggggagguccgcacguuccaucccaugaguggaauaccgacccaaguuuucaagggcgugucugugacauaucucgguuccgauauggaaguaagcgggcugacugaccuuugugagaucgaggaauugaaaucgaagaaacuggcgcucgcuccuugcaaccaggccggaaugggcgucguggguaagguuggcgagauucaguguucaucugaagagagugcacggaccaucaaaaaggaugggugcauuuggaacgccgaccuggugggaaucgaacuuagagucgaugacgcuguguguuacuccaagauaacaagcguugaggccguggcaaauuauucugcuauuccaacuaccaucggcgggcugagguuugagcgcagccacgauucccagggaaaaauuucaggcagucccuuggacaucacagccauacgagguagcuucucuguaaacuaccgggggcuccgucuguccuuaucagaaaucaccgcgacuugcacgggagaggucacaaaugugaguggcugcuacagcuguaugaccggugccaagguguccauuaaacugcauucuucgaagaacagcacugcucacgucagaugcaaaggcgaugaaaccgcauuuucaguucuagagggggugcacuccuauaucguaaggcucaguuucgaccaugccguggucgaugaacaaugucagcugaauugcggaggccacgagucucaggugacacuuaaggggaacuugauuuuucuggacguuccuaaguucguggacggaagcuacaugcagaccuaucauuccacuguccccacaggcgcuaauaucccaucaccuacggauuggcucaacgcccuguuugguaauggguuaucucgcuggauacugggagugauuggcguucuuuugggcgggcucgcacuguucuuucuaaucauguuccugcucaaacugggaaccaagcaaguguuucggagcagaacuaaacuugcguga

SEQ ID NO: 11439 - RNA, 3222 nt, Artificial Sequence
  derived and/or modified CDS sequence (opt3) from SFTSV(Jilin)__KT890281.1__GP
augaugaaggugaucugguucagcucccugauuugccucgucauacaguguggcggggacaccggacccaucauuugcgccgguccuauccacucuaacaaaucagcuaauauuccacaucuucugggcuacagugagaagaucugucaaauagauagauugauccacguuagcuccugguuaaggaaccauucucaguuucagggguaugugggacagcggggcggucgcucgcaaguaucauacuauccggcagaaaauagcuacagucgaugguccgggcugcuaucucccugcgacgccgauuggcucggaaugcugguggucaaaaaggcgaaaggcagcgacaugauugugccuggcccauccuauaaggggaagguuuucuuugagcgucccacauucgauggauacguggguuggggcugugggucaggaaaaaguagaacugaaagcggcgagcuuuguucuuccgacucagguacgagcagugggcuguugccuucugauaggguccucuggaucggagacguggcuugccagccaaugacccccauuccugaagagacauuucuggagcugaaguccuucagccagucggaauuuccagauaucugcaaaauagacggcauuguauucaaccagugugagggcgaaucucucccgcaacccuuugauguugccuggauggacguggggcacucccauaagaucauuaugcgggagcacaaaacuaaguggguccaggagucaaguagcaaggauuucgugugcuauaaagaaggaaccgguccuuguuccgagucugaagagaagacaugcaaaaccagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaccucuggaagucaauccacccgagcagcgaaucggccaaugcacugggugucaccuugaaugcaucaacggaggugugagauugauuacacugaccucagagcuaaagagugccacgguuugugcuuaucauuuuugcagcugugccacuuccggcaagaaaucuaccgagauacaguuccacucggggagccucgugggaaagacagcgauccacgucaaaggcgcacugguggacgguacugaguucaccuuugaagggaggugcauguucccggauggcugcgacgccguagauuguacauuuugccgggaguuccuuaagaauccucaguguuaccccgcucaaaaauggcuguuuauuaucauaguuauuuugcucggauaugccggccugauguuacugaccaacgugcucaaggcaaugggggucuggggauccugggugaucgcuccagucaaacuuguguucgccaucauuaaaaagcugaugcgugcgguuucaugcuugauggguaaacuaauggaccgcggcagacaggugauccaugaagaaauuggggagaauagggagggaaaccaggaugacguacggauagaaauggcccgaccucgcagagucaggcacuggauguacagucccgugauccagacgauuguugcaaucggccuggcugaggguugugaugaaauggugcaugccgacucuaagcucgucagcugccggcaaggguccggcaauaugaaagagugugugacuacaggacgcgcucugcuuccagccguaaaccccggccaggaggcaugccugcacuuuaccgccccugggucaccagauagcaaguguuugaagaucagagugaaaaggauuaaucucaagugcaaaaagucuuccaguuauuucguuccggacgcucguagccgguguacuucuguccgaagaugccgcugggcgggagauugccaguccggcugucccccucauuuuacaucaaacaguuucagcgacgacugggcagguaaaauggauagggccgggcugggauuuucgggcugcuccgacgguuguggcggggcugccugcggauguuucaaugcagccccaucuugcauauuuuggcggaaguggguggaaaacccccacggcaucauuuggaaggugagcccuugugcugccugggucccaucagcaguuaucgaguuaaccaugcccaguggggaagugagaacguuccacccgauguccggcauuccuacccagguguucaaaggaguaucugucacauaccuggguagcgauauggagguguccgggcuaacugaccucugcgaaaucgaggagcugaagucaaagaaacuugcguuggcuccauguaaccaagccggaaugggcguuguggguaaggucggcgaaauacagugcagcagugaggaaucugcaaggaccaucaagaaagauggguguauuuggaaugccgaccuggugggaaucgagcuccgcguugaugacgcugugugcuauuccaagauuacaagcguagaagccgucgcaaacuacucggcuauccccacuaccauaggcgggcugcgauuugagcggucacaugauucucagggaaagauuaguggcuccccucuugacaucacagccauucgugguagcuucucugugaauuacagagggcugagguugagccucuccgagaucaccgcgacuugcacgggagaagugacaaacgucucaggcuguuauaguugcaugaccggugccaaaguuagcauaaagcugcacucuuccaaaaauucaacugcucaugugcgcuguaagggcgaugagaccgcauuuaguguauuagaaggggugcacagcuacuccgucucucugucguucgaccacgccgugguugaugagcagugccaacuaaacuguggaggccaugaaagccaggugacacuccgggggaaucugaucuuucuugacguccccaaauucguggacggaucauauaugcagaccuaccacuccacuguuccaacaggcgcuaacauuccuagucccacggauugguugaaugcccuguuugguaacgggcucucuagauggauccugggagugauuggcgucuuacugggcgggcuugcauuguucuuucucaucaugagccuguucaagcuaggaaccaagcagauauuuaggucccgaacuaaacuggcguga

SEQ ID NO: 11440 - RNA, 3222 nt, Artificial Sequence
  derived and/or modified CDS sequence (opt3) from SFTSV(05-Lu'an(CHN)-2015)__KX302597.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcggcgcuaaauguagaugcucucucguccauaagccaggugaaguugugguaucauacgggggcaugagggugcggcccaaauguuacggauuuagucgcaugauggcaaccuuagaggucaaccagccugaacaacgaaucggccagugcacugggugucaccuggagugcaucaauggaggugugagacuuauuacauugaccagcgaacugaaguccgccacgguuugugcuucucauuucugcucgagcgccacuuccggcaagaaaucaaccgagauacaguuccacagugggucucuagugggaaagacagcgauccacgucaaaggcgcacucguggaugguacugaguuuaccuucgaagggagcuguauguuuccagacggcugcgaugccguagacugcacauucuguagggaguuucugaagaacccccaaugcuauccggcuaaaaaguggcuuuucauuaucauaguuauucuguugggauacgccggccucaugcuguuaaccaaugugcugaaggcaaucgggaucuggggauccugggucauugcuccugugaaacucauguuugccaucauuaagaaacuuaugcggacggucucauaucugauggguaaguugauggaucguggccgccaggugauacaugaagagaucggggaaaacagagagggaaaucaggacgauguuaggauugagauggcgcggccccgacgcgugagacacuggauguacagcccaguaauccuaacuauccuggccauuggccucgcagaaucuugugacgagaugguccaugcugauuccaaacuggugaguugcaggcaggguagcgggaacaugaaggaauguguuacaaccggccgggcccuucugccugcugugaaucccggacaagaggccugcuugcacuucacugcaccaggcucucccgacuccaagugucucaaaauaaaggucaaacgcaucaaccugaagugcaaaaagucaaguagcuauuuugugccugaugccagaucgagguguacauccguacgucggugccgaugggcuggggacugucagucuggaugcccaccgcauuucaccagcaauucauuuagugacgauugggcgggcaagauggacagagcagguuuaggguucuccggaugcucugauggcugugguggcgccgcuugcggguguuuuaacgccgcacccagcugcauuuucuggaggaaauggguggagaauccucacggaaucauuuggaagguuuccccaugugccgcuuggguccccucagccgugaucgaacugacgaugccuagcggcgaggugcgcaccuuccacccaaugagugggauacccacacaggucuuuaaaggaguuucugugacuuaccuaggcuccgacauggaagugagcggucucaccgaucugugcgagaucgaggaacuuaagucgaaaaaguuggcacuggcgccguguaaccaggcugggaugggaguagucggcaaagugggugagauucaaugcucaucugaagagagugcccggacaaucaagaaggacggcuguauuuggaacgcagaucucguugggaucgaacugagaguggacgaugccgucugcuauuccaaaauaacuagcguggaggcuguugccaauuacucugcaauuccuaccacaaucggaggccuuagguucgaacgcagccaugacucccaggggaagauuucaggaaguccacuggauaucaccgcuauacgaggcagcuuuucugugaacuaccgggguuugcgucucucccugucagagaucacugccacguguacaggggagguaaccaaugucaguggaugcuauagcugcaugacuggcgcgaaaguguccauuaaguuacacucuucgaaaaacagcaccgcccaugugagauguaagggugacgaaacagcuuucucaguccuggagggcguucacuccuacaccgugagucuaucuuuugaucacgcaguaguggacgaacagugccagcucaauugugggggacaugagagccaagucacucugaagggcaaccuuaucuucuuggacgugcccaaauuuguugauggguccuauaugcagacauaccacucaacggugccuaccggagccaauauucccucuccaacugacuggcugaacgcucucuucggcaauggucugaguagguggaucuuaggggucauaggagugcugcuuggcggcuuggcccucuuuuucaugauuaugagccuguuuaagcuagggacaaaacagguuuuccgcucccggaccaagcuggcauga

SEQ ID NO: 11441 - RNA, 3222 nt, Artificial Sequence
  derived and/or modified CDS sequence (opt3) from SFTSV(07-Lu'an(CHN)-2015)__KX302598.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauguugccuggauggacgugggccacagucauaagaucauuaugcgggagcacaaaacaaaguggguccaggaaagcuccucuaaggauuucgugugcuauaaagaggggacuggaccuuguagcgaaucagaggaaaaggcaugcaaaaccagugguuccugccgcggcgacaugcaguuuuguaagguggccgggugcgagcacggagaggaagcuagcgaggcaaaauguagaugcucuuuaguccauaagccaggcgaaguugugguaucauacggugggaugagggugcggcccaaauguuacggcuucagucgcaugauggccacacuggaggucaacccuccagaacagcgaaucggacaaugcaccggcugucaccuugagugcaucaaugggggagugagauugauuacucugacaagcgagcuaagguccgcuaccguuugugccucucauuuuugcucgagcgcgacguccgguaagaagucaacugaaauacacuuccacaguggcucucucguggggaaaaccgcaauccaugucaagggagcccugguggacggcacagaguucacuuuugaagguagcuguauguuccccgaugggugcgacgcuguagauugcaccuuuugucgggaguuccuuaaaaacccgcagugcuauccugccaagaaauggcuguuuauuaucauaguuauuuugcucggcuacgcaggacugauguuacugacaaaugugcucaaggcuaucggcgucuggggguccugggugaucgcccccgucaaacuuauguucgcgauuaucaagaagcugaugcguaccgugucauguuugguuggaaaacuaauggaccgcgguagacaggugauucacgaagagauaggcgagaacggggaaggaaaucaagaugacguaaggaucgagauggcccggccacgacgcgucagacauuggauguauagcccugugauucugacgauccucgcaaucggccuggcugaagguugcgaugagaugguucacgccgacucuaaacuuguguccuguaggcaggggaguggcaacaugaaggagugcauuacuacaggacgggcucuguugcccgccgucaauccaggccaggaagcaugucuccauuuuaccgcccccgggagcccugauucuaagugccugaagauaaaagugaagcgcaucaacuuaaaauguaagaaauccucaaguuacuucguaccagacgcuagaucgaggugcacuagcgugcgucggugucgaugggcgggagauugccaguccggcugcccgccccacuuuacaucuaauagcuucucagacgacugggcagguaagauggauagagccgggcugggauuuaguggcuguuccgacgguugcggcggggcugccuguggaugcuucaacgcagccccuucuuguaucuuuuggaggaaguggguugagaauccacacggcauuauuuggaaagucagccccugcgcugccugggugccuuccgcagugaucgaacuaaccaugccaucaggggagguccgcacguuccaucccaugagcggaauaccgacccaaguuuucaagggcgugagugugacauaucucgguucugauauggaaguauccgggcugacugaccuuugugagaucgaggaauugaaaagcaagaaacuggcgcucgcuccuugcaaccaggccggaaugggcgucguggguaagguuggcgagauucaguguucgucagaagagucugcacggaccaucaaaaaggaugggugcauuuggaacgccgaccuggugggaaucgaacuuagagucgaugacgcuguguguuacaguaagauaacauccguugaggccguggcaaauuauagcgcuauuccaacuaccaucggcgggcugagguuugagcgcucucacgauagccagggaaaaauuuccggcucacccuuggacaucacagccauacgagguaguuucagcguaaacuaccgggggcuccgucugucuuuauccgaaaucaccgcgacuugcacgggagaggucacaaaugugucaggcugcuacaguuguaugaccggugccaaggugagcauuaaacugcauuccucuaagaacucgacugcucacgucagaugcaaaggcgaugaaaccgcauuuagcguucuagagggggugcacucauauaucguaucccucaguuucgaccaugccguggucgaugaacaaugucagcugaauugcggaggccacgagucucaggugacacuuaaggggaacuugauuuuucuggacguuccuaaguucguggacggaagcuacaugcagaccuaucauuccacuguccccacaggcgcuaauaucccaucaccuacggauuggcucaacgcccuguuugguaauggguuaucuagguggauacugggagugauuggcguucuuuugggcgggcucgcacuguucuuucuaaucauguuccugcucaaacugggaaccaagcaaguguuucgcagccggacuaaacuugcguga

SEQ ID NO: 11442 - RNA, 3222 nt, Artificial Sequence
  derived and/or modified CDS sequence (opt3) from SFTSV(12-Lu'an(CHN)-2014)__KX302595.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaucugcaaaguagacggaauaguuuucaaccagugugauuccgagucacugccgcaacccauugacguggccuggauggaugucggccacagucauaagaucauuaugcgggaacacaaaacuaagugggugcaggagagcuccucuaaggacuuugugugcuauaaagagggcaccgggccuuguagcgaaucagaggaaaagacaugcaaaaccaguggauccugccgcggugacaugcaguucuguaaggucgcaggcugcgagcacggggaagaggccagcgaggcuaaauguagaugcucuuuaguucauaagccaggagaagugguagugucauacggcgguaugaggguccggcccaaauguuacggguuuagucgcaugauggcaacucuggaggugaauccuccagaacagcgaaucggccaaugcacaggaugucaccuugagugcaucaacggcgggguuagauugauuacccugacgagcgaacuaaaguccgccacugugugugcuucucauuucugcucgagcgccaccuccggaaagaaaucaacagagauacaguuucacagugguucucucgucggcaaggcggcaauccacgugaaaggggcccugguagauggaacugaguucaccuucgaaggcagcuguauguuucccgacgguugcgaugcuguugacugcacauucuguagggaguuucuuaagaauccgcagugcuauccugccaaaaaguggcuguucauuaucauagugauuuugcucggguacgcaggccugauguuacugaccaacguccucaaggcuaucggaguguggggcuccugggucauggcccccgugaaacuuauguuugcgaucaugaagaaacugaugcggucaguuagcuguuugauggggaagcuaauggaucguggacgccaagugauucaugaagagaucggugaaaauagagagggcaaccaggacgauguaaggauugagauggcccggccacgacgcgucagacacuggauguauucuccugugauacugacgauccucgcaauugggcuggcugaaggaugcgacgagaugguucaugccgauuccaaacuugugaguuguaggcagggcagcgguaauaugaaggaaugcgucacuacagggcgggcucuguugcccgccgugaacccaggccaggaggcaugucuccacuucaccgcccccggaucuccugacuccaagugccugaaaaucaagguaaaacgcaucaauuuaaaguguaaaaagucaaguagcuacuuugugccagaugcuagaucgaggugcacuuccguucgucggugucgaugggcgggcgacugccaaucugggugcccgagcuauuucacaucaaacaguuuuuccgacgauugggcaggaaagauggacagagccggccuggguuucucuggguguagcgauggaugcggcggugcugccuguggcugcuuuaaugcagcccccuccuguauuuucuggaggaaaugggucgagaacccucaugggauaaucuggaaggugucaccaugcgcugccugggugcccagcgcagucauugaacuaaccaugccuaguggagagguucgcacguuucacccaaugucuggcauccccacccagguguucaaagggguguccguaacauaccucggaagcgacauggaagucucgggccugacugaucuuugugagauugaagaguugaagucuaaaaagcuggcgcucgcuccgugcaaccaggccgguaugggggugguuggaaaagugggcgagauccaguguucaagugaagaguccgcacggaccauaaagaaggacgguugcaucuggaaugccgaucuggucggcauugaacuuagaguggacgaugcuguuuguuauagcaaaaucacaucuguggaggccguagcaaacuacagcgcuauuccuacuaccaucgggggacugagguucgaacgcucccacgacucacaaggcaagauaagugggagcccauuggauauuacagccauccgaggaucuuuuuccgucaauuaccggggccuccgucugucauuaagugagauuaccgcgacuugcacgggugaggugacaaacgugagcgggugcuauuccuguaugaccggagccaaagucucuaucaagcugcauucgagcaaaaauucaacugcucacguuagaugcaggggcgacgaaaccgcauucuccgugcuagaggguguacauaguuacacagugucucucagcuuugaucacgccgucguggacgaacagugucagcugaacugcggcgggcacgagucccagguuacccuuaagggaaauuugauauuccuggacgugcccaaguuugucgauggcucauauaugcaaacuuaccauucuagcgugccuacaggggcuaacauccccaguccaacggacuggcucaaugcccuguucggaaacggcuuaucccgcuggauucuggguguuaucggggugcuuuugggaguccucgcacuguuuuuccuaauuaugagccuguuuaaacucggcaccaagcagguaauccggucuagaacuaaacuggcguga

SEQ ID NO: 11443 - RNA, 3222 nt, Artificial Sequence
  derived and/or modified CDS sequence (opt3) from SFTSV(14-Lu'an(CHN)-2014)__KX302596.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaucugcaaaguagacggaauaguuuucaaccagugugauuccgagucacugccgcaacccauugacguggccuggauggaugucggccacagucauaagaucauuaugcgggaacacaaaacuaagugggugcaggagagcuccucuaaggacuuugugugcuauaaagagggcaccgggccuuguagcgaaucagaggaaaagacaugcaaaaccaguggauccugccgcggugacaugcaguucuguaaggucgcaggcugcgagcacggggaagaggccagcgaggcuaaauguagaugcucuuuaguucauaagccaggagaagugguagugucauacggcgguaugaggguccggcccaaauguuacggguuuagucgcaugauggcaacucuggaggugaauccuccagaacagcgaaucggccaaugcacaggaugucaccuugagugcaucaacggcgggguuagauugauuacccugacgagcgaacuaaaguccgccacugugugugcuucucauuucugcucgagcgccaccuccggaaagaaaucaacagagauacaguuucacagugguucucucgucggcaaggcggcaauccacgugaaaggggcccugguagauggaacugaguucaccuucgaaggcagcuguauguuucccgacgguugcgaugcuguugacugcacauucuguagggaguuucuuaagaauccgcagugcuauccugccaaaaaguggcuguucauuaucauagugauuuugcucggguacgcaggccugauguuacugaccaacguccucaaggcuaucggaguguggggcuccugggucauggcccccgugaaacuuauguuugcgaucaugaagaaacugaugcggucaguuagcuguuugauggggaagcuaauggaucguggacgccaagugauucaugaagagaucggugaaaauagagagggcaaccaggacgauguaaggauugagauggcccggccacgacgcgucagacacuggauguauucuccugugauacugacgauccucgcaauugggcuggcugaaggaugcgacgagaugguucaugccgauuccaaacuugugaguuguaggcagggcagcgguaauaugaaggaaugcgucacuacagggcgggcucuguugcccgccgugaacccaggccaggaggcaugucuccacuucaccgcccccggaucuccugacuccaagugccugaaaaucaagguaaaacgcaucaauuuaaaguguaaaaagucaaguagcuacuuugugccagaugcuagaucgaggugcacuuccguucgucggugucgaugggcgggcgacugccaaucugggugcccgagccauuucacaucaaacaguuuuuccgacgauugggcaggaaagauggacagagccggccuggguuucucuggguguagcgauggaugcggcggugcugccuguggcugcuuuaaugcagcccccuccuguauuuucuggaggaaaugggucgagaacccucacgggauaaucuggaaggugucaccaugcgcugccugggugcccagcgcagucauugaacuaaccaugccuaguggagagguucgcacguuucacccaaugucuggcauccccacccagguguucaaagggguguccguaacauaucucggaagcgacauggaagucucgggccugacugaucuuugugagauugaagaguugaagucuaaaaagcuggcgcucgcuccgugcaaccaggccgguaugggggugguuggaaaagugggcgagauccaguguucaagugaagaguccgcacggaccauaaagaaggacgguugcaucuggaaugccgaucuggucggcauugaacuuagaguggacgaugcuguuuguuacagcaaaaucacaucuguggaggccguagcaaacuauagcgcuauuccuacuaccaucgggggacugagguucgaacgcucccaugacucacaaggcaagauaagugggagcccauuggauauuacagccauccgaggaucuuuuuccgucaauuaccggggccuccgucugucauuaagugagauuaccgcgacuugcacgggugaggugacaaacgugagcgggugcuacuccuguaugaccggagccaaagucucuaucaagcugcacucgagcaaaaauucaacugcucauguuagaugcaggggcgacgaaaccgcauucuccgugcuagaggguguacacaguuauacagugucucucagcuuugaucacgccgucguggacgaacagugucagcugaacugcggcgggcaugagucccagguuacccuuaagggaaauuugauauuccuggacgugcccaaguuugucgauggcucauacaugcaaacuuaucacucuagcgugccuacaggggcuaacauccccaguccaacggacuggcucaaugcccuguucggaaacggcuuaucccgcuggauucuggguguuaucggggugcuuuugggaguccucgcacuguuuuuccuaauuaugagccuguuuaaacucggcaccaagcagguauuccggucuagaacuaaacuggcguga

SEQ ID NO: 11444 - RNA, 3222 nt, Artificial Sequence
  derived and/or modified CDS sequence (opt3) from SFTSV(18-Lu'an(CHN)-2015)__KX302599.1__GP
augaugaaggugaucugguucuuuagccugauuugcuucgucauacaguguuccggcgacucugggcccaucauuugcgccggaccuauccacucaaacaaaagugcugauauuccacaucuccuugguuacagcgagaagaucugucaaauagacagacugauccacguuuccucuugguugaggaaucauucgcaguuucagggcuauguggggcagcggggaggccgcucacaaguaagcuacuauccggcagaaaacaguuacucccgauggucugguuuacugagccccugcgaugccgacuggcuagggaugcucguggucaaaaaggcgaaaggauccgauaugauugugccuggcccaucauauaagggcaagguuuucuuugagcgucccaccuucgacggguacgugggaugggguuguggcagugggaaaagcagaacagaaucuggagagcugugcuccucagauagcggcacuuccucuggucuucugccuuccgacagggucuuguggaucggggauguggcuugucagccaaugacgcccauuccugaagagaccuuucucgagcucaagagcuucucgcagucugaauuuccagacaucugcaaaauagauggaauuguauucaaucagugugagggcgaaucccugccgcaacccuuugacguugccuggauggaugugggccacucacauaagaucauuaugcgggagcacaaaacaaaguggguccaggagaguagcuccaaggacuucgugugcuauaaagaagggacuggaccuuguucugagagcgaagagaagaccugcaaaacaucagguaguugccgcggcgacaugcaguuuuguaagguggcagggugcgaacacggagaggaggccuccgaagcuaaauguagaugcagccugguccauaagccaggcgagguugugguaucuuacagggguaugcggauccgccccaaauguuacggguucucacgaaugauggcaaccuuagaagugaaccagccugagcaaagaaucggccagugcacuggaugucaccuggaaugcauuaauggcggggucaggcuuauaacauugaccagugagcuaaagagcgccacggugugugcuucccauuucugcaguucggccacuagcggaaagaaauccaccgagauccaguuucacucagguagucugguuggcaagacagcgauucacgugaaaggggcacucgucgauggaacugaguucaccuuugaaggcucuuguauguucccagacgguugcgaugccguggacugcacauuuugucgggaguuccugaagaacccccaaugcuauccggcuaaaaaguggcuuuuuaucauaauuguaauccuguugggguacgccggccucaugcuguuaaccaauguucugaaggcaaucggaauuuggggcagcugggugaucgcuccugucaaacucauuuucgccauaaucaagaaacuuaugcguacgguguccugucugauggggaaguugauggaucgcggaagacaggucauucaugaagaaaucggugagaacagggagggcaaucaggacgaugugcggaucgaaauggcgcgaccccgcagaguuaggcacuggauguauucaccagugauucuaacuauacuggccaucgggcucgcagagggaugcgacgaaaugguacaugcugauagcaaacuggucucuugucggcagggcuccgguaacgugaaggagugcguuacaaccgggcgcgcccuucugccugcugugaaucccggccaagaggccuguuugcacuuuacugcaccaggaagucccgacagcaagugccucaaaauuagagucaagaggaucaaccugaaauguaagaaaucuuccucauacuucgugccugaugcccguagucggugcacaagcguacgaagauguaggugggcuggcgacugccagucggggugcccaccgcauuuuaccuccaauucuuucagcgacgauugggcgggaaagauggaccgcgcaggcuuagguuuuucaggguguagugauggaugcggcggugccgcuuguggcugcuucaacgccgcacccuccuguauuuucuggcggaaguggguggaaaauccucacgggaucauauggaaaguuucuccaugcgccgcuuggguccccagcgccgugaucgagcugacgaugccuuccggagaagugagaaccuuucacccaaugucaggcauucccacacaggucuucaaggggguuagcaucacuuaucuaggaagugacauggaggugucuggccucaccgaucugugugaaauugaggagcuuaaauccaagaaauuggcacuggcgccgugcaaccaggcugguaugggggugguaggaaaggucggcgaaauccaauguagcucggaggaaucagccaggacaauaaagaaggacgguugcauuuggaacgcagaucucgugggcaucgagcugcgcguugacgaugccguguguuacucuaagauuacuucugucgaagcuguggccaauuauuccgcaaucccuaccacaauagggggacuucgauuugagcggagccaugacucucagggcaaaaucagcggguccccacuggauauuaccgcuauccguggaucauucaguguuaacuacagaggcuugaggcucagccugucugagauuacugccacgugcacaggugaagugaccaauguauccgggugcuacucauguaugacuggagcgaaggucaguaucaaauuacacagcaacaagaauaguaccgcccaugugcgcugcaaaggcgacgagacagcuuuuucugugcuggaagguguccacucguauaccguuagccuaucauucgaucacgcagugguagacgagcagugucagcucaacugcggcgggcaugaaucccaagugacucugaagggaaaucuuauauuuuuggacguccccaaguucguggauggcaguuacaugcagacauaucacucuacgguuccuaccggggccaacauucccagcccaacugacuggcugaaugcucucuuuggaaacggccugucccgguggaucuuaggugugaucgggguccugcuuggaggcuuggcccucuucuuuaugauuaugucacuguucaaacuaggcacaaaacagguguuuagaucuaggaccaaacuggcauga

SEQ ID NO: 11445 - RNA, 3222 nt, Artificial Sequence
  derived and/or modified CDS sequence (opt3) from SFTSV(27-Lu'an(CHN)-2015)__KX302600.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugaggauccggcccaaauguuacggcuuuagucgcaugauggcaaccuuagaagugaaccagccugagcaacgaaucggacagugcacuggcugucaccuggaaugcauuaaugggggagucagacuuauaacauugaccagcgagcugaaguccgccacggugugugcuucucauuucugcucgagcgccacuuccgguaagaaaucaaccgagauccaguuccacaguggcucucuaguugggaagacagcgauucacgugaaaggagcacucgucgauggcacugaauuuaccuucgaggguagcuguauguuuccagacgggugcgaugccguggacugcacauucuguagggaauuucugaagaacccccaaugcuauccggcuaaaaaguggcuuuucaucauaauuguaauccuguugggcuacgccggacucaugcuguuaaccaauguucugaaggcaaucggcauuuggggguccugggugaucgcuccugucaaacucauuuuugccauaaucaagaaacuuaugcggacggugucaugucugaugggaaaguugauggaucguggucgccaggucauucaugaggaaaucggcgagaacagagaggggaaucaggacgaugugaggaucgaaauggcgcggccccgacgcguuagacacuggauguauagcccagugauucuaacuauacuggccaucggacucgcagagucuugcgacgaaaugguacaugcugauuccaaacuggucaguuguaggcagggcagcgguaacaugaaggagugcgugacaaccgggcgggcccuucugccugcuguuaaucccggccaagaggccuguuugcacuucacugcaccaggaucucccgacuccaagugccucaaaauuaaggugaaacgcaucaaccugaaguguaaaaagucaaguagcuacuuugucccugaugccagaucgaggugcacauccgugcgucggugucgaugggcuggcgacugccagucugggugcccaccgcauuucaccagcaauucauuuagugacgauugggcgggaaagauggacagagcaggcuuagguuucuccggguguucugauggaugcggcggugccgcuuguggcugcuuuaacgccgcacccagcuguauuuucuggaggaaauggguagaaaauccucacgggaucauauggaagguguccccaugcgccgcuuggguucccucagccgucaucgagcugacgaugccuagcggagaagugcgcaccuuccacccaaugaguggcauucccacacagguguuuaaaggggucucuguuacuuaucuaggauccgacauggaggugagcggccucaccgaucugugugaaaucgaggagcuuaagucgaaaaaguuggcacuggcgccgugcaaccaggcugguaugggggugguaggaaaagucggcgaaauucaauguucaucugaggaaagugcccggacaaucaagaaggacgguugcauauggaacgcagaucucgugggcauugagcugagaguugacgaugccguguguuacuccaaaaucacuagcgucgaagcuguggccaauuauucugcaauuccuaccacaaucgggggacuuagguucgagcgcagccaugacucccagggcaagauaucagggaguccacuggauaucaccgcuauucgaggcagcuuuucuguuaacuaccggggauugcgucucucccugucagagaucacugccacgugcacaggugaagugaccaauguaagugggugcuacagcuguaugacuggagcgaaagucuccauuaaguuacacucuucgaaaaacagcaccgcccaugugagaugcaagggcgacgagacagcuuucucagugcuggaagguguccacuccuauaccguuagucuaucuuuugaucacgcagugguagacgagcagugucagcucaauugcggcgggcaugaaagccaagugacucugaagggaaaccuuaucuucuuggacguccccaaauuuguggauggcuccuacaugcagacauaucacucaacgguuccuaccggggccaauauacccucuccaacugacuggcugaacgcucucuucggaaauggccugaguagguggauuuuaggugugaucgggguccugcuuggaggcuuggcccucuuuuucaugaucaugagccuguuuaagcuaggcacaaaacagguguuccgcucccggaccaagcuggcauga

SEQ ID NO: 11446 - RNA, 3222 nt, Artificial Sequence
  derived and/or modified CDS sequence (opt3) from SFTSV(36-Lu'an(CHN)-2015)__KX302601.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucauguuugccaucauuaagaaacuuaugcggacggucucaugucugaugggaaaguugauggaucguggucgccaggugauacaugaggaaaucggcgagaacagagaggggaaucaggacgauguuaggauugaaauggcgcggccccgacgcgugagacacuggauguauagcccaguaguccuaacuauccuggccaucggacucgcagagucuugcgacgaaauggugcaugcugauuccaaacugguuaguuguaggcagggcagcgguaacaugaaggagugcgugacaaccgggcgggcccuucugccugcugucaaucccggccaagaggccuguuugcacuucacugcaccaggaucucccgacuccaagugccucaaaauuaaggugaaacgcauaaaccugaaguguaaaaagucaaguagcuacuuuguaccugaugccagaucgaggugcacauccgugcgucggugucgaugggcuggcgacugccagucugggugcccaccgcauuucaccagcaauucauuuagugacgauugggcgggaaagauggacagagcaggcuuagguuucuccggguguucugauggaugcggcggugccgcuuguggcugcuuuaacgccgcacccagcuguaucuucuggaggaaauggguugaaaauccucacgggauuaucuggaaggucuccccaugcgccgcuugggugcccucagccgugauugagcugacgaugccuagcggagaaguccgcaccuuccacccaaugaguggcauccccacacagguuuuuaaaggggugucugugacuuaucuaggauccgacauggagguaagcggccucaccgaucugugugaaauagaggagcuuaagucgaaaaaguuggcacuggcgccgugcaaccaggcugguaugggggucgugggaaaaguuggcgaaauccaauguucaucugaggaaagugcccggacaauuaagaaggacgguugcaucuggaacgcagaucucgugggcauugagcugagagucgacgaugccguguguuacuccaaaaucacuagcguugaagcuguggccaauuauucugcaauaccuaccacaauugggggacuuagguucgagcgcagccaugacucccagggcaagaucucagggaguccacuggauauuaccgcuauccgaggcagcuuuucuguaaacuaccggggauugcgucucucccugucagagauaacugccacgugcacaggugaagucaccaaugugagugggugcuacagcuguaugacuggagcgaaaguguccaucaaguuacacucuucgaaaaacagcaccgcccaugucagaugcaagggcgacgagacagcuuucucaguucuggaaggugugcacuccuauaccguaagucuaucuuuugaucacgcaguggucgacgagcagugucagcucaauugcggcgggcaugaaagccaagugacucugaagggaaaccuuauuuucuuggacguucccaaauuuguggauggcuccuacaugcagacauaucacucaacggucccuaccggggccaauauccccucuccaacugacuggcugaacgcucucuucggaaauggccugaguagguggauuuuaggugugaucgggguucugcuuggaggcuuggcccucuuuuucaugauaaugagccuguuuaagcuaggcacaaaacagguguuccgcucccggaccaagcuggcauga

SEQ ID NO: 11447 - RNA, 3222 nt, Artificial Sequence
  derived and/or modified CDS sequence (opt3) from SFTSV(42-Lu'an(CHN)-2015)__KX302602.1__GP
augaugaaggugaucugguucagcucccugauuugcuuugucauacaguguucuggcgacucagggcccaucauuugcgccggaccuauccacaguaacaaaagcgcugauauuccacaucuccuugguuucuccgagaagaucugucaaauagacagacugauccacguuucuucgugguugaggaaucauucacaguuucagggcuacguggggcagcggggaggccgcagccaaguaaguuauuacccggcagaaaacuccuauucucgauggagcgguuuacugucccccugcgaugccgacuggcuagggaugcucguggucaaaaaggcgaaaggaucagauaugauugugccuggcccaaguuacaagggcaagguuuucuuugagcgucccaccuucgacggguaugugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuucucgagcugaagucguucucucaguccgaauuuccagacaucugcaaaauagauggaauuguauucaaucagugugagggcgaaucacugccgcaacccuuugacguugccuggauggaugugggccacagucauaagaucauuaugcgggagcacaaaacaaaguggguccaggagagcuccucuaaggacuucgugugcuacaaagaagggacuggaccuuguagcgagucagaagagaagaccugcaaaacaagugguuccugccgcggcgacaugcaguuuuguaagguggcagggugcgaacacggagaggaggccagcgaagcuaaauguagaugcucucucguccauaagccaggcgagguugugguaucauaugguaggaugcgggugcgccccaaauguuacggguucagucgaaugauggcaaccuuagaagucaaccagccugagcaaagaaucggccagugcacuggaugucaccuggaaugcaucaauggcggggugaggcuuauuacauugaccagcgagcugaaguccgccacgguuugugcuucucauuucugcucgagcgccacuuccggaaagaaaucaaccgagauacaguuucacagugguucucuagugggcaagacagcgauccacgucaaaggggcacucguggauggaacugaguucaccuuugaaggcagcuguauguucccagacgguugcgaugccguagacugcacauuuugucgggaguuccugaagaacccccaaugcuacccggcuaaaaaguggcuuuuuauuaucauaguuauucuguugggguaugccggccucaugcuguuaaccaaugugcugaaggcaaucggaaucuggggcuccugggucauugcuccugugaaacucaucuucgccauuauaaagaaacuuaugcguacggucucaugucugauggggaaguugauggaucgcggaagacaggugauccaugaagaaauuggugagaacagggagggcaaucaggacgauguucggaucgaaauggcgcgaccccgcagagugaggcacuggauguacagcccaguaauccuaacuauucuggccauagggcucgcagagucuugcgacgaaaugguccaugcugauuccaaacuggugaguugucggcagggaagcggcaacaugaaggagugcguuacaaccggucgcgcccuucugccugcugugaaucccgggcaagaggccuguuugcacuuuacugcaccaggcucucccgacuccaagugccucaaaaucaaggucaaaagaauuaaccugaaguguaaaaagucaaguagcuauuucgugccugaugccaggucgcguugcacauccguacggcgauguagaugggcuggagacugccagucuggcugcccaccgcauuuuaccagcaauucauucagugacgauugggcggggaagauggacagggcaggauuaggcuuuuccgguuguucugaugggugcggaggcgccgcuugugguugcuucaacgccgcacccagcuguaucuucuggcgcaaauggguggaaaauccucacggcauuaucuggaagguuuccccaugcgccgcuuggguccccucagccgugauagagcugacgaugccuagcggggaagugcggaccuuucacccaaugaguggaauccccacacaggucuucaaaggcguuucugugacuuaccuaggguccgacauggaggugagcggacucaccgaucugugugaaauugaggagcuuaagucgaaaaaguuggcacuggcgccgugcaaccaggcuggcauggguguagucgggaaagugggagaaauccaauguucaucugaggaaagugccagaacaauuaagaaggacggcugcaucuggaacgcagaucucguugguauagagcugaggguggacgaugccgucuguuauuccaaaauuacuagcguggaagcuguuucuaauuacagcgccaucccuaccacaauuggcgggcuucgcuuugagcgaucccaugacucacagggaaagaucaguggcagcccacuggauauaaccgcaauccgggggucuuucuccgugaacuaucguggauugagacucucacugagugagauuacugcuacgugcacaggcgaaguaaccaaugucagcgguugcuacuccuguaugacuggggccaaagugucuaucaaguuacacucgagcaaaaacucaaccgcgcaugugaggugcaagggagacgagacagccuuuuccguccuggaaggcguucacaguuacaccgugucuuugagcuucgaucacgcuguaguggacgagcagugucagcucaauugcgguggccaugaaucccaagucacucugaaggggaaccuuauuuuucuagacgugcccaaauucguugauggaucauauaugcagacauaccacucuacggugccuaccggcgcaaauauccccagcccaacugacuggcugaacgcccucuuugggaauggacugagucgcuggauauuaggcgucauuggugugcugcuugggggauuggcucucuucuuuaugaucaugucccuguucaagcuaggcacaaaacagguuuuucggagcagaaccaagcuggccuga

SEQ ID NO: 11448 - RNA, 3222 nt, Artificial Sequence
  derived and/or modified CDS sequence (opt3) from SFTSV(44-Lu'an(CHN)-2015)__KX302603.1__GP
augaugaaggugaucugguucagcucccugauuugcuuugucauacaguguucuggcgacucagggcccaucauuugcgccggaccuauccacaguaacaaaagcgcugauauuccacaucuccuugguuucuccgagaagaucugucaaauagacagacugauccacguuucuucgugguugaggaaucauucacaguuucagggcuacguggggcagcggggaggccgcagccaaguaaguuauuacccggcagaaaacuccuauucucgauggagcgguuuacugucccccugcgaugccgacuggcuagggaugcucguggucaaaaaggcgaaaggaucagauaugauugugccuggcccaaguuacaagggcaagguuuucuuugagcgucccaccuucgacggguaugugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuucucgagcugaagucguucucucaguccgaauuuccagacaucugcaaaauagauggaauuguauucaaucagugugagggcgaaucacugccgcaacccuuugacguugccuggauggaugugggccacagucauaagaucauuaugcgggagcacaaaacaaaguggguccaggagagcuccucuaaggacuucgugugcuacaaagaagggacuggaccuuguagcgagucagaagagaagaccugcaaaacaagugguuccugccgcggcgacaugcaguuuuguaagguggcagggugcgaacacggagaggaggccagcgaagcuaaauguagaugcucucucguccauaagccaggcgagguugugguaucauauggugggaugagggugcggcccaaauguuacggcuucagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuucacaguggcucucuaguggggaagacagcgauccacgucaaaggagcacucguggauggcacugaguucaccuuugaagguagcuguauguucccagacgggugcgaugccguagacugcacauuuuguagggaguuccugaagaacccccaaugcuacccggcuaaaaaguggcuuuuuauuaucauaguuauucuguugggcuaugccggacucaugcuguuaaccaaugugcugaaggcaaucggcaucuggggguccugggucauugcuccugugaaacucaucuucgccauuauaaagaaacuuaugcggacggucucaugucugaugggaaaguugauggaucguggucgccaggugauccaugaagaaauuggcgagaacagagaggggaaucaggacgauguuaggaucgaaauggcgcggccccgacgcgugagacacuggauguacagcccaguaauccuaacuauucuggccauaggacucgcagagucuugcgacgaaaugguccaugcugauuccaaacuggugaguuguaggcagggcagcgguaacaugaaggagugcguuacaaccgggcgggcccuucugccugcugugaaucccggccaagaggccuguuugcacuuuacugcaccaggaucucccgacuccaagugccucaaaaucaaggucaaacgcauuaaccugaaguguaaaaagucaaguagcuauuucgugccugaugccagaucgaggugcacauccguacgucggugucgaugggcuggcgacugccagucugggugcccaccgcauuuuaccagcaauucauucagugacgauugggcgggaaagauggacagagcaggcuuagguuuuuccggguguucugauggaugcggcggugccgcuuguggcugcuucaacgccgcacccagcuguaucuucuggaggaaauggguggaaaauccucacgggauuaucuggaagguuuccccaugcgccgcuuggguccccucagccgugauagagcugacgaugccuagcggagaagugcgcaccuuucacccaaugaguggcauccccacacaggucuucaaagggguuucugugacuuaccuaggauccgacauggaggugagcggccucaccgaucugugugaaauugaggagcuuaagucgaaaaaguuggcacuggcgccgugcaaccaggcugguauggggguagucggaaaagugggcgaaauccaauguucaucugaggaaagugcccggacaauuaagaaggacgguugcaucuggaacgcagaucucguuggcauagagcugagaguggacgaugccgucuguuauuccaaaauuacuagcguggaagcuguuucuaauuacagcgccaucccuaccacaauugggggacuuagguuugagcgcucccaugacucacagggcaagaucagugggagcccacuggauauaaccgcaauccgaggaucuuucuccgugaacuaucggggcuugcgucucucacugagugagauuacugcuacgugcacaggugaaguaaccaaugucagcgggugcuacuccuguaugacuggagccaaagugucuaucaaguuacacucgagcaaaaacucaaccgcgcaugugagaugcaagggcgacgagacagccuuuuccguccuggaagguguucacaguuacaccgugucuuugagcuucgaucacgcuguaguggacgagcagugucagcucaauugcggcgggcaugaaucccaagucacucugaagggaaaccuuauuuuucuagacgugcccaaauucguugauggcucauauaugcagacauaccacucuacggugccuaccggggcaaauauccccagcccaacugacuggcugaacgcccucuuuggaaauggccugaguagguggauauuaggugucauuggggugcugcuuggaggcuuggcucucuucuuuaugaucaugucccuguucaagcuaggcacaaaacagguuuuucgcagccggaccaagcuggccuga

SEQ ID NO: 11449 - RNA, 3222 nt, Artificial Sequence
  derived and/or modified CDS sequence (opt3) from SFTSV(52-Lu'an(CHN)-2015)__KX302604.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcggacggucucaugucugaugggaaaguugauggaucguggucgccaggugauccaugaggaaauuggcgagaacagagaggggaaucaggacgauguuaggaucgaaauggcgcggccccgacgcgugagacacuggauguauagcccaguaauccuaacuauucuggccauaggacucgcagagucuugcgacgaaaugguccaugcugauuccaaacuggugaguuguaggcagggcagcgguaacaugaaggagugcguuacaaccgggcgggcccuucugccugcugugaaucccggccaagaggccuguuugcacuucacugcaccaggaucucccgacuccaagugccucaaaaucaaggucaaacgcauuaaccugaaguguaaaagaucaaguagcuacuuugugccugaugccaggucgcguugcacauccguacggcgauguagaugggcuggcgacugccagucugggugcccaccgcauuucaccagcaauucauuuagugacgauugggcgggaaagauggacagggcaggcuuagguuucuccggguguucugauggaugcggcggugccgcuuguggcugcuuuaacgccgcacccagcuguaucuucuggcgcaaguggguggaaaauccucacgggauuaucuggaaaguuuccccaugcgccgcuuggguccccucagccgugauagagcugacgaugccuagcggagaagugcggaccuuccacccaaugaguggcauccccacacaggucuuuaaggggguuucugugacuuaucuaggauccgacauggaggugagcggccucaccgaucugugugaaauugaggagcuuaaaucgaagaaauuggcacuggcgccgugcaaccaggcugguauggggguagucggaaaggugggcgaaauccaauguucaucugaggaaagugccagaacaauuaaaaaggacgguugcaucuggaacgcagaucucguuggcauagagcugaggguggacgaugccgucuguuacuccaagauuacuagcguggaagcuguugccaauuauucugcaaucccuaccacaauugggggacuucgcuucgagcgaagccaugacucccagggcaaaaucucagggaguccacuggauauaaccgcuauccggggcagcuuuucugugaacuaccguggauugagacucucccugucagagauuacugccacgugcacaggugaaguaaccaaugucagugggugcuacagcuguaugacuggagcgaagguguccaucaaauuacacucuucgaagaacagcaccgcccaugugaggugcaaaggcgacgagacagcuuucucaguccuggaagguguucacuccuauaccgugagucuaucuuuugaucacgcaguaguggacgagcagugucagcucaauugcggcgggcaugaaagccaagucacucugaagggaaaccuuauuuucuuggacgugcccaaguuuguugauggcuccuacaugcagacauaucacucaacggugccuaccggggccaauauccccucuccaacugacuggcugaacgcucucuucggaaauggccugagccgcuggauauuaggugucauuggggugcugcuuggaggcuuggcccucuuuuucaugaucaugagucuguuuaaacuaggcacaaagcagguuuuccgguccagaaccaaacuggcauga

SEQ ID NO: 11450 - RNA, 3222 nt, Artificial Sequence
  derived and/or modified CDS sequence (opt3) from SFTSV(HL/Injected)__KF791953.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuugcaguuccgauucagguacgagcagugggcuguugccuucugacaggguccucuggaucggagauguggcuugucagccaaugacccccauuccugaagagacauuucuggagcugaaguccuucagccagucggaauuuccagacaucugcaaaauagauggcauuguauucaaucagugugagggcgaaucucucccgcaacccuuugacguugccuggauggauguggggcacucccauaagaucauuaugcgggagcacaaaacuaaguggguccaggagucaaguagcaaggacuucgugugcuauaaagaaggaaccgguccuuguuccgagucugaagagaagacaugcaaaaccagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacucuggaagucucacagccugagcaacgaaucggccagugcacagggugucaccuugaaugcaucaacggaggugugagauugauuacccugacgagugagcuaaagagcgccacuguuugugcuucccauuuuuguucuucggccaccagcggcaagaaauccacagagauacaguuccacucagggagucucgugggaaagacugcgauccacgucaaaggcgcacugguggaugguaccgaguucacauuugaagggucuugcauguucccagacggcugcgaugccguagacugcaccuuuuguagggaguuccuuaagaauccccaaugcuauccggcuaaaaaguggcuguuuauuaucauaguuauuuugcucggauacgccggccugauguuacugacgaacgugcucaaggcaaucggggucuggggaagcugggugaucgcuccugucaaacuuguguucgccauuaucaagaaacugaugcgggcgguuuccuguuugauggguaagcuaauggaucguggccgccaggugauucaugaagaaauaggggagaauagagagggaaaccaggacgauguaaggaucgaaauggcccggccccgacgcgucagacacuggauguauucaccagugauucugacuauccucgcaaucggccuggcugaggguugcgacgaaaugguucaugccgauagcaaacuugugucuuguaggcagggguccggcaauaugaaggagugcgucacaaccggacgggcucuguugccugccgugaaccccggccaagaggcaugucuccacuuuacugccccagggagucccgacagcaagugccugaaaauuaagguaaaacgcauaaauuuaaaguguaaaaagucuuccucauacuucgugccugaugcuagaaguaggugcacaagcguucgucggugucgaugggcgggagacugccagucgggcugcccaccgcauuuuaccuccaacucuuucagcgacgauugggcagguaagauggacagagccgggcugggauuuucaggcuguagugaugguugcggcggggcugccuguggaugcuucaaugcagcccccuccuguaucuuuuggaggaaaugggucgaaaacccucacggcauuaucuggaaggugucuccaugcgcugccugggugcccagcgcagucauugagcuaacgaugccuuccggggaaguucgcaccuuccacccaaugucaggaauccccacacagguguucaaaggcgugagcguaacuuaucucgguagugacauggaggucucugggcugaccgaucuuugugaaauagaggaguugaaguccaaaaagcuggcgcucgcuccgugcaaucaggccggaaugggcgugguugguaaagugggcgaaauccaauguagcucggaggaaucagcacggacaauuaagaaggacgggugcaucuggaacgccgaucuggucggaauugagcuuagaguggacgaugcuguuuguuacucuaaaaucacuucuguggaagccguagcaaacuauuccgcuauaccuaccacaauuggcgggcugagguuugagcgcagccaugacucucagggaaagaucagcggcuccccauuggauauuaccgccauccgagguucauucagugucaauuaccgggggcuccgucugagcuuaucugagauaacugcgacgugcacaggagaagugaccaacguguccggcugcuacucauguaugacuggugccaaagucaguaucaagcugcacagcuccaaaaauucuaccgcucauguuagaugcaagggcgacgagacagcauuuucggugcuagaagggguacacagcuauucagugucccucaguuucgaucacgccgucguggacgagcagugucagcugaacugcggaggccaugaaucucaaguuacccuuagggggaauuugauuuuucuggacgugcccaaguucgucgauggaagcuacaugcagacuuaucacuccacagugccuacgggcgcuaacauccccucaccaaccgacuggcucaaugcccuguuugguaacggguuaucucgcuggauucugggaguuaucggcgugcuuuugggcgggcucgcacuguucuuucuaauaaugagccuguucaaacucggaacuaagcagauuuuucggaguagaacaaaacuggcguga

SEQ ID NO: 11451 - RNA, 3222 nt, Artificial Sequence
  derived and/or modified CDS sequence (opt3) from SFTSV(HL/Larvae/G2)__KF791955.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuugcaguuccgauucaaggacgagcaguggucuguugccuucugaccggguccucuggaucggggauguggcuugucagccaaugacccccauuccugaagagacauuucuggagcugaaguccuucagccagucggaauuuccagacaucugcaaaauagauggaauuguauucaaucagugugagggcgaaucucucccgcaacccuuugacguugccuggauggaugugggccacucccauaagaucauuaugcgcgagcacaaaacuaaguggguccaggagucaaguagcaaggacuucgugugcuauaaagaagggaccggaccuuguuccgagucugaagagaagacaugcaaaaccagcgguucaugcagaggcgacaugcaguuuuguaagguggcagggugcgaacacggagaggaggccagugaagcuaaauguaggugcuccuuaguccauaagccaggcgagguugugguaagcuacggugggaugcgggugcgccccaaauguuacggcuucucucgaaugauggcaacucuggaagucucacagccugagcaaagaaucggacagugcacaggcugucaccuugaaugcaucaacgggggagugagguugauuacccugacgagugagcuaaagagcgccacuguuugugcuucccauuuuuguucuucggccaccagcgguaagaaauccacagagauacaguuccacucaggcagucucguggggaagacugcgauccacgucaaaggagcacugguggauggcaccgaguucacauuugaagguucuugcauguucccagacgggugcgaugccguagacugcaccuuuugucgggaguuccuuaagaauccccaaugcuauccggcuaaaaaguggcuguuuauuaucauaguuauuuugcucggcuacgccggacugauguuacugacgaacgugcucaaggcaaucggcgucugggggagcugggugaucgcuccugucaaacuuguguucgccauuaucaagaaacugaugcgugcgguuuccuguuugaugggaaagcuaauggaucgcgguagacaggugauucaugaagaaauaggcgagaauagggaggggaaccaggacgauguacggaucgaaauggcccgaccccgcagagucaggcacuggauguauucaccagugauucugacuauccucgcaaucggacuggcugagggcugcgacgaaaugguucaugccgauagcaaacuugugucuugucggcaggguuccgggaauaugaaggagugcgucacaaccggccgcgcucuguugccugccgugaaccccggacaagaggcaugucuccacuuuacugccccaggcagucccgacagcaagugccugaaaauuaagguaaaaagaauaaauuuaaaguguaaaaagucuuccucauacuucgugccugaugcuaggagucguugcacaagcguucggcgauguagaugggcgggggacugccagucgggaugcccaccgcauuuuaccuccaacucuuucagcgacgauugggcaggcaagauggacagggccggucugggguuuucaggauguagugauggcugcgguggcgcugccugugggugcuucaaugcagcccccuccuguaucuuuuggcgcaaaugggucgaaaacccucacggaauuaucuggaaggugucuccaugcgcugccugggugcccagcgcagucauugagcuaacgaugccuuccggcgaaguucggaccuuccacccaaugucagggauccccacacagguguucaaaggagugagcguaacuuaucucggcagugacauggaggucucuggucugaccgaucuuugugaaauagaggaguugaaguccaaaaagcuggcgcucgcuccgugcaaucaggccgggaugggagugguuggcaaagugggugaaauccaauguagcucggaggaaucagcaagaacaauuaagaaggacggcugcaucuggaacgccgaucuggucgggauugagcuuaggguggacgaugcuguuuguuacucuaaaaucacuucuguggaagccguagcaaacuauuccgcuauaccuaccacaauuggaggccugcgcuuugagcgaagccaugacucucaggggaagaucagcggauccccauuggauauuaccgccauccggggcucauucagugucaauuaccguggucucagacugagcuuaucugagauaacugcgacgugcacaggggaagugaccaacguguccggaugcuacucauguaugacuggcgccaaagucaguaucaagcugcacagcuccaaaaauucuaccgcucauguuaggugcaagggugacgagacagcauuuucggugcuagaaggcguacacagcuauucagugucccucaguuucgaucacgccgucguggacgagcagugucagcugaacugcgggggacaugaaucucaaguuacccuucgcggcaauuugauuuuucuggacgugcccaaguucgucgaugggagcuacaugcagacuuaucacuccacagugccuacgggagcuaacauccccucaccaaccgacuggcucaaugcccuguuuggcaacgguuuaucucgguggauucuggggguuaucggagugcuuuugggcggccucgcacuguucuuucuaauaaugagccuguucaaacucgggacuaagcagauuuuuagaaguaggacaaaacuggcguga

SEQ ID NO: 11452 - RNA, 3222 nt, Artificial Sequence
  derived and/or modified CDS sequence (opt3) from SFTSV(JS2011-004)__KC505124.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuuguucuuccgauucagguacgagcagugggcuguugccuucugacaggguccucuggaucggagauguggcuugccagccaaugacccccauuccugaagagacauuucuggagcugaaguccuucagccagucggaauuuccagacaucugcaaaauagauggcauuguauucaaucaguguggcggggagucucucccgcaacccuuugacguugccuggauggaugugggacacucccauaagaucauuaugcgggaacacaaaacuaaguggguccaggagucaaguagcaaggacuucgugugcuauaaagaggguaccggcccuuguuccgaaucugaggaaaagacaugcaaaaccagcgggucaugccgcggagacaugcaguuuuguaagguggcaggcugcgagcacggugaagaggccagugaggcuaaauguagaugcuccuuaguccauaagccaggggaaguugugguaagcuacggcggaaugagggugcggcccaaauguuacggcuucucucgcaugauggcaacucuggaggucaaccagccugaacaacgaaucgggcagugcacaggaugucaccuugagugcaucaaugguggcgugagauugauuacccugacgucagaacuaaagagugccacuguuugugcuagccauuuuugcuccucugccaccucggggaagaaaagcacagagauacaguuccacuccggaucacucgugggcaagacugcgauccacgucaaaggugcacugguggaugggaccgaguucacauuugaaggcaguuguauguucccagacggaugcgaugccguagacugcaccuuuuguagggaguuccuuaagaacccccaaugcuauccggcuaaaaaguggcuguuuauuaucauaguuauuuugcucggcuacgccgggcugauguuacugacgaaugugcucaaggcaaucggagucugggguucuugggugaucgcuccugucaaacuuguguucgccauuaugaagaaacugaugcgggcgguuagcuguuugaugggcaagcuaauggaucgugggcgccaggugauccaugaagagauuggagaaaacagagagggcaaucaggacgauguaaggauagagauggcccggccccgacgcgucagacacuggauguauuccccagugauccugacuauucucgcaaucggucuggcugaagggugcgacgagaugguucaugccgauucaaaacuugugagcuguaggcagggcucuggaaacaugaaggaaugcgucacaaccggccgggcucuguugccugccgugaaucccgggcaagaggcaugucuccacuuuacugccccaggaucccccgacaguaagugccugaaaaucaagguaaaacgcauuaacuuaaaguguaaaaagucgucuuccuacuucgugccugaugcuagaucaaggugcacaaguguucgucggugucgaugggcgggcgacugccagagcgguugcccaccgcauuuuaccagcaauuccuucucugacgauugggcagggaagauggacagagccggacugggcuuuagcgguuguucagauggcugcgggggagcugccuguggcugcuucaacgcagcccccaguuguauauuuuggaggaaaugggucgagaauccucacgggaucauuuggaagguguccccaugcgcugccugggugcccucugcagucaucgaacuaacgaugccuagcggagagguucgcaccuuccacccaauguccggcauucccacacagguguucaaaggugugucaguaacuuaucucgggagcgacauggaagucaguggacugaccgaucuuugugagaucgaagaguugaagucuaaaaagcuggcgcucgcuccgugcaaccaggccggcaugggugugguuggcaaagugggggagauacaauguuccagcgaagagucggcacggacaaucaagaaggacggaugcauuuggaacgccgaucuggucggcaucgaacuuagaguggacgaugcuguuuguuacucaaaaauuacuucuguggaggccguagcaaauuauagugcuaucccuaccacaauagggggacugagguuugaacgcucccaugacagccagggcaagauuucugguagcccauuggauaucaccgccauucgaggguccuucucagucaacuaccggggacuccgucugaguuuaagcgagaucacugcgacgugcacaggcgaggugaccaaugugucugguugcuacuccuguaugacuggcgccaaagucucaauaaagcugcacaguagcaaaaacuccaccgcucauguuagaugcaagggggacgaaacagcauuuucugugcuagagggaguacacucguauagcgugucacucuccuucgaucacgccgucguggacgaacagugucagcugaauugcggcgggcaugagagucacguuacccuuaagggaaacuugaucuuucuggacgugcccaaauucgucgauggcucuuacaugcaaacuuaucauagcacagugccuacgggugcuaauauucccuccccaaccgacuggcucaacgcccuguuugggaauggauuaucaagguggauccugggcguuauuggcgugcuucucgggggauuggcacuguucuuucuaaucaugucucuguucaagcucgguacuaaacaggucuuucgcagccggacaaagcuggcguga

SEQ ID NO: 11453 - RNA, 3222 nt, Artificial Sequence
  derived and/or modified CDS sequence (opt3) from SFTSV(JS2011-013-1)__KC505127.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgacugggacagugcacuggcugucaccuugaaugcaucaaugggggagugagauugaucacacugaccagcgagcuaaaguccgccacgguuugugcuucucauuucugcucgagcgccacuuccgguaagaaaucaaccgagauucaguuccacaguggcucucucguggggaagacagcgauacacgucaaaggagcacugguggauggcacugaauuuaccuucgaggguagcuguauguuuccagacgggugcgaugccguagacugcacauucuguagggaauuucuuaagaacccccaaugcuauccggcuaaaaaguggcuguucaucauuaucguuauauugcucggcuacgccggacugauguuacugaccaaugugcucaaggcaauuggcaucuggggguccugggucaucgcuccugugaaacuuauguuugccauuaucaagaaacugaugcggacggucucauguuugaugcguaagcuaauggaucgcggaagacaggugauucaugaggaaauaggugagaacagggagggcaaucaggacgauguucggaucgaaauggcgcgaccccgcagagugaggcacuggauguauagcccaguaauucugacuauccucgccaucgggcuggcagagucuugcgacgaaaugguccaugcugauuccaaacuugugaguugucggcagggaagcggcaacaugaaggagugcguuacaaccggucgcgcccuguugccugcugugaaucccgggcaagaggccugucuccacuucacugcaccaggcucucccgacuccaagugccugaaaauuaaggucaaaagaauaaacuuaaaguguaaaaagucaaguagcuacuuugugccugaugccaggucgcguugcacauccguacggcgauguagaugggcuggagacugccagucuggcugcccaccgcauuucaccagcaauucauuuagugacgauugggcggggaagauggacagggcaggacugggcuucuccgguuguucugaugggugcggaggcgccgcuugugguugcuuuaacgccgcacccagcuguaucuucuggcgcaaauggguggaaaauccucacggcauuaucuggaagguuuccccaugcgccgcuuggguccccucagccgugauugagcuaacgaugccuagcggggaagugcggaccuuccacccaaugaguggaauccccacacaggucuuuaaaggcguuucugugacuuaucucggguccgacauggaggugagcggacugaccgaucuuugugaaauagaggaguugaagucgaaaaagcuggcacucgcgccgugcaaccaggcuggcauggguguagucgggaaagugggagaaauccaauguucaucugaggaaagugccagaacaauuaagaaggacggcugcaucuggaacgcagaucugguugguauugagcuuaggguggacgaugccgucuguuacuccaaaaucacuagcguggaagcuguugccaauuauucugcaauaccuaccacaauuggcgggcugcgcuucgagcgaagccaugacucccagggaaagaucucaggcaguccauuggauauuaccgcuauccgggggagcuuuucugugaaauaccguggacucagacuguccuuaucagagauaacugccacgugcacaggcgaaguaaccaacgucagugguugcuacagcuguaugacuggggcgaagguguccaucaaacugcacucuucgaagaauagcaccgcccaugugaggugcaagggagacgagacagcuuucucaguccuagaaggcggucacuccuauaccguuagucucucuuuugaucacgcagugguagacgagcagugucagcugaacugcggcgggcaugaaagccaagugacucuuaaaggaaauuugauuuuccuggacguccccaaguuuguggauggcuccuacaugcagacauaucacucaacgguuccuaccggggccaacauccccucuccaacugacuggcucaaugcucuguucggaaacggcuuaagccgcuggauucugggugugaucgggguccuuuugggaggccucgcccuguuuuucaugauaaugagucuauuuaaacugggcacaaaacagguguuccgguccagaaccaagcucgcauga

SEQ ID NO: 11454 - RNA, 3222 nt, Artificial Sequence
  derived and/or modified CDS sequence (opt3) from SFTSV(JS2011-027)__KC505130.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuugcaguuccgauucagguacgagcagugggcuguugccuucugacaggguccucuggaucggagauguggcuugucagccaaugacccccauuccugaagagacauuucuggagcugaaguccuucagccagucggaauuuccagacaucugcaaaauagauggcauuguauucaaucagugugagggcgaaucucucccgcaacccuuugacguugccuggauggauguggggcacucccauaagaucauuaugcgggagcacaaaacuaaguggguccaggagucaaguagcaaggacuucgugugcuauaaagaaggaaccgguccuuguuccgagucugaagagaagacaugcaaaaccagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacucuggaagucaacgagccugaacagcgaaucggccaaugcacagggugucaccuugagugcaucucaggaggugugagauugauuacccugacgagugagcuaaagagcgccacuguuugugcuucccauuuuuguucuucggccaccagcggcaagaaauccacagaaauacaguuccacucagggagucucgugggaaagacugcgauccacgucaaaggcgcacugguggaugguaccgaguucacauuugaagggucuugcauguucccagacggcugcgaugccguagacugcaccuuuuguagggaguuccuuaagaauccccagugcuauccggcuaaaaaguggcuguuuauuaucauaguuauuuugcucggauacgccggccugauguuacugacgaacgugcucaaggcaaucggggucuggggaagcugggugaucgcuccugucaaacuuguguucgccauuaucaagaaacugaugcgggcgguuuccuguuugauggguaagcuaauggaucguggccgccaagugauucaugaagagauaggggagaauagagaaggaaaccaggacgauguaaggaucgagauggcccggccccgacgcgucagacacuggauguauucaccagugauucugacuauccucgcaaugggccuggcugaagguugcgacgagaugguucaugccgauagcaaacuugugucuuguaggcagggguccggcaauaugaaggagugcgucacaaccggacgggcucuguugccugccgugaaccccggccaggaagcaugucuccacuuuacugccccagggagucccgacagcaagugccugaaaaucaagguaaaacgcauuaauuuaaaguguaaaaagucuuccucauacuucgugccugaugcuagaaguaggugcacaagcguucgucggugucgaugggcgggagacugccaaucgggcugcccaccgcauuuuaccuccaacucuuucagcgacgauugggcagguaagauggacagagccgggcugggauuuucaggcuguagugaugguugcggcggggcugccuguggaugcuucaaugcagcccccuccuguauauuuuggaggaaaugggucgagaacccucacggcaucauuuggaaggugucuccaugcgcugccugggugcccagcgcagucaucgaacuaacgaugccuuccggggagguucgcaccuuccacccaaugucaggcauucccacacagguguucaaaggagugagcguaacuuaucucgguagugacauggaagucucugggcugaccgaucuuugugagaucgaggaauugaaguccaaaaagcuggcgcucgcuccgugcaaucaggccggaaugggcgugguugguaaagugggcgagauacaguguagcucggaagagucagcacggacaaucaagaaggacgggugcauuuggaacgccgaucuggucggaaucgaacuuagaguggacgaugcuguuuguuacucuaaaauuacuucuguggaggccguagcaaacuauuccgcuaucccuaccacaauaggcgggcugagguuugagcgcagccaugacucucaaggaaagauuagcggcuccccauuggauaucaccgccauucgagguucauucaguaucaauuaccgggggcuccgucugagcuuaucugaaauaacugcgacgugcacaggagaggucaccaacguguccggcugcuacucauguaugacuggugccaaagugaguaucaagcugcacagcuccaaaaauucuaccgcucaugucagaugcaagggcgacgaaacagcauuuucgguucuagagggggugcacagcuauucaguaucccucaguuucgaucacgccguggucgacgaacagugucagcugaacugcggaggccaugagucucaggugacccuuagggggaauuugauuuuucuggacguucccaaguucguggauggaagcuacaugcaaacuuaucacuccacagucccuacgggcgcuaacauccccucaccaaccgacuggcucaaugcccuguuugguaacggguuaucucgcuggauucugggagugaucggcguucuuuugggcgggcucgcacuguucuuucuaauaaugagccuguucaaacucggaacuaaacagguguuucggaguagaacaaagcuggcguga

SEQ ID NO: 11455 - RNA, 3222 nt, Artificial Sequence
  derived and/or modified CDS sequence (opt3) from SFTSV(JS2011-034)__KC505133.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugaggauccggcccaaauguuacggcuuuagucgcaugauggcaaccuuagaagugaaccagccugagcaacgaaucggacagugcacuggcugucaccuggaaugcauuaaugggggagucagacuuauaacauugaccagcgagcugaaguccgccacggugugugcuucucauuucugcucgagcgccacuuccgguaagaaaucaaccgagauccaguuccacaguggcucucuaguugggaagacagcgauucacgugaaaggagcacucgucgauggcacugaauuuaccuucgaggguagcuguauguuuccagacgggugcgaugccguggacugcacauucuguagggaauuucugaagaacccccaaugcuauccggcuaaaaaguggcuuuucaucauaauuguaauccuguugggcuacgccggacucaugcuguuaaccaauguucugaaggcaaucggcauuuggggguccugggugaucgcuccugucaaacucauguuugccauuauaaagaaacuuaugcggacggugucaugucugaugggaaaguugauggaucguggucgccaggucauccaugaggaaauuggcgagaacagagaggggaaucaggacgaugugaggaucgaaauggcgcggccccgacgcguuagacacuggauguauagcccagugauccuaacuuuccuggccauuggacucgcagagucuugcgacgaaaugguacaugcugauuccaaacuggucaguuguaggcagggcagcgguaacaugaaggagugcgugacaaccgggcgggcccuucugccugcuguuaaucccggccaagaggccuguuugcacuuuacugcaccaggaucucccgacuccaagugccucaaaauaaaggugaaacgcaucaaccugaaguguaaaaagucaaguagcuacuucgucccugaugccagaucgaggugcacauccgugcgucggugucgaugggcuggcgacugccagucugggugcccaccgcauuuuaccagcaauucauucagugacgauugggcgggaaagauggacagagcaggcuuagguuuuuccuguugcucugauggguguggaggcgccgcuugcgguuguuucaacgccgcacccagcugcauuuucuggaggaaauggguagaaaauccucacggcaucauuuggaagguguccccaugugccgcuuggguucccucagccgucaucgagcugacgaugccuagcggggaagugcgcaccuuucacccaaugaguggaauacccacacagguguucaaaggcgucucuguuacuuaucuaggguccgacauggaggugagcggacucaccgaucugugcgaaaucgaggagcuuaagucgaaaaaguuggcacuggcgccguguaaccaggcuggcaugggugugguagggaaagucggagaaauucaaugcucaucugaggaaagugcccggacaaucaagaaggacggcuguauuuggaacgcagaucucguggguaucgagcugagaguugacgaugccgugugcuacuccaaaauaacuagcgucgaagcuguggccaauuauucugcaauuccuaccacaaucggcgggcuuagguuugagcgcagccaugacucccagggaaagauuucaggcaguccacuggauaucaccgcuauacgagggagcuucucuguuaacuaccggggauugcgucucucccugucagagaucacugccacgugcacaggcgaagugaccaauguaagugguuguuacagcugcaugacuggggcgaaagucuccauuaaguuacacucuucgaaaaacagcaccgcccaugugagauguaagggagacgagacagcuuuuucagugcuggaaggcguccacuccuauaccguuagucuaucuuucgaucacgcagugguagacgagcagugccagcucaauugugguggccaugaaagccaagugacucugaaggggaaccuuaucuuuuuggacguccccaaauucguggauggauccuacaugcagacauaucacucaacgguuccuaccggcgccaauauucccucuccaacugacuggcugaacgcucucuuugggaauggacugaguagguggaucuuaggcgugauagguguccugcuugggggauuggcccucuucuuuaugauuaugagccugcuaaagcugggcacaaaacagguguaccgcucccggaccaagcucgcauga

SEQ ID NO: 11456 - RNA, 3222 nt, Artificial Sequence
  derived and/or modified CDS sequence (opt3) from SFTSV(JS2011-062)__KC505136.1__GP
augaugaaggugaucugguucagcucccugauuugccucgucauacaguguucuggcgacucagggcccaucauuugcgccggaccuauccacaguaacaagagcgcugauauuccacaucuucuggguuacuccgagaagaucugucaaauagacagauugauccacguuucuucgugguuaaggaaucauucacaguuucagggcuauguggggcagcggggaggccgcagccaaguaaguuacuauccggcagugaacuccuacucucgauggagcggucugcuaucccccugcgaugccgacuggcucgggaugcuggucgugaaaaaggcgaaaggaucagauaugauuguuccuggcccaaguuauaagggcaagguguucuuugaacgucccaccuucgacggguacgucggaugggguuguggcagcgggaaaucuagaacagaguccggagaacuuugcucaagcgauaguggcacuucuuccggucuguugccuagcaauagggugcucuggaucggggacguagcuugucagccaaugacgcccauuccugaggaaaccuuucuggagcugaagucguucucucaguccgaguuuccagauaucugcaaaauagacggaauuguuuucaaccagugugaaggcgagucacucccgcaacccuuugauguggccuggauggacgucggccacagucauaagaucauuaugcgggaacacaaaacaaagugggugcaggagagcuccucuaaggauuucgugugcuauaaagaggggacuggaccuuguagcgaaucagaggaaaaggcaugcaaaaccagugguuccugccgcggcgacaugcaguuuuguaaggucgccgggugcgagcacggagaagaggcuagcgaggcaaaauguagaugcucuuuaguucauaagccaggcgaagugguagugucauacggugggaugaggguccggcccaaauguuacggcuucagucgcaugauggccacacuggaggugaauccuccagaacagcgaaucggacaaugcaccggcugucaccuugagugcaucaacgggggaguuagauugauuacucugacaagcgaacuaaaguccgcuaccgugugugccucucauuuuugcucgagcgcgacguccgguaagaaaucaacugagauacaguuccacaguggcucucucgucgggaagaccgcaauccacgugaaaggagcccugguagacggcacagaguucacuuuugaagguagcuguauguuccccgaugggugcgacgcuguugauugcaccuuuuguagggaguuccuuaagaauccgcagugcuauccugccaaaaaguggcuguuuauuaucauagugauuuugcucggcuacgcaggacugauguuacugacaaacguccucaaggcuaucggcguguggggguccugggucaucgcccccgugaaacuuauguucgcgauuaugaagaaacugaugcggaccguuucauguuugaugggaaagcuaaucgaccguggucgccaagugauucaugaagagauaggcgaaaauggggagggaaacagagaugacguaaggaucgagauggcccggccacgacgcgucagacacuggauguauagcccugugauucugacgauccucgcaaucggccuggcugaagguugcgaugagaugguucaugccgacucuaaacuuguguccuguaggcaggggaguggcaauaugaaggaaugcgucacuacaggacgggcucuguugcccgccgugaacccaggccaggaggcaugucuccacuuuaccgcccccgggagcccugauucuaagugccugaaaauuaagguaaaacgcauaaauuuaaaguguaaaaaguccucaaguuacuucgugccagacgcuagaucgaggugcacuagcguucgucggugucgaugggcgggagauugccaguccggcugcccgccccauuuuacaucuaacagcuucucagacgacugggcagguaagauggauagagccgggcugggauuuaguggcuguuccgacgguugcggcggggcugccuguggaugcuucaaugcagccccuucuuguaucuuuuggaggaaaugggucgagaacccacacggcauuaucuggaaggugagccccugcgcugccugggugccuuccgcagucauugaacuaaccaugccaucaggggagguucgcacguuccaccccaugagcggaaucccgacccaaguguucaaaggcgugaguguaacauaucucgguucugauauggaagucuccgggcugacugaccuuugugagauagaagaguugaaaagcaagaagcuggcgcucgcuccuugcaaccaggccggaaugggcgugguugguaaagugggcgagauccaguguucgucagaagagucugcacggaccauuaagaaggaugggugcaucuggaaugccgaccuggucggaauugaacuuagaguggaugacgcuguuuguuacaguaaaaucacauccguggaggccguagcaaacuauagcgcuauaccaacuaccauuggcgggcugagguuugaacgcucucaugauagccagggaaagaucuccggcucacccuuggacauuacagccauccgagguaguuucagcgucaauuaccgggggcuccgucugucuuuauccgagauaaccgcgacuugcacgggagaggugacaaacgugucaggcugcuacaguuguaugaccggugccaaagucagcaucaagcugcacuccucuaaaaauucgacugcucauguuagaugcaagggcgaugaaaccgcauuuagcgugcuagaggggguacacucauauacagugucccucaguuucgaccacgccgucguggaugaacaaugucagcugaacugcggaggccaugagucucagguuacccuuaaggggaauuugauuuuucuggacgugccuaaauucgucgacggaagcuacaugcagacuuaucacuccacagugcccacgggcgcuaacaucccaucaccuaccgauuggcucaaugcccuguuugguaacggguuaucuagguggauucugggacuuaucggcguuuugcucggcgggcuggcacuauucuuucugauaaugagccucuucaagcugggaacuaaacaaguguuucgcagucggacaaaacuugcguga

SEQ ID NO: 11457 - RNA, 3222 nt, Artificial Sequence
  derived and/or modified CDS sequence (opt3) from SFTSV(JS2011-109)__KC505139.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuuguucuuccgauucagguacgagcagugggcuguugccuucugacaggguccucuggaucggagauguggcuugccagccaaugacccccauuccugaagagacauuucuggagcugaaguccuucagccagucggaauuuccagacaucugcaaaauagauggcauuguauucaaucagugugagggcgaaucucucccgcaacccuuugacguugccuggauggauguggggcacucccauaagaucauuaugcgggagcacaaaacuaaguggguccaggagucaaguagcaaggacuucgugugcuauaaagaaggaaccgguccuuguuccgagucugaagagaagacaugcaaaaccagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacucuggaagucaaccagccugagcaacgaaucggccagugcacagggugucaccuugaaugcaucaauggaggugugagauugauuacccugacgucagagcuaaagagugccacuguuugugcuagccauuuuugcuccucugccaccucgggcaagaaaagcacagagauacaguuccacuccgggucacucgugggaaagacugcgauccacgucaaaggcgcacugguggaugguaccgaguucacauuugaagggaguuguauguucccagacggcugcgaugccguagacugcaccuuuuguagggaguuccuuaagaacccccaaugcuauccggcuaaaaaguggcuguuuauuaucauaguuauuuugcucggauacgccggccugauguuacugacgaaugugcucaaggcaaucggggucuggggaucuugggugaucgcuccugucaaacuuguguucgccauuaucaagaaacugaugcgggcgguuagcuguuugauggguaagcuaauggaucguggccgccaggugauucaugaagaaauaggggagaacagagagggaaaucaggacgauguaaggaucgaaauggcccggccccgacgcgucagacacuggauguauuccccagugauucugacuauccucgcaaucggccuggcugaggguugcgacgaaaugguucaugccgauucaaaacuugugagcuguaggcaggggucuggcaacaugaaggagugcgucacaaccggacgggcucuguugccugccgugaaucccggccaagaggcaugucuccacuuuacugccccagggucccccgacaguaagugccugaaaauuaagguaaaacgcauaaacuuaaaguguaaaaagucgucuuccuacuucgugccugaugcuagaucaaggugcacaaguguucgucggugucgaugggcgggagacugccagagcggcugcccaccgcauuuuaccagcaauuccuucucugacgauugggcagguaagauggacagagccgggcugggauuuagcggcuguucagaugguugcggcggggcugccuguggaugcuucaacgcagcccccaguuguaucuuuuggaggaaaugggucgaaaauccucacggcauuaucuggaagguguccccaugcgcugccugggugcccucugcagucauugagcuaacgaugccuagcggggaaguucgcaccuuccacccaauguccggaauccccacacagguguucaaaggcgugucaguaacuuaucucgguagcgacauggaggucagugggcugaccgaucuuugugaaauagaggaguugaagucuaaaaagcuggcgcucgcuccgugcaaccaggccggaaugggcgugguugguaaagugggcgaaauccaauguuccagcgaggaaucggcacggacaauuaagaaggacgggugcaucuggaacgccgaucuggucggaauugagcuuagaguggacgaugcuguuuguuacucaaaaaucacuucuguggaagccguagcaaauuauagugcuauaccuaccacaauuggcgggcugagguuugagcgcucccaugacagccagggaaagaucucuggcagcccauuggauauuaccgccauccgagguuccuucucagucaacuaccgggggcuccgucugaguuuaagcgagauaacugcgacgugcacaggagaagugaccaaugugucuggcugcuacuccuguaugacuggugccaaagucucaaucaagcugcacaguagcaaaaacuccaccgcucauguuagaugcaagggcgacgagacagcauuuucugugcuagaagggguacacucguauagcgugucacucuccuucgaucacgccgucguggacgagcagugucagcugaauugcggaggccaugaaagucacguuacccuuagggggaacuugauuuuucuggacgugcccaaguucgucgauggaucuuacaugcaaacuuaucauagcacagugccuacgggcgcuaauauccccuccccaaccgacuggcucaacgcccuguuugguaauggguuaucacgcuggauucugggaguuaucggcgugcuuuugggcgggcucgcacuguucuuucuaauaaugucucuguucaaacucggaacuaagcaggucuuucggagcagaacaaaacuggcguga

SEQ ID NO: 11458 - RNA, 3222 nt, Artificial Sequence
  derived and/or modified CDS sequence (opt3) from SFTSV(JS2011-13-2)__KR230770.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuuguucuuccgauucagguacgagcagugggcuguugccuucugacaggguccucuggaucggagauguggcuugccagccaaugacccccauuccugaagagacauuucuggagcugaaguccuucagccagucggaauuuccagacaucugcaaaauagauggcauuguauucaaucagugugagggcgaaucucucccgcaacccuuugacguugccuggauggauguggggcacucccauaagaucauuaugcgggagcacaaaacuaaguggguccaggagucaaguagcaaggacuucgugugcuauaaagaaggaaccgguccuuguuccgagucugaagagaagacaugcaaaaccagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacucuggaagucaaccagccugagcaacgaaucggccagugcacagggugucaccuugaaugcaucaauggaggugugagauugauuacccugacgucagagcuaaagagugccacuguuugugcuagccauuuuugcuccucugccaccucgggcaagaaaagcacagagauacaguuccacuccgggucacucgugggaaagacugcgauccacgucaaaggcgcacugguggaugguaccgaguucacauuugaagggaguuguauguucccagacggcugcgaugccguagacugcaccuuuuguagggaguuccuuaagaacccccaaugcuauccggcuaaaaaguggcuguuuauuaucauaguuauuuugcucggauacgccggccugauguuacugacgaaugugcucaaggcaaucggggucuggggaucuugggugaucgcuccugucaaacuuguguucgccauuaucaagaaacugaugcgggcgguuagcuguuugauggguaagcuaauggaucguggccgccaggugauucaugaagaaauaggggagaacagagagggaaaucaggacgauguaaggaucgaaauggcccggccccgacgcgucagacacuggauguauuccccagugauucugacuauccucgcaaucggccuggcugaggguugcgacgaaaugguucaugccgauucaaaacuugugagcuguaggcaggggucuggcaacaugaaggagugcgucacaaccggacgggcucuguugccugccgugaaucccggccaagaggcaugucuccacuuuacugccccagggucccccgacaguaagugccugaaaauuaagguaaaacgcauaaacuuaaaguguaaaaagucgucuuccuacuucgugccugaugcuagaucaaggugcacaaguguucgucggugucgaugggcgggagacugccagagcggcugcccaccgcauuuuaccagcaauuccuucucugacgauugggcagguaagauggacagagccgggcugggauuuagcggcuguucagaugguugcggcggggcugccuguggaugcuucaacgcagcccccaguuguaucuuuuggaggaaaugggucgaaaauccucacggcauuaucuggaagguguccccaugcgcugccugggugcccucugcagucauugagcuaacgaugccuagcggggaaguucgcaccuuccacccaauguccggaauccccacacagguguucaaaggcgugucaguaacuuaucucgguagcgacauggaggucagugggcugaccgaucuuugugaaauagaggaguugaagucuaaaaagcuggcgcucgcuccgugcaaccaggccggaaugggcgugguugguaaagugggcgaaauccaauguuccagcgaggaaucggcacggacaauuaagaaggacgggugcaucuggaacgccgaucuggucggaauugagcuuagaguggacgaugcuguuuguuacucaaaaaucacuucuguggaagccguagcaaauuauagugcuauaccuaccacaauuggcgggcugagguuugagcgcucccaugacagccagggaaagaucucuggcagcccauuggauauuaccgccauccgagguuccuucucagucaacuaccgggggcuccgucugaguuuaagcgagauaacugcgacgugcacaggagaagugaccaaugugucuggcugcuacuccuguaugacuggugccaaagucucaaucaagcugcacaguagcaaaaacuccaccgcucauguuagaugcaagggcgacgagacagcauuuucugugcuagaagggguacacucguauagcgugucacucuccuucgaucacgccgucguggacgagcagugucagcugaauugcggaggccaugaaagucacguuacccuuaaggggaacuugauuuuucuggacgugcccaaauucgucgauggaucuuacaugcaaacuuaucauagcacagugccuacgggcgcuaauauccccuccccaaccgacuggcucaacgcccuguuugguaauggguuaucaagguggauucugggaguuaucggcgugcuuuugggcgggcucgcacuguucuuucuaauaaugucucuguucaagcucggaacuaaacaggucuuucgcagccggacaaagcuggcguga

SEQ ID NO: 11459 - RNA, 3222 nt, Artificial Sequence
  derived and/or modified CDS sequence (opt3) from SFTSV(JS2011-69)__KR230771.1__GP
augaugaaggugaucugguucagcucccuggucugccucguuauucaguguucuggcgacaccgggcccauaaucugcgccggaccuauucacucaaacaaaagugcuaauaucccacaucuucuggguuacagcgagaagauuugucaaaucgauagauugauacacguguccucuugguuaaggaaccauucgcaguuucagggcuauguagggcagcggggaggccgcucacaagugagcuacuauccggcagaaaauaguuacucccgauggucuggucugcuaagccccugcgacgccgauuggcucgggaugcuggucgugaaaaaggcgaaaggauccgacaugaucguuccuggcccaucauauaagggcaagguguucuuugagcgucccacauucgauggguacgucggaugggguuguggcagugggaaaagcagaacugaaucuggagagcuuugcuccucagacagcggcacgaguucuggucuguugccuuccgauagggugcucuggauuggggacguagcuugucagccaaugacccccaucccugaagagacauuucuggagcucaagagcuucucgcagucugaauuuccagauauuugcaaaaucgacggaauaguuuucaaccagugugauuccgagucacugccgcaacccuuugacguggccuggauggaugucggccacagucauaagauuaucaugcgggaacacaaaacuaagugggugcaggagagcuccucuaaggacuucgugugcuauaaagagggcaccgggccuuguagcgaaucagaggaaaagacaugcaaaaccaguggauccugccgcggugacaugcaguuuuguaaggucgcaggcugcgagcacggggaagaggccagcgaggcuaaauguagaugcucuuuaguucauaagccaggagaagugguagugucauacggcgguaugaggguccggcccaaauguuacggguucagucgcaugauggcaacucuggaggugaauccuccagaacagcgaauuggccaaugcacaggaugucaccuugagugcaucaacggcgggguuagauugaucacccugacgagcgaacuaaaguccgccacugugugugcuucucauuuuugcucgagcgccaccuccggaaagaaaucaacagagauucaguuccacagugguucucucgucggcaaggcggcaauacacgugaaaggggcccugguagauggaacugaguucaccuuugaaggcagcuguauguuccccgacgguugcgaugcuguugacugcacauuuuguagggaguuccuuaagaauccgcagugcuauccugccaaaaaguggcuguuuaucauuaucgugauauugcucggguacgcaggccugauguuacugaccaacguccucaaggcuauuggaguguggggcuccugggucauggcccccgugaaacuuauguucgcgaucaucaagaaacugaugcggucaguuagcuguuugauggggaagcuaauggaucguggacgccaagugauucaugaagagaucggugaaaauagagagggcaaccaggacgauguaaggauugagauggcccggccacgacgcgucagacacuggauguauucuccugugauacugacgauccucgcaauugggcuggcugaaggaugcgacgagaugguucaugccgauuccaaacuugugaguuguaggcagggcagcgguaauaugaaggaaugcgucacuacagggcgggcucuguugcccgccgugaacccaggccaggaggcaugucuccacuuuaccgcccccggaucuccugacuccaagugccugaaaaucaagguaaaacgcaucaauuuaaaguguaaaaagucaaguagcuacuucgugccagaugcuagaucgaggugcacuuccguucgucggugucgaugggcgggcgacugccaaucugggugcccgagccauuuuacaucaaacaguuucuccgacgauugggcaggaaagauggacagagccggccuggguuuuucuggguguagcgauggaugcggcggugcugccuguggcugcuucaaugcagcccccuccuguauauuuuggaggaaaugggucgagaacccucacgggauuaucuggaaggugucaccaugcgcugccugggugcccagcgcagucauugaacuaaccaugccuaguggagagguucgcacguuccacccaaugucuggcauccccacccagguguucaaagggguguccguaacauaucucggaagcgacauggaagucucgggccugacugaucuuugugagauugaagaguugaagucuaaaaagcuggcgcucgcuccgugcaaccaggccgguaugggggugguuggaaaagugggcgagauccaguguucaagugaagaguccgcacggaccauaaagaaggacgguugcaucuggaaugccgaucuggucggcauugaacuuagaguggacgaugcuguuuguuacagcaaaaucacaucuguggaggccguagcaaacuauagcgcuauuccuacuaccaucgggggacugagguuugaacgcucccaugacucacaaggcaagauaagugggagcccauuggauauuacagccguccgaggaucuuucuccgugaauuaccggggccuccgucugucauuaagugagaucaccgcgacuugcacgggugaggugacaaacgucagcgggugcuacuccuguaugaccggagccaaaguuucuauuaagcugcacucgagcaaaaauucaacugcucaugugagaugcaagggcgacgaaaccgcauuuuccguacuagagggugugcacaguuauacagucucucucagcuucgaucacgccgugguugacgaacagugucagcugaacugcggcgggcaugagucccaggugacccuuaagggaaauuugaucuuucuggacguccccaaauucguggauggcucauacaugcaaacuuaucacucuagcguuccuacaggggcuaacauacccaguccaacggacuggcucaaugcccuguuuggaaacggcuuauccagguggauccugggugugauugggguccuuuugggaguacucgcacuguucuuucuaaucaugagccuguucaagcucggcaccaaacagguguuucgcucucggacuaagcuggcguga

SEQ ID NO: 11460 - RNA, 3222 nt, Artificial Sequence
  derived and/or modified CDS sequence (opt3) from SFTSV(JS2012-020)__KC505142.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuuguucuuccgauucagguacgagcagugggcuguugccuucugacaggguccucuggaucggagauguggcuugccagccaaugacccccauuccugaagagacauuucuggagcugaaguccuucagccagucggaauuuccagacaucugcaaaauagauggcauuguauucaaucaguguggcggggagucucucccgcaacccuuugacguugccuggauggaugugggacacucccauaagaucauuaugcgggaacacaaaacuaaguggguccaggagucaaguagcaaggacuucgugugcuauaaagaggguaccggcccuuguuccgaaucugaggaaaagacaugcaaaaccagcgggucaugccgcggagacaugcaguuuuguaagguggcaggcugcgagcacggugaagaggccagugaggcuaaauguagaugcuccuuaguccauaagccaggggaaguugugguaagcuacggcggaaugagggugggccccaaauguuacggguucucucggaugauggcaacucuggaggucaaccagccugaacaacgcaucggacagugcacagguugucaccuugagugcaucaauggcggggugcgauugauuacccugacgucagaacuaaagagugccacuguuugugcuagccauuuuugcuccucugccaccucgggaaagaaaagcacagagauacaguuccacuccggcucacucguggguaagacugcgauccacgucaaaggggcacugguggauggcaccgaguucacauuugaaggaaguuguauguucccagacggcugcgaugccguagacugcaccuuuuguagagaguuccuuaagaacccccaaugcuauccggcuaaaaaguggcuguuuauuaucauaauuaucuugcucggguacgccggacugauguuacugacgaauguucucaaggcaaucgguguguggggcucuugggucauugcuccugugaaacuugucuucgccaucauuaagaaacugaugagggcggugagcuguuugauggggaagcuaauggaucggggacgucagguuauacaugaagagaucggcgaaaaccgcgaggguaaucaggacgaugugagaauugagauggccaggccccggcgaguacgccacuggauguauuccccagucauccugacuauccucgcaauugggcuggcugaaggcugcgacgagauggugcaugccgauucaaaacuuguuagcuguagacagggaucuggcaacaugaaggaaugcgugacaaccgggagggcucuguugccugccgucaaucccggacaagaggcaugucuccacuuuacugccccaggcucccccgacaguaagugccugaaaauaaaggugaaacggaucaacuuaaaguguaaaaagucgucuuccuacuucguaccugaugcucgcucaagaugcacaagugugaggcguugucggugggcgggugacugccagagcgggugcccaccgcauuuuaccagcaauuccuucucugacgauugggcaggaaagauggaccgagccggccuggguuuuagcggcuguucagaugggugcggaggcgcugccugugggugcuucaacgcagcccccaguuguaucuuuuggagaaaauggguugagaauccucacggaauuauuuggaaggucuccccaugcgcugccugggugcccucugcagugaucgaacuaacgaugccuagcggcgaggucaggaccuuccacccaauguccgguauacccacacagguuuucaaaggggugucagugagcuaucucggaagugacauggaaguaucuggccugacugaucuuugugagaucgaagaguugaaguccaaaaagcuggcgcucgcuccgugcaaccaggccgguaugggcgucguggggaaaguuggagagauucaauguagcucggaagagucagcacgcaccaucaagaaggacggcugcauuuggaacgccgaucugguggggaucgaacuucgggucgacgaugcuguguguuacucuaaaauaacaaguguugaggccguggcaaauuauuccgcuauuccuacuaccaucggaggccugagauuugaaaggagccaugacucucaggguaagauuagcggguccccauuggauaucacagccauacgcggaucauucaguguaaacuaccgaggccuccggcugagcuuaucugagaucaccgcgacuugcacgggugaggucacaaauguguccggcugcuacucauguaugaccggggccaaagugaguauuaagcugcacagcuccaaaaacucuacugcucauguccguugcaagggagacgaaaccgcauuuucgguucuagagggcgugcacagcuauucaguaucccucaguuucgaucacgccguggucgacgaacagugucagcugaauugcgggggacaugagucucacgugacacuuaagggcaacuugaucuuucuggacguucccaaauucguggaugguagcuacaugcaaaccuaucauuccacugucccuacaggggcuaauauucccucaccaacggacuggcucaacgcccuguuuggaaauggcuuaucuagauggauccugggcgugauagggguucuuuugggaggucucgcacuguucuuucuaauuaugagccuguucaagcucggcaccaaacagguguuuaggagucgcacuaagcuggcguga

SEQ ID NO: 11461 - RNA, 3222 nt, Artificial Sequence
  derived and/or modified CDS sequence (opt3) from SFTSV(JS2012-035)__KC505145.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuuguucuuccgauucagguacgagcagugggcuguugccuucugacaggguccucuggaucggagauguggcuugccagccaaugacccccauuccugaagagacauuucuggagcugaaguccuucagccagucggaauuuccagacaucugcaaaauagauggcauuguauucaaucagugugagggcgaaucucucccgcaacccuuugacguugccuggauggauguggggcacucccauaagaucauuaugcgggagcacaaaacuaaguggguccaggagucaaguagcaaggacuucgugugcuauaaagaaggaaccgguccuuguuccgagucugaagagaagacaugcaaaaccagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacucugggcgucaaccagccugaacaacgaaucgggcagugcacaggaugucaccuugagugcaucaaugguggcgugagauugauuacccugacgucagaacuaaagagugccacuguuugugcuagccauuuuugcuccucugccaccucggggaagaaaagcacagagauacaguuccacuccggaucacucgugggcaagacugcgauccacgucaaaggugcacugguggaugggaccgaguucacauuugaaggcaguuguauguucccagacggaugcgaugccguagacugcaccuuuuguagggaguuccuuaagaacccccaaugcuauccggcuaaaaaguggcuguuuauuaucauaguuauuuugcucggcuacgccgggcugauguuacugacgaaugugcucaaggcaaucggagucugggguucuugggugaucgcuccugucaaacuuguguucgccauuaucaagaaacugaugcgggcgguuagcuguuugaugggcaagcuaauggaucgugggcgccaggugauucaugaagagauaggagaaaacagagagggcaaucaggacgauguaaggaucgagauggcccggccccgacgcgucagacacuggauguauuccccagugauucugacuauccucgcaaucggucuggcugaagggugcgacgagaugguucaugccgauucaaaacuugugagcuguaggcagggcucuggaaacaugaaggaaugcgucacaaccggccgggcucuguugccugccgugaaucccgggcaagaggcaugucuccacuuuacugccccaggaucccccgacaguaagugccugaaaauuaagguaaaacgcauaaacuuaaaguguaaaaagucgucuuccuacuucgugccugaugcuagaucaaggugcacaaguguucgucggugucgaugggcgggcgacugccagagcgguugcccaccgcauuuuaccagcaauuccuucucugacgauugggcagggaagauggacagagccggacugggcuuuagcgguuguucagauggcugcgggggagcugccuguggcugcuucaacgcagcccccaguuguaucuuuuggaggaaaugggucgagaauccucacgggauuaucuggaagguguccccaugcgcugccugggugcccucugcagucauugaacuaacgaugccuagcggagagguucgcaccuuccacccaauguccggcauccccacacagguguucaaaggugugucaguaacuuaucucgggagcgacauggaagucaguggacugaccgaucuuugugagauagaagaguugaagucuaaaaagcuggcgcucgcuccgugcaaccaggccggcaugggugugguuggcaaagugggggagauccaauguuccagcgaagagucggcacggacaauuaagaaggacggaugcaucuggaacgccgaucuggucggcauugaacuuagaguggacgaugcuguuuguuacucaaaaaucacuucuguggaggccguagcaaauuauagugcuauaccuaccacaauugggggacugagguuugaacgcucccaugacagccagggcaagaucucugguagcccauuggauauuaccgccauccgaggguccuucucagucaacuaccggggacuccgucugaguuuaagcgagauaacugcgacgugcacaggcgaggugaccaaugugucugguugcuacuccuguaugacuggcgccaaagucucaaucaagcugcacaguagcaaaaacuccaccgcucauguuagaugcaagggggacgaaacagcauuuucugugcuagagggaguacacucguauagcgugucacucuccuucgaucacgccgucguggacgaacagugucagcugaauugcggcgggcaugagagucacguuacccuuaggggaaacuugauuuuucuggacgugcccaaguucgucgauggcucuuacaugcaaacuuaucauagcacagugccuacgggugcuaauauccccuccccaaccgacuggcucaacgcccuguuugggaauggauuaucacgcuggauucugggcguuaucggcgugcuucucgggggauuggcacuguucuuucuaauaaugucucuguucaaacucgguacuaagcaggucuuucggagcagaacaaaacuggcguga

SEQ ID NO: 11462 - RNA, 3222 nt, Artificial Sequence
  derived and/or modified CDS sequence (opt3) from SFTSV(JS2012-79)__KR230772.1__GP
augaugaaggugaucugguucagcucccugaccugcuuugucauucaguguucuggcgacucagggcccauaaucugcgccggaccuauucacaguaacaaaagcgcugauaucccacaucuccuugguuacuccgagaagauuugucaaaucgacagacugauacacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugaucgugccuggcccaaguuauaagggcaagguuuucuucgagcgucccacauuugacggguacgugggaugggguuguggcagcgggaaaucuagaacugaauccggagagcugugcucaagcgauaguggcacgucuuccggucuucugccuagcgacagggucuuguggauuggggauguggcuugucagccaaugacccccaucccugaagagacauuccucgagcugaagucguuuucucaguccgaauuuccagacauuugcaaaaucgauggaauaguauuuaaucagugugagggcgaaucacugccgcaacccuucgacguugccuggauggaugugggccacagucauaagauuaucaugcgggagcacaaaacuaaguggguccaggagagcuccucuaaggacuuugugugcuauaaagaagggaccggaccuuguagcgagucagaagagaagacaugcaaaaccagugguuccugccgcggcgacaugcaguucuguaagguggcagggugcgaacacggagaggaggccagcgaagcuaaauguagaugcucucucguccauaagccaggcgagguugugguaucauacggugggaugaggauucggcccaaauguuacggcuuuagucgcaugauggcaacuuuagaagugaaccagccugagcaacgacugggacagugcacaggcugucaccuugaaugcaucaaugggggagucagauugaucacccugacgagcgagcuaaaguccgccacugugugugcuucucauuucugcucgagcgccaccuccgguaagaaaucaacagagauucaguuccacaguggcucucucguugggaagacugcgauacacgugaaaggagcacuggucgauggcaccgaauuuacauucgaggguagcuguauguuuccagacgggugcgaugccguggacugcaccuucuguagggaauuucuuaagaacccccaaugcuauccggcuaaaaaguggcuguucaucauuaucguaauauugcucggcuacgccggacugauguuacugacgaauguucucaaggcaauuggcaucuggggguccugggugaucgcuccugucaaacuuauguuugccauuaucaagaaacugaugcggacugugucauguuugaugcguaagcuaauggaucgcggaagacaggucauucaugaggaaauaggugagaacagggagggcaaucaggacgaugugcggaucgaaauggcgcgaccccgcagaguuaggcacuggauguauagcccagugauucugacaauccucgccaucgggcuggcagagucuugcgacgaaaugguacaugcugauuccaaacuugucaguugucggcagggaagcggcaacaugaaggagugcgugaccacuggucgcgcccuguugucugcuguuaauccugggcaagaggccugucuccacuucacagcacccggcuccccagacucaaagugccugaaaauuaaggugaaaagaauaaacuuaaaguguaaaaagaguagcucguacuuuguccccgaugccaggucccguugcaccucugugcggcgauguagaugggcuggagacugccagagcggcugcccuccacauuucacgucaaauaguuuuuccgacgauugggcggggaagauggacagggcaggacugggcuucucugguuguagcgaugggugcggaggcgccgcuugugguugcuuuaacgccgcaccguccuguaucuucuggcgcaaauggguagaaaauccccacggcauuaucuggaaggugucaccuugcgccgcuuggguuccaagcgccgucauugagcuaaccaugcccaguggggaagugcggacauuccacccuaugucuggaaucccaacucagguguuuaaaggcgucuccguuaccuaucucgggagcgacauggaggugucgggacugacagaucuuugugaaauagaggaguugaagucuaaaaagcuggcacucgcgcccugcaaccaggcuggcaugggugugguagggaaagucggagaaauccaauguucaagugaggaauccgccagaacuauuaagaaggacggcugcaucuggaacgcagaucugguggguauugagcuuaggguugacgaugccguguguuacagcaaaaucaccucugucgaagcuguggccaauuauagcgcaauaccgacaaccauuggcgggcugcgcuucgagcgaucccaugacucacagggaaagaucaguggcagcccuuuggauauuacugcuauccgggggucuuuuuccguuaacuaccguggacucagacugucauuaagugagauaacggccacaugcaccggcgaagugacuaauguaagcgguugcuacuccuguaugaccggggcgaaagucucuaucaagcugcacucgagcaaaaacucaacagcccaugugaggugcaagggagacgagaccgcuuucuccgugcuagaaggcggucacaguuauacugucucucucagcuuugaucacgcaguuguggacgagcagugucagcugaauugcggcgggcaugaaucccaaguaacacuuaagggaaacuugauuuuccuggacgugccaaaauuugucgauggcucauacaugcagacguaucacucuaccgugcccacuggggccaauaucccuagccccacagacuggcucaacgcucuguucggaaauggcuuaagucgcuggauucuggguguuaucggggugcuuuugggaggccucgcccuguuuuucaugauaaugucccuauuuaagcugggcaccaaacaggucuuccggagcagaacaaagcucgcauga

SEQ ID NO: 11463 - RNA, 3222 nt, Artificial Sequence
  derived and/or modified CDS sequence (opt3) from SFTSV(JS2013-44)__KR230773.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggagaccagcgaagccaaauguagaugcucucucguccauaagccaggcgagguugugguaucauacggugggaugaggauccggcccaaauguuacggcuuuagucgcaugauggcuacuuuagaagugaaccagccugagcaacgacugggacagugcacaggcugucaccuugaaugcaucaaugggggagucagauugauuacccugacgagcgagcuaaaguccgcaacugugugugccucucauuucugcucgagcgcuaccuccgguaagaaaucaacagagauacaguuccacaguggcucucucguugggaagacugccauccacgugaaaggagcgcuggucgauggcaccgaauuuacauucgaggguagcuguauguuuccagacgggugcgaugcaguggacugcaccuucuguagggaauuucuuaagaacccccaaugcuauccggccaaaaaguggcuguucauuaucauaguaauuuugcucggcuacgcuggacugauguuacugacgaauguucucaaggccaucggcaucuggggguccugggugauugcaccugucaaacuuauguuugcuaucauuaagaaacugaugcggacugugucauguuugaugcguaagcuaauggaucgcggaagacaggucauacaugaggaaaucggugagaacagggagggcaaucaggacgaugugcggauugaaauggcccgaccccgcagaguuaggcacuggauguauagcccagugauccugacaauccucgcgauugggcuggccgagucuugcgacgaaaugguacaugcagauuccaaacuugucaguugucggcagggaagcggcaacaugaaggagugcgugaccacuggucgcgcucuguugccugccguuaaucccgggcaagaggcuugucuccacuucacagccccaggcucucccgacuccaagugccugaaaauaaaggugaaaagaaucaacuuaaaguguaaaaagucaaguagcuacuuugucccugaugcaaggucgcguugcaccuccgugcggcgauguagaugggccggagacugccagucuggcugcccaccgcauuucacgagcaauucauuuagugacgauugggcugggaagauggacagggcgggacugggcuucuccgguuguucugaugggugcggaggcgcagccugugguugcuuuaacgcugcccccagcuguauuuucuggcgcaaauggguagaaaauccucacggcaucauuuggaagguguccccaugcgcagccuggguucccucagcugucaucgagcuaaccaugccuagcggggaagugcggacauuccacccaaugaguggaauacccacucagguguuuaaaggcgucucuguuaccuaucucggguccgacauggaggugagcggacugacagaucuuugugaaaucgaggaguugaagucgaaaaagcuggcccucgcaccgugcaaccaggcgggcaugggugugguagggaaagucggagaaauucaauguucaucugaggaaagugcuagaacuaucaagaaggacggcugcauuuggaacgccgaucugguggguaucgagcuuaggguugacgaugcaguguguuacuccaaaauaaccagcgucgaagccguggcuaauuauucugccauuccuacaaccaucggcgggcugcgcuucgagcgaagccaugacucccagggaaagauuucaggcaguccauuggauaucagcgcaauacgggggucuuuuuccguuaacuaccguggacucagacugucauuaagugagaucacugcuacgugcacaggcgaagugaccaauguaagcgguugcuacuccuguaugacuggggccaaagucucuauuaagcugcacucgagcaaaaacucaaccgcgcaugugaggugcaagggagacgagacagccuucuccgugcuagaaggcguccacaguuauaucguuucucucagcuuugaucacgcugugguagacgagcagugucagcugaauugcgguggccaugaaucccaagugacccuuaaggggaacuugauuuuccuggacguccccaaauuuguggauggaucauacaugcagacuuaucacucuacaguuccuacgggcgcaaauauccccagcccaaccgacuggcucaacgcccuguucgggaauggauuaagucgcuggauacugggcgugauugguguccuucucgggggauuggcucuguuuuccaugaucaugagccuauucaagcugggcacuaaacagguguuucggucuagaacaaagcucgccuga

SEQ ID NO: 11464 - RNA, 3222 nt, Artificial Sequence
  derived and/or modified CDS sequence (opt3) from SFTSV(JS2013-46)__KR230774.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuuguucuuccgauucagguacgagcagugggcuguugccuucugacaggguccucuggaucggagauguggcuugccagccaaugacccccauuccugaagagacauuucuggagcugaaguccuucagccagucggaauuuccagacaucugcaaaauagauggcauuguauucaaucagugugagggcgaaucucucccgcaacccuuugacguugccuggauggauguggggcacucccauaagaucauuaugcgggagcacaaaacuaaguggguccaggagucaaguagcaaggacuucgugugcuauaaagaaggaaccgguccuuguuccgagucugaagagaagacaugcaaaaccagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacucuggaagucaacgagccugaacagcgaaucggccaaugcacagggugucaccuugagugcaucucaggaggugugagauugauuacccugacgagugagcuaaagagcgccacuguuugugcuucccauuuuuguucuucggccaccagcggcaagaaauccacagaaauacaguuccacucagggagucucgugggaaagacugcgauccacgucaaaggcgcacugguggaugguaccgaguucacauuugaagggucuugcauguucccagacggcugcgaugccguagacugcaccuuuuguagggaguuccuuaagaauccccagugcuauccggcuaaaaaguggcuguuuauuaucauaguuauuuugcucggauacgccggccugauguuacugacgaacgugcucaaggcaaucggggucuggggaagcugggugaucgcuccugucaaacuuguguucgccauuaucaagaaacugaugcgggcgguuuccuguuugauggguaagcuaauggaucguggccgccaagugauucaugaagagauaggggagaauagagaaggaaaccaggacgauguaaggaucgagauggcccggccccgacgcgucagacacuggauguauucaccagugauucugacuauccucgcaaugggccuggcugaagguugcgacgagaugguucaugccgauagcaaacuugugucuuguaggcagggguccggcaauaugaaggagugcgucacaaccggacgggcucuguugccugccgugaaccccggccaggaagcaugucuccacuuuauggccccagggagucccgacagcaagugccugaaaaucaagguaaaacgcauuaauuuaaaguguaaaaagucuuccucauacuucgugccugaugcuagaaguaggugcacuagcguucgucggugucgaugggcgggagacugccaaucgggcugcccaccgcauuuuacauccaacucuuucagcgacgauugggcagguaagauggacagagccgggcugggauuuucaggcuguagugaugguugcggcggggcugccuguggaugcuucaaugcagcccccuccuguauauuuuggaggaaaugggucgagaacccucacggcaucauuuggaaggugucuccaugcgcugccugggugcccagcgcagucaucgaacuaaccaugccuuccggggagguucgcacguuccacccaaugucaggcauucccacccagguguucaaaggagugagcguaacauaucucgguagugacauggaagucucugggcugacugaucuuugugagaucgaggaauugaaguccaaaaagcuggcgcucgcuccgugcaaucaggccggaaugggcgugguugguaaagugggcgagauacaguguagcucggaagagucagcacggaccaucaagaaggacgggugcauuuggaacgccgaucuggucggaaucgaacuuagaguggacgaugcuguuuguuacucuaaaauuacaaguguggaggccguagcaaacuauuccgcuaucccuacuaccauaggcgggcugagguuugagcgcagccaugacucucaaggaaagauuagcggcuccccauuggauaucacagccauucgagguucauucaguaucaauuaccgggggcuccgucugagcuuaucugaaauauccgcgaccugcacuggagaggucacgaacgugucaggcugcuacaguuguaugacaggugccaaagugagcaucaagcugcacuccucuaaaaauucgaccgcucaugucagaugcaagggcgacgaaacugcauuuagcguucuagagggggugcacucauauuccguaagucucucuuucgaucacgccguggucgacgaacagugucagcugaacugcggaggccaugagagccaggugacccuuagggggaauuugauuuuucuggacguucccaaguucguggauggauccuacaugcaaacauaucacucaaccgucccuacuggcgcuaacauccccucuccaacagacuggcucaaugcccuguuugguaacggguuaagccgcuggauucugggagugaucggcguucuuuugggcgggcucgcacuguucuuucuaauaaugagucuguucaaacucggaacgaaacagguguuucgguccagaaccaagcuggcguga

SEQ ID NO: 11465 - RNA, 3222 nt, Artificial Sequence
  derived and/or modified CDS sequence (opt3) from SFTSV(JS2013-52)__KR230775.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucauguuugccaucauuaagaaacuuaugcggacggucucaugucugaugggaaaguugauggaucguggucgccaggugauacaugaggaaaucggcgagaacagagaggggaaucaggacgauguuaggauugaaauggcgcggccccgacgcgugagacacuggauguauagcccaguaauccuaacuuuccuggccaucggacucgcagagucuugcgacgaaaugguccaugcugauuccaaacuggugaguuguaggcagggcagcgguaacaugaaggagugcguuacaaccgggcgggcccuucugccugcugugaaucccggccaagaggccuguuugcacuuuacugcaccaggaucucccgacuccaagugccucaaaauuaaggucaaacgcauaaaccugaaguguaaaaagucaaguagcuacuucgugccugaugccagaucgaggugcacauccguacgucggugucgaugggcuggcgacugccagucugggugcccaccgcauuuuaccagcaauucauucagugacgauugggcgggaaagauggacagagcaggcuuagguuuuuccggguguucugauggaugcggcggugccgcuuguggcugcuucaacgccgcacccagcuguaucuucuggaggaaauggguggaaaauccucacgggauuaucuggaagguuuccccaugcgccgcuuggguccccucagccgugauugagcugacgaugccuagcggagaagugcgcaccuuucacccaaugaguggcauccccacacaggucuucaaagggguuucugugacuuaucuaggauccgacauggaggugagcggccucaccgaucugugugaaauagaggagcuuaagucgaaaaaguuggcacuggcgccgugcaaccaggcugguauggggguagucggaaaagugggcgaaauccaauguucaucugaggaaagugcccggacaauuaagaaggacgguugcaucuggaacgcagaucucguuggcauugagcugagaguggacgaugccgucuguuacuccaaaaucacuagcguggaagcuguugccaauuauucugcaauaccuaccacaauugggggacuuagguuugagcgcagccaugacucccagggcaagaucucagggaguccacuggauauuaccgcuauccgaggcagcuucucugugaacuaccggggauugcgucucucccugucagagauaacugccacgugcacaggugaaguaaccaaugucagugggugcuacagcuguaugacuggagcgaaaguguccaucaaguuacacucuucgaaaaacagcaccgcccaugugagaugcaagggcgacgagacagcuuuuucaguccuggaagguguucacuccuauaccgugagucuaucuuucgaucacgcaguaguggacgagcagugucagcucaauugcggcgggcaugaaagccaagucacucugaagggaaaccuuaucuuuuuggacgugcccaaauucguugauggcuccuacaugcagacauaucacucaacggugccuaccggggccaauauucccucuccaacugacuggcugaacgcucucuuuggaaauggccugaguagguggauuuuaggugucaucggggugcugcuuggaguuuuggcccucuucuuucugauaaugagccuauucaagcugggcacaaaacagguguuucgcucccggaccaagcucgcauga

SEQ ID NO: 11466 - RNA, 3222 nt, Artificial Sequence
  derived and/or modified CDS sequence (opt3) from SFTSV(JS2013-69)__KR230776.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauauuaucgugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggauuggggauguggcuugucagccaaugacgcccaucccugaagagaccuuccucgagcugaagucguuuucucaguccgaauuuccagacauaugcaaaauugauggaaucguauuuaaucagugugagggcgaaucacugccgcaacccuucgacguugccuggauggaugugggccacagucauaagauuaucaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgacugggacagugcacuggcugucaccuugaaugcaucaaugggggagugagauugauuacacugaccagcgagcuaaaguccgccacgguuugugcuucucauuucugcucgagcgccacuuccgguaagaaaucaaccgagauacaguuccacaguggcucucucguggggaagacagcgauccacgucaaaggagcacugguggauggcacugaauuuacccuugagagcuccuguauguucccagacgguugcgaugccguagacugcacauuuuguagggaauuucugaagaacccccaaugcuauccggcuaaaaagugguuguuuauuaucauaguuauucuccugggguacgccggcuuaaugcugcucaccaaugugcuuaaggcaaucggaaucuggggcucaugggucauugcuccugugaaacugauguucgccaucauuaagaaauugaugcggacggucagcugucuaaugcguaagcugauggaucgcgggagacaggugauacaugaggaaaucggagagaacagggaggguaaucaggacgauguucggauugaaauggcgcgaccccgcagagugaggcacuggauguauucuccaguaauccucacuauccuggccauuggccuugcagaguccugcgacgaaaugguccaugcugauaguaaacuggugagcugucggcaggggucuggaaacaugaaggagugcguuacaaccggccgcgccuugcucccugcugugaaucccggucaagaggccugucugcacuuuacugcaccagggucccccgacucaaagugcuuaaaaauaaaggucaaaagaaucaaccugaaguguaaaaagaguagcucguacuucgugccugaugccaggucccguugcacaucuguacggcgauguagaugggcuggcgacugccagagcggaugcccaccgcauuuuaccucaaauaguuucuccgacgauugggcgggcaagauggacagggcagggcuaggauuuucuggcuguagcgaugguugcgggggagccgcuuguggcugcuucaacgccgcacccuccuguauuuucuggcgcaaauggguggaaaauccucacgguaucauuuggaagguuucaccaugcgccgcuuggguccccagcgccgugaucgagcucacgaugccuaguggcgaagugcggaccuuccacccaaugucugggauacccacacaggucuucaaaggaguuuccgugacuuaucugggcagcgacauggaggugucggggcuuaccgauuugugugaaaucgaggagcugaagucaaagaagcucgcacuggcgccgugcaaccaggcuggaaugggcguagucgguaaagugggggaaauucaauguucuagugaggaauccgccagaacaaucaagaaggacggaugcauuuggaacgcagaucuuguuggcaucgagcugaggguggacgaugccgucuguuacagcaaaauaacuucuguggaagcuguugccaauuauagcgcaauuccuaccacaaucgguggcuugcgcuuugagcgaucccaugacucacaggggaagauuaguggaagcccacucgauaucaccgcuauacggggcucuuucuccgugaacuaccgugggcugagauuaucacugagugagaucacugccacgugcacaggagaaguaaccaaugucagcggcugcuacuccuguaugacuggugcgaaagugucuauuaagcuacacucgagcaaaaacucaaccgcccaugugaggugcaagggggacgagacagcuuuuuccguccucgaaggaguucacaguuauaccgugucucugagcuucgaucacgcaguaguggacgagcagugucagcuuaauugcggcggucaugaaucccaagucacuuugaagggcaaccugaucuuucucgacgugcccaaauucguugaugggucauacaugcagacauaucacucuagcgugccuacgggagccaauauucccaguccaaccgacuggcugaacgcuuuauuuggcaaugggcugucccgcuggauccuuggagucauaggcguguugcucgguguucuggcccuauucuuucugauuaugagccucuucaagcuggggacuaaacagguguuucggucuagaacaaaacuugcauga

SEQ ID NO: 11467 - RNA, 3222 nt, Artificial Sequence
  derived and/or modified CDS sequence (opt3) from SFTSV(JS2013-71)__KR230777.1__GP
augaugaaggugaucugguucagcucccugauuugcuuugucauacaguguggcggggacaccggacccaucauuugcgccgguccuauccacucuaacaaaucagcugauauuccacaucuccuuggcuacagugagaagaucugucaaauagacagacugauccacguuagcuccugguugaggaaucauucucaguuccagggguaugugggacagcggggcggucgcucgcaaguaucauacuauccggcagaaaacagcuacagucgaugguccggguuacugucucccugcgaugccgacuggcuaggaaugcucguggucaaaaaggcgaaaggcagcgauaugauugugccuggcccauccuauaaggggaagguuuucuucgagcgucccacauuugacggauacguggguuggggcugugggucaggaaaaaguagaacugaaagcggcgagcugugcagcuccgauucagguacgagcagugggcuucugccuucugacagggucuuguggaucggagauguggcuugucagccaaugacccccauuccugaagagacauuccucgagcugaaguccuuuagccagucggaauuuccagacaucugcaaaauagauggcauuguauuuaaucagugugagggcgaaucucugccgcaacccuucgacguugccuggauggauguggggcacucccauaagaucauuaugcgggagcacaaaacuaaguggguccaggagucaaguagcaaggacuuugugugcuauaaagaaggaaccgguccuuguuccgagucugaagagaagacaugcaaaaccagcggcucaugccgcggggacaugcaguucuguaagguggcaggaugcgaacacggcgaggaggccagugaagcuaaauguagaugcucccucguccauaagccaggugagguugugguaagcuacgggggcaugagggugcggcccaaauguuacggauuuucucgcaugauggcaacuuuagaagucaaccagccugagcaacgaaucggccagugcacagggugucaccuggaaugcaucaauggaggugugagacuuauuaccuugacgucagagcugaagagugccacuguuugugcuagccauuucugcuccucugccaccucgggcaagaaaagcacagagauacaguuccacuccgggucgcuagugggaaagacugcgauccacgucaaaggcgcacucguggaugguaccgaauuuacauucgaggggaguuguauguuuccagacggcugcgaugccguagacugcaccuucuguagggaauuucugaagaacccccaaugcuauccggcuaaaaaguggcuuuucauuaucauaguuauucuguugggauacgccggccucaugcuguuaacgaaugugcugaaggcaaucggggucuggggaucuugggugaucgcuccugucaaacucguguuugccauuaucaagaaacuuaugcgggcgguuagcugucugauggguaaguugauggaucguggccgccaggugauucaugaggaaauaggggagaacagagagggaaaucaggacgauguaaggaucgaaauggcccggccccgacgcgucagacacuggauguauuccccagugauucuaacuauccuggcaaucggccucgcugaggguugcgacgaaaugguucaugccgauucaaaacuggugagcuguaggcaggggucuggcaacaugaaggagugcgucacaaccggacgggcccuucugccugcugugaaucccggccaagaggcauguuugcacuucacugccccagggucccccgacaguaagugccucaaaauuaagguaaaacgcauaaaccugaaguguaaaaagucuucuuccuacuuugugccugaugcuagaucaaggugcacaaguguucgucggugucgaugggcgggagacugccagagcggcugcccaccgcauuucaccucaaauuccuuuucugacgauugggcagguaagauggacagagccggguuaggauucagcggcuguucagaugguugcggcggggcugccuguggaugcuuuaacgcagcccccaguuguaucuucuggaggaaaugggucgaaaauccucacggcauuaucuggaagguguccccaugcgcugccugggugcccucugcagucauugagcugacgaugccuagcggggaaguucgcaccuuccacccaauguccggaauccccacacagguguuuaaaggcgugucaguaacuuaucuagguagcgacauggaggucagugggcucaccgaucugugugaaauagaggagcuuaagucuaaaaaguuggcgcuggcuccgugcaaccaggccggaaugggcgugguugguaaagugggcgaaauccaauguuccagcgaggaaucggcacggacaauuaagaaggacgggugcaucuggaacgccgaucucgucggaauugagcugagaguggacgaugcuguuuguuacucaaaaaucacuucuguggaagccguagcaaauuauagugcuauaccuaccacaauuggcgggcuuagguucgagcgcucccaugacagccagggaaagaucucuggcagcccacuggauauuaccgccauccgagguuccuuuucagucaacuaccggggguugcgucucagucugagcgagauaacugcgacgugcacaggagaagugaccaaugugucuggcugcuacuccuguaugacuggugccaaagucucaaucaaguuacacaguagcaaaaacuccaccgcucauguuagaugcaagggcgacgagacagcauucucugugcuggaagggguacacucguauagcgugucacuauccuuugaucacgccgucguggacgagcagugucagcucaauugcggaggccaugaaagucacguuacccugagggggaaccuuauuuucuuggacgugcccaaguuugucgauggaucuuacaugcaaacuuaucauagcacagugccuacgggcgcuaauauccccuccccaaccgacuggcugaacgcccucuucgguaaugggcugucacgcuggauuuuaggaguuaucggcgugcugcuuggcggguuggcacucuuuuuccugauaaugucucuauuuaaacugggaacuaagcaggucuuccggagcagaacaaaacucgcguga

SEQ ID NO: 11468 - RNA, 3222 nt, Artificial Sequence
  derived and/or modified CDS sequence (opt3) from SFTSV(JS2014-03)__KR230778.1__GP
augaugaaggugaucugguucagcucccugauuuacuuugucauacagugcucuggcgacucagggcccaucauuugugccggaccuauccacaguaacaaaagcgcugauauuccacaucuccuugguuauuccgagaagaucugccaaauagacagacugauccacguuucuucgugguugaggaaucauucacaguuccagggcuacguggggcagcggggaggccgcagccaaguaaguuauuacccggcagaaaacuccuauucucgauggagcgguuuacugucccccugugaugccgacuggcuagggaugcucguggucaaaaaggcgaaaggaucagauaugauugugccuggcccaaguuacaagggcaagguuuucuucgagcgucccaccuuugacggguaugugggaugggguugcggcagcgggaaaucuagaacagaauccggagagcuguguucaagcgauaguggcacuucuuccggucuucugccuagcgacagggucuuguggaucggggauguggcuugccagccaaugacgcccauuccugaagagaccuuccucgagcugaagucguuuucucaguccgaauuuccagacaucuguaaaauagauggaauuguauuuaaucagugcgagggcgaaucacugccgcaacccuucgacguugccuggauggaugugggccacagucauaagaucauuaugcgggagcacaaaacaaaguggguccaggagagcuccucuaaggacuuuguguguuacaaagaagggacuggaccuugcagcgagucagaagagaagaccuguaaaacaagugguuccugccgcggcgacaugcaguucugcaagguggcagggugugaacacggagaggaggccagcgaagcuaaaugcagauguucucucguccauaagccaggcgagguugugguaucauacggugggaugaggauccggcccaaaugcuauggcuuuagucgcaugauggcaaccuuagaagugaaccagccugagcaacgaaucggacaguguacuggcugccaccuggaauguauuaaugggggagucagacuuauaacauugaccagcgagcugaaguccgccacggugugcgcuucucauuucuguucgagcgccacuuccgguaagaaaucaaccgagauccaguuccacaguggcucucuaguugggaagacagcgauucacgugaaaggagcacucgucgauggcacugaauuuaccuucgaggguagcugcauguuuccagacgggugugaugccguggacugcacauucugcagggaauuucugaagaacccccaauguuacccggcuaaaaaguggcuuuucaucauaauuguaauccuguugggcuaugccggacucaugcuguuaaccaauguucugaaggcaaucggcauuuggggguccugggugaucgcuccugucaaacucauguuugccauuauaaagaaacuuaugcggacggugucaugccugaugggaaaguugauggaucguggucgccaggucauccaugaggaaauuggcgagaacagagaggggaaucaggacgaugugaggaucgaaauggcgcggccccgacgcguuagacacuggauguacagcccagugauccuaacuuuccuggccauuggacucgcagagucuugugacgaaaugguacaugcugauuccaaacuggucaguugcaggcagggcagcgguaacaugaaggagugugugacaaccgggcgggcccuucugccugcuguuaaucccggccaagaggccugcuugcacuuuacugcaccaggaucucccgacuccaagugucucaaaauaaaggugaaacgcaucaaccugaagugcaaaaagucaaguagcuauuucgucccugaugccagaucgagguguacauccgugcgucggugccgaugggcuggcgacugucagucugggugcccaccgcauuuuaccagcaauucauucagugacgauugggcgggaaagauggacagagcaggcuuagguuuuuccgggugcucugauggauguggcggugccgcuugcggcuguuucaacgccgcacccagcugcauuuucuggaggaaauggguagaaaauccucacgggaucauuuggaagguguccccaugugccgcuuggguucccucagccgucaucgagcugacgaugccuagcggagaagugcgcaccuuucacccaaugaguggcauacccacacagguguucaaaggggucucuguuacuuaccuaggauccgacauggaggugagcggccucaccgaucugugcgaaaucgaggagcuuaagucgaaaaaguuggcacuggcgccguguaaccaggcugguaugggggugguaggacgggucggcgaaauucaaugcucaucugaggaaagugccagaacaaucaaaaaggacgguuguauuuggaacgcagaucucgugggcaucgagcugaggguugacgaugccgugugcuauuccaagauaacuagcgucgaagcuguggccaauuacucugcaauuccuaccacaaucgggggacuucgcuuugagcgaagccaugacucccagggcaaaauuucagggaguccacuggauaucaccgcuauacggggcagcuucucuguuaacuaccguggauugagacucucccugucagagaucacugccacguguacaggugaagugaccaauguaagugggugcuauagcugcaugacuggagcgaaggucuccauuaaauuacacucuucgaagaacagcaccgcccaugugagguguaaaggcgacgagacagcuuuuucagugcuggaagguguccacuccuacaccguuagucuaucuuucgaucacgcagugguagacgagcagugccagcucaauuguggcgggcaugaaagccaagugacucugaagggaaaccuuaucuuuuuggacguccccaaguucguggauggcuccuauaugcagacauaccacucaacgguuccuaccggggccaauauucccucuccaacugacuggcugaacgcucucuuuggaaauggccugagccgcuggaucuuaggugugauagggguccugcuuggaggcuuggcccucuucuuuaugauuaugagucuguucaaacuaggcacaaaacagguguuucgguccagaaccaagcuggcauga

SEQ ID NO: 11469 - RNA, 3222 nt, Artificial Sequence
  derived and/or modified CDS sequence (opt3) from SFTSV(JS2014-16)__KR230780.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaucugcaaaguagacggaauaguuuucaaccagugugauuccgagucacugccgcaacccauugacguggccuggauggaugucggccacagucauaagaucauuaugcgggaacacaaaacuaagugggugcaggagagcuccucuaaggacuuugugugcuauaaagagggcaccgggccuuguagcgaaucagaggaaaagacaugcaaaaccaguggauccugccgcggugacaugcaguucuguaaggucgcaggcugcgagcacggggaagaggccagcgaggcuaaauguagaugcucuuuaguucauaagccaggagaagugguagugucauacggcgguaugaggguccggcccaaauguuacggguuuagucgcaugauggcaacucuggaggugaauccuccagaacagcgaaucggccaaugcacaggaugucaccuugagugcaucaacggcgggguuagauugauuacccugacgagcgaacuaaaguccgccacugugugugcuucucauuucugcucgagcgccaccuccggaaagaaaucaacagagauacaguuucacagugguucucucgucggcaaggcggcaauccacgugaaaggggcccugguagauggaacugaguucaccuucgaaggcagcuguauguuucccgacgguugcgaugcuguugacugcacauucuguagggaguuucuuaagaauccgcagugcuauccugccaaaaaguggcuguucauuaucauagugauuuugcucggguacgcaggccugauguuacugaccaacguccucaaggcuaucggaguguggggcuccugggucauggcccccgugaaacuuauguuugcgaucauuaagaaacugaugcggucaguuagcuguaugauggggaaguugauggaucguggacgccaagugauccaugaagagauuggugaaaauagagagggcaaccaggacgauguaaggauagagauggcccggccacgacgcgucagacacuggauguauucuccugugauccuaacgauucuggcaaucgggcucgcugaaggaugcgacgagaugguucaugccgauuccaaacuggugcuuuguaggcagggcagugguaauaugaaggaaugcgucacuacagggcgggcucuguugcccgccgugaacccaggccaggaggcaugucuccacuucaccgcccccggaagcccugacucuaagugccugaaaaucaagguaaaacgcauuaauuuaaaguguaaaaaguccucaaguuacuuugugccagaugcuagaucgaggugcacuagcguucgucggugucgaugggcgggcgacugccaauccgggugcccgucucauuucacaagcaacucauuuagugacgauugggcaggaaagauggacagagccggccuggguuucuccggguguucugauggaugcggcggugcugccuguggcugcuuuaaugcagcccccagcuguauauucuggaggaaaugggucgagaacccucacgggaucauuuggaagguguccccaugcgcugccugggugcccucagcagucaucgaacuaaccaugccuagcggagagguucgcacguuucacccaaugaguggcauucccacccagguguucaaaggggugucuguaacauaucucggauccgacauggaagucagcggccugacugaucuuugugagaucgaagaguugaagucgaaaaagcuggcgcucgcuccgugcaaccaggccgguaugggggugguuggaaaagugggcgagauacaguguucaucugaagagagugcacggaccaucaagaaggacgguugcauuuggaaugccgaucuggucggcaucgaacuuagaguggacgaugcuguuuguuacuccaaaauuacaagcguggaggccguagcaaacuauucugcuaucccuacuaccauagggggacugagguucgaacgcagccaugacucccaaggcaagauuucagggaguccauuggauaucacagccauucgaggcagcuuuucugucaauuaccggggacuccgucuguccuuaucagagaucaccgcgacuugcacgggugaggugacaaacgugagugggugcuacagcuguaugaccggagccaaagucuccauaaagcugcacucuucgaaaaauagcacugcucauguuagaugcaggggcgacgaaaccgcauucucagugcuagaggguguacacuccuauacagugagucucucuuuugaucacgccgucguggacgaacagugucagcugaacugcggcgggcaugagagccagguuacccuuaagggaaauuugaucuuccuggacgugcccaaguuugucgauggcuccuacaugcaaacuuaucacucaucugugccuacaggggcuaacauucccagcccaacggacuggcucaaugcccuguucggaaacggcuuaagucgcuggauccuggguguuauuggggugcuuuugggaguccucgcacuguuuuuccuaaucaugucccuguuuaaacucggcaccaagcagguauuccggagcagaacuaaacuggcguga

SEQ ID NO: 11470 - RNA, 3222 nt, Artificial Sequence
  derived and/or modified CDS sequence (opt3) from SFTSV(JS2014-18)__KR230781.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuuguucuuccgauucagguacgagcagugggcuguugccuucugacaggguccucuggaucggagauguggcuugccagccaaccacacccauuccugaagagacuuuucuggagcugaaguccuucagccagucggaauuuccagacguaugcaaaaucgauggcauaguuuucaaucagugugagggcgaaucucucccgcaacccuuugacguggccuggauggaugucgggcacucccauaagauuaucaugcgggagcacaaaaccaagugggugcaggagucaaguagcaaggacuucgugugcuauaaagaaggaacagguccuuguuccgagucugaagagaagaccugcaaaacuagcggcucaugccgcggggacaugcaguuuuguaaggucgcaggaugcgaacacggcgaggaggccagugaagcuaaauguagaugcuccuuaguucauaagccaggugaggugguagugagcuacgggggcaugaggguccggcccaaauguuacggauucucucgcaugauggcaacacuggaagugaacccuccagagcagcgaauuggccaaugcaccgggugucaccuugaaugcaucaauggagguguuagauugaucacgcugacuucagagcuaaagagugccaccgugugugcuagccauuuuugcuccucugccacaucgggcaagaaaagcacugagauucaguuccacuccgggucacucgucggaaagaccgcgauacacgugaaaggcgcacugguagaugguacagaguucaccuuugaagggaguuguauguuccccgacggcugcgaugccguugacugcacguuuuguagggaguuccuuaagaacccgcagugcuauccugcuaaaaaguggcuguuuaucauuaucgugauauugcucggauacgccggccugauguuacugacuaauguccucaaggcaauugggguguggggaucuugggucaucgcucccgugaaacuuguuuucgccaucauuaagaaacugaugcgggcggugagcuguuugauggguaagcuaauggaucguggccgccaaguaauccaugaagaaauuggggagaacagagagggaaaucaggacgaugucaggauagaaauggcccggccacgacgcgugagacacuggauguauuccccuguuauccugacaauucucgcaaucggccuggcugaggguugcgacgaaauggugcaugccgauucaaaacuugucagcuguaggcaggggucuggcaacaugaaggagugcgugaccacuggacgggcucuguugcccgccguaaauccaggccaggaggcaugucuccacuuuacagcccccggguccccugacaguaagugccugaaaaucaaggugaaacgcauuaacuuaaaguguaaaaagucgucuuccuacuucguuccagaugcuagaucaaggugcaccaguguccgucggugucgaugggcgggagacugccaaagcggcugcccgccccauuuuacgagcaauuccuucucugacgauugggcagguaagauggacagagccgggcugggauuuagcggcuguucagaugguugcggcggggcugccuguggaugcuucaacgcagccccuaguuguauauuuuggaggaaauggguggaaaauccacacggcaucauuuggaaggugucccccugcgcugccugggucccuucugcaguuaucgagcuaaccaugccaagcggggaagugcgcacauuccaccccauguccggcauuccgacucagguguucaaaggaguaucagucaccuaucucgguagcgacauggaggugagugggcugacagaucuuugugaaaucgaggaguugaagucuaaaaagcuggcgcucgcuccuugcaaccaggccggaaugggcguuguggguaaagucggcgaaauacaguguuccagcgaggaaucggcacggacuaucaagaaggacgggugcauuuggaacgccgaucuggugggaaucgagcuuagaguugacgaugcuguguguuacucaaaaauuaccucuguagaagccgucgcaaauuauagugcuaucccaacaaccauaggcgggcugagguuugagcgcucccaugacagccaaggaaagauuucuggcagccccuuggauaucacugccauucgagguuccuucucagugaacuaccgggggcuccgucugaguuuaagcgagaucacggcgacaugcaccggagaagugacuaaugucucuggcugcuacuccuguaugaccggugccaaaguuucaauaaagcugcacaguagcaaaaacuccacagcucaugugagaugcaagggcgacgagaccgcauuuucuguacuagaaggggugcacucguauagcgucucacucuccuucgaucacgccgugguugacgagcagugucagcugaauugcggaggccaugaaagucaggugacucuuagggggaacuugaucuuucuggacgucccuaaguucguggauggaucuuacaugcaaacauaucacagcacgguucccaccggcgcuaauauuccauccccuacugacuggcucaacgcccuguuugguaauggguuaucacgcuggauccugggagugauuggcguccuuuugggcgggcucgcacuguucuuucuaaucaugucucuguucaaacucggaacaaagcagguauuucggagcagaaccaaacuggcguga

SEQ ID NO: 11471 - RNA, 3222 nt, Artificial Sequence
  derived and/or modified CDS sequence (opt3) from SFTSV(JS2014-31)__KR230782.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugaggauccggcccaaauguuacggcuuuagucgcaugauggcaaccuuagaagugaaccagccugagcaacgacugggacagugcacuggcugucaccuugaaugcaucaaugggggagucagauugauuacacugaccagcgagcuaaaguccgccacggugugugcuucucauuucugcucgagcgccacuuccgguaagaaaucaaccgagauacaguuccacaguggcucucucguugggaagacagcgauccacgugaaaggagcacuggucgauggcacugaauuuaccuucgaggguagcuguauguuuccagacgggugcgaugccguggacugcacauucuguagggaauuucuuaagaacccccaaugcuauccggcuaaaaaguggcuguucauuaucauaguaauuuugcucggcuacgccggacugauguuacugaccaauguucucaaggcaaucggcaucuggggguccugggugauugcuccugucaaacuuauguuugccaucauuaagaaacugaugcggacggugucauguuugaugcguaagcuaauggaucgcggaagacaggucauacaugaggaaaucggugagaacagggagggcaaucaggacgaugugcggauugaaauggcgcgaccccgcagaguuaggcacuggauguauagcccagugauccugacuauccucgccauugggcuggcagagucuugcgacgaaaugguacaugcugauuccaaacuugucaguugucggcagggaagcggcaacaugaaggagugcgugacaaccggucgcgcccuguugccugcuguuaaucccgggcaagaggccugucuccacuucacugcaccaggcucucccgacuccaagugccugaaaauaaaggugaaaagaaucaacuuaaaguguaaaaagucaaguagcuacuuugucccugaugccaggucgcguugcacauccgugcggcgauguagaugggcuggagacugccagucuggcugcccaccgcauuucaccagcaauucauuuagugacgauugggcggggaagauggacagggcaggacugggcuucuccgguuguucugaugggugcggaggcgccgcuugugguugcuuuaacgccgcacccagcuguauuuucuggcgcaaauggguagaaaauccucacggcaucauuuggaagguguccccaugcgccgcuuggguucccucagccgucaucgagcuaacgaugccuagcggggaagugcggaccuuccacccaaugaguggaauacccacacagguguuuaaaggcgucucuguuacuuaucucggguccgacauggaggugagcggacugaccgaucuuugugaaaucgaggaguugaagucgaaaaagcuggcacucgcgccgugcaaccaggcuggcaugggugugguagggaaagucggagaaauucaauguucaucugaggaaagugccagaacaaucaagaaggacggcugcauuuggaacgcagaucugguggguaucgagcuuaggguugacgaugccguguguuacuccaaaauaacuagcgucgaagcuguggccaauuauucugcaauuccuaccacaaucggcgggcugcgcuucgagcgaagccaugacucccagggaaagauuucaggcaguccauuggauaucaccgcuauacgggggagcuuuucuguuaacuaccguggacucagacuguccuuaucagagaucacugccacgugcacaggcgaagugaccaauguaagugguugcuacagcuguaugacuggggcgaaagucuccauuaagcugcacucuucgaaaaacagcaccgcccaugugaggugcaagggagacgagacagcuuucucagugcuagaaggcguccacuccuauaccguuagucucucuuuugaucacgcagugguagacgagcagugucagcugaauugcgguggccaugaaagccaagugacucuuaaggggaacuugaucuuccuggacguccccaaauuuguggauggauccuacaugcagacauaucacucaacgguuccuaccggcgccaauauucccucuccaacugacuggcucaacgcucuguucgggaauggauuaagccgcuggauccugggcgugauagguguccuuuugggggugcucgcccuguuuuuccuaauuaugagucuguuuaagcucggaacaaaacagguuuuccgguccagaaccaagcuggcauga

SEQ ID NO: 11472 - RNA, 3222 nt, Artificial Sequence
  derived and/or modified CDS sequence (opt3) from SFTSV(JS2014-33)__KR230783.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguaacuguauguuuccagacgggugcgaugccguagacugcacauucuguagggaauuucugaagaauccccaaugcuauccggcuaaaaaguggcuuuucauuaucauaguuauucuguugggcuacgccggacucaugcuguuaaccaacgugcugaaggcaaucggcaucugggggagcugggucauugcuccugugaaacucaucuuugccauuauaaagaaacuuaugcgggcggucggaugucugauggguaaguugauggaucguggccgccaggugauccaugaggaaauuggggagaauagagagggaaaccaggacgauguuaggaucgaaauggcccggccccgacgcgugagacacuggauguauuccccaguaauccuaacgauucuggcaauaggccucgcugagucaugcgacgaaaugguccaugccgauagcaaacuggugucuuguaggcagggugggggcaauaugaaggagugcguuacuacaggacgggcccuucugccugcugugaaccccggccaagaggcauguuugcacuucaccgccccagggucccccgacaguaagugccucaaaaucaaggucaaacgcauuaaucugaaguguaaaaagaguucuuccuacuuugugccugaugcuagaucaaggugcacuagcguacgucggugucgaugggcgggagacugccagagcggcugcccaccgcauuucacaucgaacuccuuuucugacgauugggcagguaagauggacagagccggguuaggauucagcggcuguucagaugguugcggcggggcugccuguggaugcuuuaaugcagcccccaguuguaucuucuggaggaaauggguggaaaacccucacggcauuaucuggaagguuuccccaugcgcugccuggguccccucugcagugauagagcugaccaugccuagcggggaagugcgcacguuccacccaauguccggaauccccacccaggucuuuaaaggcguuucagugacauaucuagguagcgacauggaggugagugggcucacugaucugugugaaauugaggagcuuaagucuaaaaaguuggcgcuggcuccgugcaaccaggccggaaugggcguagucgguaaagugggcgaaauccaauguuccagcgaggaaucggcacggaccauuaagaaggacgggugcaucuggaaugccgaucucguuggaauagagcugagaguggacgaugcugucuguuacucaaaaauuacaucuguggaagccguugcaaacuauagugcuaucccuacuaccauuggcgggcuuagguucgagcgcucccaugacagccagggaaagaucucuggcagcccacuggauauaacagccauccgagguuccuuuucagugaauuaccggggguugcgucucagucugagcgagauuaccgcgacuugcacgggagaaguaacaaacgucucuggcugcuacuccuguaugaccggugccaaagugucaaucaaguuacacaguagcaaaaauuccacugcucaugugagaugcaagggcgacgagaccgcauucucuguccuggaagggguucacucguauacagugagccuaucauuugaucacgccguaguggacgagcagugucagcucaacugcggaggccaugaaucccaagucacccugaaggggaaucuuauuuucuuggacgugcccaaauuuguugauggaaguuacaugcagacuuaucacucugcugugccuacaggcgccaacauccccagcccaacggacuggcugaaugcacucuucgguaacgggcuguccagguggauauuaggagucauuggcgugcugcuuggcggguuggcgcucuuuuucaugaucaugucacuguuuaagcuaggaaccaaacaggccuuccgcucucggacuaagcuggcuuga

SEQ ID NO: 11473 - RNA, 3222 nt, Artificial Sequence
  derived and/or modified CDS sequence (opt3) from SFTSV(JS2014-39)__KR230784.1__GP
augaugaaggugaucugguucagcucccugaccugcuuugucauucaguguucuggcgacucagggcccauaaucugcgccggaccuauucacaguaacaaaagcgcugauaucccacaucuccuugguuacuccgagaagauuugucaaaucgacagacugauacacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugaucgugccuggcccaaguuauaagggcaagguuuucuucgagcgucccacauuugacggguacgugggaugggguuguggcagcgggaaaucuagaacugaauccggagagcugugcucaagcgauaguggcacgucuuccggucuucugccuagcgacagggucuuguggauuggggauguggcuugucagccaaugacccccaucccugaagagacauuccucgagcugaagucguuuucucaguccgaauuuccagacauuugcaaaaucgauggaauaguauuuaaucagugugagggcgaaucacugccgcaacccuucgacguugccuggauggaugugggccacagucauaagauuaucaugcgggagcacaaaacuaaguggguccaggagagcuccucuaaggacuuugugugcuauaaagaagggaccggaccuuguagcgagucagaagagaagacaugcaaaaccagugguuccugccgcggcgacaugcaguucuguaagguggcagggugcgaacacggagaggagacuagcgaagccaaauguagaugcucucucguccauaagccaggcgagguugugguaucauacggugggaugaggauucggcccaaauguuacggcuuuagucgcaugauggcuacauuagaagugaaccagccugagcaacgacugggacagugcaccggcugucaccuugaaugcaucaaugggggagucagauugaucacgcugacuagcgagcuaaaguccgcaaccgugugugccucucauuucugcucgagcgcuacauccgguaagaaaucaacugagauucaguuccacaguggcucucucguugggaagaccgccauacacgugaaaggagcgcuggucgauggcacagaauuuaccuucgaggguagcuguauguuuccagacgggugcgaugcaguggacugcacguucuguagggaauuucuuaagaacccccaaugcuauccggccaaaaaguggcuguucaucauuaucguaauauugcucggcuacgcuggacugauguuacugacuaauguucucaaggccauuggcaucuggggguccugggugaucgcaccugucaaacuuauguuugcuauuaucaagaaacugaugcggacagugucauguuugaugcguaagcuaauggaucgcggaagacaggucauucaugaggaaauaggugagaacagggagggcaaucaggacgaugugcggaucgaaauggcccgaccccgcagaguuaggcacuggauguauagcccagugauucugaccauccucgcgaucgggcuggccgagucuugcgacgaaaugguacaugcagauuccaaacuugucaguugucggcagggaagcggcaacaugaaggagugcgugacuacaggucgcgcucuguugccugccguuaaucccgggcaagaggcuugucuccacuucaccgccccaggcucucccgacuccaagugccugaaaauuaaggugaaaagaauaaacuuaaaguguaaaaagucaaguagcuacuuugucccugaugcaaggucgcguugcacguccgugcggcgauguagaugggccggagacugccagucuggcugcccaccgcauuucaccagcaauucauuuagugacgauugggcugggaagauggacagggcgggacugggcuucuccgguuguucugaugggugcggaggcgcagccugugguugcuuuaacgcugcccccagcuguaucuucuggcgcaaauggguagaaaauccucacggcauuaucuggaagguguccccaugcgcagccuggguucccucagcugucauugagcuaacaaugccuagcggggaagugcggacuuuccacccaaugaguggaauccccacccagguguuuaaaggcgucucuguuacauaucucggguccgacauggaggugagcggacugacugaucuuugugaaauagaggaguugaagucgaaaaagcuggcccucgcaccgugcaaccaggcgggcaugggugugguagggaaagucggagaaauccaauguucaucugaggaaagugcuagaaccauuaagaaggacggcugcaucuggaacgccgaucugguggguauugagcuuaggguugacgaugcaguguguuacuccaaaaucacaagcgucgaagccguggcuaauuauucugccauaccuaccacuauuggcgggcugcgcuucgagcgaagccaugacucccagggaaagaucucaggcaguccauuggauauuagcgcaauccgggggucuuuuuccguuaacuaccguggacucagacugucauuaagugagauaacggcuacaugcaccggcgaagugacuaauguaagcgguugcuacuccuguaugaccggggccaaagucucuaucaagcugcacucgagcaaaaacucaacagcgcaugugaggugcaagggagacgagaccgccuucuccgugcuagaaggcguccacaguuauauuguuucucucagcuuugaucacgcugugguagacgagcagugucagcugaauugcgguggccaugaaucccaagugacucuuaaggggaacuugaucuuccuggacguccccaaauuuguggauggaucauacaugcagacauaucacucuacgguuccuaccggcgcaaauauucccagcccaacugacuggcucaacgcccuguucgggaauggauuaagucgcuggauccugggcgugauagguguccuucucgggggauuggcucuguuuuccaugauuaugagccuauucaagcugggcacaaaacagguguuucggucuagaaccaagcucgccuga

SEQ ID NO: 11474 - RNA, 3222 nt, Artificial Sequence
  derived and/or modified CDS sequence (opt3) from SFTSV(JS2014-H.longicornis-02)__KR230786.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguguuuuucgagcgucccaccuuugacggguacguuggaugggguuguggcagcgggaaaucuagaacagaauccggagagcugugcucaagcgauaguggcacuucuuccggucuucugccuagcgacagggucuuguggaucggggauguggcuugucagccaaugacgcccauuccuguagaagccuuccucgagcugaagucguuuucucaguccgaguucccagacaucugcaaaauagauggaauuguuuuuaaucagugugaaggcgagucacugccgcaacccuucgacguggcauggauggaugucggccacagucauaagaucauuaugcgggaacacaaaaccaagugggugcaggagagcuccucuaaggacuuugugugcuauaaagaggggacaggaccuuguccagaaagcgaggaaaagacuugcaaaaccucagguaguugccgcggcgacaugcaguucuguaaggucgccgggugcgagcacggagaagaggcuuccgaggcaaaauguagaugcagccucguucauaagcccggcgaagugguagugucuuacggugggaugaggauccggccuaaauguuacggcuuuucacgcaugauggccacauuagaggucaaccagccagaacaacgacugggacagugcaccggcugucaccuugagugcaucaaugggggagugagauugauuacucugacaagugaacuaaagagcgcuaccguuugugccucccauuucugcagcucggcgacgagcgguaagaaauccacugagauacaguuccacucaggcagucucguggggaagaccgcaauccacgucaaaggagcccugguggauggcacagaguuuacuuucgaagguucuuguauguuucccgacgggugcgaugcuguagacugcaccuucuguagggaguuucuuaagaacccgcaaugcuauccugccaaaaaguggcuguucauuaucauaguuauuuugcucggcuacgcaggacugauguuacugacaaaugugcucaaggcuaucggcaucugggggagcugggucauugcccccgugaaacuuauguuugcgaucauuaagaaacugaugcggaccgucuccuguuugaugcguaagcuaauggaucgcggaagacaggugauacaugaagagaucggugaaaacagggagggcaaucaggacgauguucggauugagauggcccgaccacgcagagugaggcacuggauguauucaccuguaauccugacgauccucgcaauugggcuggcugaaagcugcgacgagaugguccaugccgauucuaaacuuguguccugucggcagggaaguggcaacaugaaggaaugcguuacuacaggucgcgcucuguugcccgccgugaauccagggcaagaggcaugucuccacuucaccgcccccggcagcccugacucuaagugccugaaaauaaaggucaaaagaaucaacuuaaaguguaaaaaguccucaaguuacuuugugccagaugcuaggagccguugcacuucgguacggcgauguagaugggcgggagacugccaguccggcugcccgccccauuucacaucuaauagcuuuucagacgauugggcagggaagauggacagggccggacugggcuucagugguuguuccgaugggugcggaggcgcugccugugguugcuuuaacgcagccccuucuuguauuuucuggcgcaaauggguggagaauccacacggcaucauuuggaagguuagccccugcgcugccugggucccuuccgcagugaucgaacuaaccaugccaucaggggaggugcggacguuccaccccaugagcggaauaccgacccaggucuuuaaaggcguuagugugacauaucucgggucugacauggaaguguccggacugacugaucuuugugagaucgaagaguugaagucuaaaaagcuggcgcucgcuccuugcaaccaggccggcauggguguagucgggaaagugggagagauucaauguucgucagaagagucugcaagaaccaucaagaaggacggcugcauuuggaacgccgaucugguugguaucgaacuuaggguggacgaugcugucuguuacaguaaaauaacauccguggaggccguugcaaauuauagcgcuauuccaacuaccaucggcgggcugcgcuucgaacgaucucaugacagccagggaaagauuuccggcucacccuuggauaucacagccauacgggggaguuuuagcgugaacuaccguggacucagacugucuuuauccgagaucaccgcgacuugcacgggcgagguaacaaaugucucagguugcuacaguuguaugaccggggccaaagugagcauuaagcugcacuccucuaaaaacucgacugcucaugugaggugcaagggagacgaaaccgcauucagcguccuagagggcguucacucauauacagugucccucaguuuugaucacgccguaguggacgaacagugucagcugaauugcgguggccaugagucucaagucacccuuaaggggaacuugaucuuccuggacgugccuaaauuuguugauggaagcuacaugcagacuuaucacuccacagugcccacgggcgcuaauauuccaucaccuaccgacuggcucaacgcccuguucgggaauggauuaucucgcuggauccugggcgucauaggugugcuucucgggggauuggcacuguuuuucaugauuaugagccuauuuaagcugggcacuaaacagguuuuccggaguagaacaaagcucgcguga

SEQ ID NO: 11475 - RNA, 3222 nt, Artificial Sequence
  derived and/or modified CDS sequence (opt3) from SFTSV(JS2014-H.longicornis-03)__KR230787.1__GP
augaugaaggugaucugguucagcucccugaccugcuuugucauucaguguucuggcgacucagggcccauaaucugcgccggaccuauucacaguaacaaaagcgcugauaucccacaucuccuugguuacuccgagaagauuugucaaaucgacagacugauacacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugaucgugccuggcccaaguuauaagggcaagguuuucuucgagcgucccacauuugacggguacgugggaugggguuguggcagcgggaaaucuagaacugaauccggagagcugugcucaagcgauaguggcacgucuuccggucuucugccuagcgacagggucuuguggauuggggauguggcuugucagccaaugacccccaucccugaagagacauuccucgagcugaagucguuuucucaguccgaauuuccagacauuugcaaaaucgauggaauaguauuuaaucagugugagggcgaaucacugccgcaacccuucgacguugccuggauggaugugggccacagucauaagauuaucaugcgggagcacaaaacuaaguggguccaggagagcuccucuaaggacuuugugugcuauaaagaagggaccggaccuuguagcgagucagaagagaagacaugcaaaaccagugguuccugccgcggcgacaugcaguucuguaagguggcagggugcgaacacggagaggaggccagcgaagcuaaauguagaugcucucucguccauaagccaggcgagguugugguaucauacggugggaugaggauucggcccaaauguuacggcuuuagucgcaugauggcaacuuuagaagugaaccagccugagcaacgaaucggacagugcacaggcugucaccuggaaugcaucaaugggggagucagacuuauuaccuugacgagcgagcugaaguccgccacugugugugcuucucauuucugcucgagcgccaccuccgguaagaaaucaacagagauacaguuccacaguggcucucuaguugggaagacugcgauccacgugaaaggagcacucgucgauggcaccgaauuuacauucgaggguagcuguauguuuccagacgggugcgaugccguggacugcaccuucuguagggaauuucugaagaacccccaaugcuauccggcuaaaaaguggcuuuucauuaucauaguaauucuguugggcuacgccggacucaugcuguuaacgaauguucugaaggcaaucggcaucuggggguccugggugauugcuccugucaaacucauguuugccaucauuaagaaacuuaugcggacugugucaugucugaugggaaaguugauggaucguggucgccaggucauacaugaggaaaucggcgagaacagagaggggaaucaggacgaugugaggauugaaauggcgcggccccgacgcguuagacacuggauguauagcccagugauccuaacauuccuggccaucggacucgcagagucuugcgacgaaaugguacaugcugauuccaaacuggucaguuguaggcagggcagcgguaacaugaaggagugcgugaccacugggcgggcccuucugccugcuguuaaucccggccaagaggccuguuugcacuuuacagcaccaggaucucccgacuccaagugccucaaaauuaaggugaaacgcauaaaccugaaguguaaaaagucaaguagcuacuucgucccugaugccagaucgaggugcaccuccgugcgucggugucgaugggcuggcgacugccagucugggugcccaccgcauuuuacgagcaauucauucagugacgauugggcgggaaagauggacagagcaggcuuagguuuuuccggguguucugauggaugcggcggugccgcuuguggcugcuucaacgccgcacccagcuguaucuucuggaggaaauggguagaaaauccucacgggauuaucuggaagguguccccaugcgccgcuuggguucccucagccgucauugagcugaccaugccuagcggagaagugcgcacauuucacccaaugaguggcauccccacucagguguucaaaggggucucuguuaccuaucuaggauccgacauggaggugagcggccucacagaucugugugaaauagaggagcuuaagucgaaaaaguuggcacuggcgccgugcaaccaggcugguaugggggugguaggaaaagucggcgaaauccaauguucaucugaggaaagugcccggacuauuaagaaggacgguugcaucuggaacgcagaucucgugggcauugagcugagaguugacgaugccguguguuacuccaaaaucaccagcgucgaagcuguggccaauuauucugcaauaccuacaaccauugggggacuuagguuugagcgcagccaugacucccagggcaagaucucagggaguccacuggauauuacugcuauccgaggcagcuucucuguuaacuaccggggauugcgucucucccugucagagauaacggccacaugcaccggugaagugacuaauguaagugggugcuacagcuguaugaccggagcgaaagucuccaucaaguuacacucuucgaaaaacagcacagcccaugugagaugcaagggcgacgagaccgcuuuuucagugcuggaagguguccacuccuauacuguuagucuaucuuucgaucacgcagugguagacgagcagugucagcucaauugcggcgggcaugaaagccaagugacacugaagggaaaccuuaucuuuuuggacguccccaaauucguggauggcuccuacaugcagacguaucacucaaccguuccuacuggggccaauauucccucuccaacagacuggcugaacgcucucuuuggaaauggccugaguagguggauuuuaggugugaucgggguccugcuuggaggcuuggcccucuucuuuaugauaaugagccuguucaagcuaggcaccaaacagguguuucgcucccggacaaagcuggcauga

SEQ ID NO: 11476 - RNA, 3222 nt, Artificial Sequence
  derived and/or modified CDS sequence (opt3) from SFTSV(JS2014-Hedgehog-02)__KR230789.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugaggauccggcccaaauguuacggcuuuagucgcaugauggcaaccuuagaagugaaccagccugagcaacgaaucggacagugcacuggcugucaccuggaaugcauuaaugggggagucagacuuauaacauugaccagcgagcugaaguccgccacggugugugcuucucauuucugcucgagcgccacuuccgguaagaaaucaaccgagauccaguuccacaguggcucucuaguugggaagacagcgauucacgugaaaggagcacucgucgauggcacugaauuuaccuucgaggguagcuguauguuuccagacgggugcgaugccguggacugcacauucuguagggaauuucugaagaacccccaaugcuauccggcuaaaaaguggcuuuucaucauaauuguaauccuguugggcuacgccggacucaugcuguuaaccaauguucugaaggcaaucggcauuuggggguccugggugaucgcuccugucaaacucauguuugccauuauaaagaaacuuaugcggacggugucaugucugaugggaaaguugauggaucguggucgccaggucauccaugaggaaauuggcgagaacagagaggggaaucaggacgaugugaggaucgaaauggcgcggccccgacgcguuagacacuggauguauagcccagugauccuaacuauucuggccauaggacucgcagagucuugcgacgaaaugguacaugcugauuccaaacuggucaguuguaggcagggcagcgguaacaugaaggagugcgugacaaccgggcgggcccuucugccugcuguuaaucccggccaagaggccuguuugcacuucacugcaccaggaucucccgacuccaagugccucaaaaucaaggugaaacgcauuaaccugaaguguaaaaagucaaguagcuacuuugucccugaugccagaucgaggugcacauccgugcgucggugucgaugggcuggcgacugccagucugggugcccaccgcauuucaccagcaauucauuuagugacgauugggcgggaaagauggacagagcaggcuuagguuucuccggguguucugauggaugcggcggugccgcuuguggcugcuuuaacgccgcacccagcuguaucuucuggaggaaauggguagaaaauccucacgggauuaucuggaagguguccccaugcgccgcuuggguucccucagccgucauagagcugacgaugccuagcggagaagugcgcaccuuccacccaaugaguggcauccccacacagguguuuaaaggggucucuguuacuuaucuaggauccgacauggaggugagcggccucaccgaucugugugaaauugaggagcuuaagucgaaaaaguuggcacuggcgccgugcaaccaggcugguaugggggugguaggaaaagucggcgaaauccaauguucaucugaggaaagugcccggacaauuaagaaggacgguugcaucuggaacgcagaucucgugggcauagagcugagaguugacgaugccguguguuacuccaaaauuacuagcgucgaagcuguggccaauuauucugcaaucccuaccacaauugggggacuuagguucgagcgcagccaugacucccagggcaagaucucagggaguccacuggauauaaccgcuauccgaggcagcuuuucuguuaacuaccggggauugcgucucucccugucagagauuacugccacgugcacaggugaagugaccaauguaagugggugcuacagcuguaugacuggagcgaaagucuccaucaaguuacacucuucgaaaaacagcaccgcccaugugagaugcaagggcgacgagacagcuuucucagugcuggaagguguccacuccuauaccguuagucuaucuuuugaucacgcagugguagacgagcagugucagcucaauugcggcgggcaugaaagccaagugacucugaagggaaaccuuauuuucuuggacguccccaaauuuguggauggcuccuacaugcagacauaucacucaacgguuccuaccggggccaauauccccucuccaacugacuggcugaacgcucucuucggaaauggccugaguagguggauauuaggugugauugggguccugcuuggaggcuuggcccucuuuuucaugaucaugagccuguuuaagcuaggcacaaaacagguguuccgcucccggaccaagcuggcauga

SEQ ID NO: 11477 - RNA, 3222 nt, Artificial Sequence
  derived and/or modified CDS sequence (opt3) from SFTSV(KACNH)__KU507558.1__GP
augaugaaggugaucugguucagcucccugauuugccucgucauacaguguucuggcgacucagggcccaucauuugcgccggaccuauccacaguaacaaaagcgcuuccauuccacaucuucuggguuacucugagaagaucugucaaauagauagauugauccacguuucgucaugguuaaggaaucauagccaguuucagggcuauguggggcagcggggaggccgcagucaaguauccuacuauccggcagaaaacucuuacagccgaugguccggucugcuaucacccugcgacgccgauuggcucgggaugcugguggucaaaaaggcgaaaggaagugacaugauugugccuggcccaagcuauaagggcaagguuuucuuugagcgucccaccuucgauggguacgugggaugggguuguggcucugggaaauccagaacagaaucaggagagcuuugcagcagugacucuggcacuuccagcggucuguugccuucggauaggguccucuggaucggggacguggcuugucagccaaugacgcccauuccugaagagaccuuucuggagcugaagucuuucucccagucagaauuuccagauaucugcaaaauagacggaauuguauucaaucagugugagggcgaaagucucccgcaacccuuugauguugccuggauggacgugggccacagccauaagaucauuaugcgggagcacaaaacaaaguggguccaggaguccucuagcaaggauuucgugugcuauaaagaagggacuggaccuuguucagagagugaagagaaggcaugcaaaaccuccgguagcugccgcggcgacaugcaguuuuguaagguggccgggugcgaacacggagaggaggcuucugacgcaaaauguagaugcucauuaguccauaagccaggcgaaguugugguaaguuacggugggaugagggugcggcccaaauguuacggcuucagccgcaugauggccacacuggaggucaacccuccagaacagcgaaucggacaaugcaccggcugucaccuugagugcaucaaugggggagugagauugauuacucugacauccgaacuaaagucugcuaccguuugugccucgcauuuuugcagcuccgcgacgucagguaagaaaaguacugagauacaguuccacucuggcagccucguggggaagaccgcaauccacgucaaaggagcccugguggauggcacagaguucacuuuugaagguuccuguauguuccccgacgggugcgaugcuguagacugcaccuuuuguagggaguuccuuaagaacccgcagugcuauccugccaaaaaguggcuguuuauuuugaucguuauacuccugggcuacgcaggauuaaugcugauuacaaaugugcucaaggcuaucggcgucugggggucaugggugaucgcccccgucaaacuuauguucgcgauuaucaagaaacugaugcggaccgugagcuguuugaugggaaagcuaauggaucguggucgccaaguuauucaugaagagauaggcgaaaacggggagggaaaucaggacgaugugagaaucgagauggccaggccacggcgaguacgccacuggauguauucuccugucauucugacgauccucgcaaucggccuggcugaagguugcgacgagauggugcaugccgauuccaaacuuguuaguuguagacaggggagcggcaacaugaaggaaugcgugacuacaggaagggcucuguugcccgccgucaauccaggccaggaggcaugucuccacuuuaccgcccccgggucuccugacuccaagugccugaaaauuaaggugaaacggauaaacuuaaaguguaaaaagucaaguagcuacuucguaccagaugcucgcucgagaugcacuuccgugaggcguugucggugggcgggagacugccaaucuggcugcccgccccauuuuacaagcaauucauucagugacgauugggcagguaagauggaccgagccgggcugggauuuuccggcuguucugaugguugcggcggggcugccuguggaugcuucaacgcagccccuagcuguaucuuuuggagaaaauggguugagaauccacacggcauuaucuggaaggucucccccugcgcugccugggugccuucagcagugauugaacuaaccaugccaagcggggaggucaggacguuccaccccaugaguggaaucccgacccagguuuucaaaggcgugucugugacauaucucgguuccgacauggaaguaagcgggcugacugaucuuugugagauagaagaguugaagucgaaaaagcuggcgcucgcuccuugcaaccaggccggaaugggcgucguggguaaaguuggcgagauccaguguucaucugaagagagugcacgcaccauuaagaaggacgggugcaucuggaacgccgaucuggugggaauugaacuucgggucgacgaugcuguguguuacuccaaaaucacaagcguugaggccguggcaaauuauucugcuauaccaacuaccauuggcgggcugagauuugaaaggagccaugacucccaaggaaagaucucaggcagucccuuggauauuacagccauccgcgguagcuucucuguaaacuaccgagggcuccggcuguccuuaucagagauaaccgcgacuugcacgggagaggucacaaaugugaguggcugcuacagcuguaugaccggugccaaaguguccaucaagcugcacucuucgaaaaacagcacugcucauguccguugcaagggcgacgaaaccgcauuuucaguucuagagggggugcacuccuauacaguaagucucucuuucgaucacgccguggucgacgaacagugucagcugaauugcggaggccaugagagccaggugacccuuaaggggaacuugauuuuucuggacguuccuaaauucguggauggauccuacaugcaaacuuaucacucaacaguccccacgggcgcuaauaucccaucuccuaccgacuggcucaacgcccuguuugguaauggguuaagcagauggauucugggagugaucggcguucuuuugggcgggcucgcacuguucuuucuaauaaugagucuguucaagcucggaacuaaacagguguuuaggucccgcacaaagcuggcguga

SEQ ID NO: 11478 - RNA, 3222 nt, Artificial Sequence
  derived and/or modified CDS sequence (opt3) from SFTSV(KACNH2)__KU507559.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccaacaggguccucuggaucggggauguggcuugucagccaaugacccccauuccugaagagacauuucuggagcuuaagagcuucucgcagucugaauuuccagacaucugcaaaauagauggaauuguauucaaucagugugaguccgaaucacucccgcaacccuuugacguugccuggauggaugugggccacagucauaagaucauuaugcgggagcacaaaacuaaguggguccaggagagcuccucuaaggacuucgugugcuauaaagaaggcaccgggccuuguagcgagucagaggaacgcacaugcaagaccaguggauccugcagaggugauaugcaguuuuguaaaguggcaggcugcgaacacggggaggaggccagcgaagcuaaguguaggugcucuuuaguccauaaaccaggagagguugugguaucauacggcgguaugcgggugcgccccaaguguuacggguucagucgaaugauggcaacucuggaagucaacccuccagagcagagaaucggccaaugcacaggaugucacaucgaaugcauuaauggcggggugaggcuuauaaccuugacgagcgagcugaaauccgccacuguuugugcuucucauuuuugcucgagcgccaccuccggaaagaagucaacagagauccaguuccacagugguucucuagugggcaaagcggcaauucacgucaagggggcccucguggacggaacugaauuuaccuuugagggcagcuguauguuccccgacgguugcgaugcuguagacugcacauuuugucgggaauuucugaaaaacccgcagugcuauccugccaagaaauggcuuuuuaucauaauuguuauccuguugggguacgcaggccucaugcuguuaaccaaugugcugaaggcuaucggagucuggggcuccugggugauugcccccgucaagcucauguucgcgaucauuaaaaagcugaugcguucagugagcugucugauggggaaauugauggaucgcggaagacaaguuauacaugaggaaaucggugagaacagggagggcaaucaggacgaugugcggauugaaauggcccgaccacgcagaguaaggcacuggauguauucuccugucauccuaacgauccuggcaauugggcucgcugagggaugcgacgaaauggugcaugccgauuccaagcugguuaguugucggcagggcggugggaacaugaaagagugcgugacuacaggccgcgcccuucugcccgcugucaauccaggacaggaggcauguuugcacuuuaccgcccccggcagcccugacucuaagugccucaagauaaaagugaagagaaucaaccugaaauguaagaaauccucaaguuacuucguaccagaugcuaggagccguugcacuucggugcggcgauguagaugggcgggggacugccaauccggaugcccgucucauuuuacaagcaauucauucagugaugacugggcaggcaagauggacagggccgguuuaggguuuuccggauguucugauggcugcgguggcgcugccugugggugcuucaacgcagcccccagcuguauuuucuggcgcaaguggguugaaaacccucacggaaucauuuggaaagucuccccaugcgcugccugggugcccucagcagugaucgagcugaccaugccuagcggcgaaguccggacguuccacccaaugagugggauacccacccagguuuucaagggagugucugugacauaucuaggcuccgacauggagguaagcggucucacugaucugugugaaaucgaggagcuuaaaucgaagaaauuggcgcuggcuccgugcaaucaggccgggaugggagucgugggcaagguuggugaaauucaguguucaucugaggaaagugcaagaaccaucaaaaaggacggcugcauuuggaacgccgaucucguggggaucgagcugagggucgacgaugcuguguguuacuccaagauaacaagcguugaagccguggcaaauuauucugcuauuccuacuaccaucggaggccuucgcuuugagcgaagccaugacucccaagggaaaauuucaggaaguccacuggauaucacagccauacggggcagcuucucuguaaacuaccgugguuugagacucucccugucagagaucaccgcgacuugcacgggggaagucacaaaugugaguggaugcuacagcuguaugaccggcgccaagguguccauuaaauuacacucuucgaagaacagcacugcucaugucaggugcaaaggugacgagaccgcauuuucaguucuggaaggcauccacuccuauacagugagucuaucuuucgaucacgccguaguggacgagcagugucagcucaauugcgggggacaugaaagccaggucacccugaagggcaaccuuauuuucuuggaugugcccaaguucguugacggguccuacaugcaaacuuaucacucaucugugccuacaggagcuaauauccccagcccaacggacuggcugaacgcccucuuuggcaauggucugagucgcuggauauuaggggucauuggagugcugcuuggcggcuuggcacucuucuuucugaucaugucccuauucaaacuggggaccaagcagguuuuucggagcagaacuaaacucgcguga

SEQ ID NO: 11479 - RNA, 3222 nt, Artificial Sequence
  derived and/or modified CDS sequence (opt3) from SFTSV(KACNH3)__KP663744.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcugaagucauucucgcagucugaauuuccagauaucugcaaaauagacggaauuguauucaaccagugugaguccgaaucacucccgcaacccuuugauguugccuggauggacgugggccacagucauaagaucauuaugcgggagcacaaaacuaaguggguccaggagagcuccucuaaggauuucgugugcuauaaagaaggcaccgggccuuguagcgagucagaagagaagacaugcaaaaccaguggauccugccgcggugacaugcaguuuuguaagguggcaggcugcgaacacggggaggaggccagcggagcuaaauguagaugcucuuuaguccauaagccaggcgaaguugugguaucauacggugggaugagggugcggcccaaauguuacggcuucagucgcaugauggcaacucuggaggucaauccuccagaacagcgaaucggacaaugcacaggcugucaccuugagugcaucaacgggggagugagauugauuacccugacgagcgaacuaaaguccgccacuguuugugcuucucauuuuugcucgagcgccaccuccgguaagaaaucaacagagauacaguuccacaguggcucucucguggggaagacugcgauccacgucaaaggagcacugguggacggcaccgaguucacauuugaagguagcuguauguuccccgaugggugcgacgccguagauugcaccuuuuguagggaguuccuuaagaauccgcagugcuauccugcuaaaaaguggcuguuuauuaucauaguuauuuugcucggcuacgccggacugauguuacugacgaacgugcucaaggcaaucggcgucuggggguccugggugaucgcucccgucaaacuuauguucgccauuaucaagaaacugaugcggucagugagcuguuugaugggaaagcuaauggaccguggucgccaaguuauucaugaagagauaggcgaaaauagagaggggaaccaggaugacgugaggaucgagauggcgcggccacgacgcguaagacacuggauguauucuccugucauucugacuauccucgccaucggacuggcagaaggcugcgaugagauggugcaugcugacuccaaacuuguuaguuguaagcaggguagcgggaauaugaaggaaugcgugacaaccggcagggcccuguugcccgcugucaacccaggacaggaggccugucuccacuuuacugcacccggcucuccugauuccaaaugccugaagauuaaagugaagcggauaaauuuaaaauguaagaagucaaguagcuacuucguaccagacgcccgcucgagaugcacauccgugaggcguugucggugggcuggggauugccaaucuggaugcccgagccauuuuaccucaaacaguuucuccgacgacugggcgggcaaaauggaucgagcaggucugggguuuucuggauguagcgacggcugcgguggcgccgcuugugggugcuucaaugccgcacccuccuguaucuuuuggagaaaguggguugagaacccucacggaauuaucuggaaagucucaccaugcgccgcuugggugcccagcgccgugauugaacuaacgaugccuaguggcgaggucaggaccuuccacccaaugucugggauccccacacagguuuucaagggaguguccgugacuuaucucggcagcgauauggaaguaucgggucugaccgaccuuugugagauagaagaguugaaaucaaagaaacuggcacucgcgccgugcaaccaggcugggaugggagucgugggcaagguuggugagauccaguguucuagugaagaguccgcccgcacaauuaagaaagauggcugcaucuggaaugcagaccugguggggauugaacuucgggucgaugacgccguguguuacagcaagaucacuucuguugaggcuguggccaacuauagcgcaauaccuaccacaauuggaggccugagauuugaaaggucccaugauucacaagggaaaaucaguggaagcccauuggacauuaccgcuauccgcggcucuuucuccguaaauuaccgaggucuccggcugucauuaagugaggucacugccacgugcacaggggaggugaccaacgugagcggaugcuacuccuguaugacuggcgcgaaggucucuauaaaacugcacucgagcaagaauagcaccgcccauguucguugcaagggugaugaaacagcuuuuuccgugcuagagggcguacacaguuauaccgugucucucagcuucgaccacgcagucguggaugaacagugucagcugaacugcgggggacaugagucccagguuacucuuaaaggcaauuugaucuuucuggacgugcccaaguucgucgacgggucauacaugcaaacauaucacucuagcgugccuacgggagccaacauucccaguccaaccgauuggcucaaugcucuguuuggcaacgguuuauccagauggauccuggggguuauuggagugcuuuugggcggccucgcccuguucuuucuaaucaugagccuguucaaacucgggacuaagcaggucuuuaggucucgcacaaaacuggcauga

SEQ ID NO: 11480 - RNA, 3222 nt, Artificial Sequence
  derived and/or modified CDS sequence (opt3) from SFTSV(KADGH)__KU507548.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaucugcaaaauagacggaauuguauucaaccagugugaguccgaaucacuggcccaaccguuugauguugcauggauggacgugggccacagucauaagaucauuaugcgggagcacaaaacuaaguggguccaggagagcuccucuaaggauuucgugugcuauaaagaaggcaccgggcccuguagcgagucagaagagaagacaugcaaaaccaguggauccugccgcggugacaugcaguuuuguaagguggccggcugcgaacacggggaggagacuagcgucgcuaaauguagaugcucuuuaguucauaagccuggagaagugguagugucauacggcgguaugaggguccggccaaaauguuacggguucagucgcaugauggcaacacuggaggugaaucccccugaacagcgaaucggccaaugcaccggaugucaccuugagugcaucagcggcgggguuagauugauuacgcugacuuccgaacuaaagucugccaccgugugugcuucgcauuuuugcagcuccgccacaucaggaaagaaaaguacugagauacaguuccacucugguagccucgucggcaaggcggcaauccacgugaaagggguacugguugacggaaccgaguucacauuugaaggcuccuguauguucccagaugguugcgacgccguggauugcaccuuuuguagggaguuccuuaagaacccccagugcuauccggcuaaaaaguggcuguuuauuaucauagucauuuugcucggguacgccggccugauguuacugacgaaugugcucaaggcaaucggagucuggggcucaugggugaucgcuccuguuaaacuuauguucgccauuaucaagaaacugaugcggagcgugucuuguuugauggggaagcuaauggaccguggacgccaaguaauucaugaagagauaggugaaaacagagagggcaaucaggaugacgucaggaucgagauggcgcggccccgacgcgugagacacuggauguauuccccaguuauucugacuauccucgccaucgggcuggcagaaggaugcgaugagauggugcaugcugacaguaaacuugucagcuguaggcagggcucugguaacaugaaggaaugcgugacaaccgggcgggcccuguugccugcuguaaaucccggccaggaggccugucuccacuuuacugcaccaggaucccccgauucaaagugccugaaaauuaaggugaaacgcauaaacuuaaaguguaaaaagaguagcucguacuucguuccugacgccagauccaggugcacaucuguccgucggugucgaugggcuggcgauugccaaagcgggugcccaucacauuuuaccaguaauuccuucucugacgacugggcgggaaagauggauagagcaggccuggguuuuagcggguguuccgacggaugcggcggugccgcuuguggcugcuucaacgccgcaccgucauguaucuuuuggaggaaauggguggagaauccccacgggauuaucuggaaggugagcccuugcgccgcuugggucccaagugccguuauugaacuaacgaugcccucuggagaggugcgcaccuuccacccuauguccggcaucccaacacagguguucaaagggguaagcgucacuuaucucggaucggauauggaagugucaggccugaccgaccuuugugagauagaagaguugaagucuaaaaagcuggcacucgcgcccugcaaccaggcugguauggggguugugggaaaagucggcgagauccaguguaguuccgaagagagcgcccggacaauuaagaaggaugguugcaucuggaacgcagaccuggugggcauugaacuuagaguugaugacgccguguguuacucuaaaaucacuagcguagaggcugucgccaauuauuccgcaauaccgaccacaauugggggacugagguuugaacgcucacaugauagucaaggcaagaucagcgggucuccuuuggacauuaccgcuauccgaggauccuucucagugaacuaccggggccuccgucugaguuuaagcgagauaacugccacgugcacaggugaggugaccaaugucuccgggugcuacucuuguaugacuggagcgaaaguuucgaucagacugcacagcucaaagaacuccaccgcccaugugaggugcaaagaagaugagacagcuuuuaguguacuagaaggcgugcacucuuauaccgucagccucuccuucgaccacgcagugguugaugagcagugucagcugaauugcgguggccaugaaucacaggugacucuuaaggggaacuugauuuuucuggacgucccaaaguucguggacggaucuuacaugcaaacauaucacagcaguguucccacgggcgccaauaucccuucccccaccgauuggcucaacgcucuguuugggaauggauuaagccgcuggauucugggcgugaucgguguccuuuugggagggcucgcccuguucuuucuaauaaugucucuguucaaacucggcacuaagcagguauuucggucaagaacaaaacuggcauga

SEQ ID NO: 11481 - RNA, 3222 nt, Artificial Sequence
  derived and/or modified CDS sequence (opt3) from SFTSV(KAGBH)__KU507560.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuccuggagcugaagucauuuucgcagucugaauuuccagauaucugcaaaauagacggaauuguauuuaaccagugugaguccgaaucacucccgcaacccuucgauguugccuggauggacgugggccacagucauaagaucauuaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucuuuaguccauaagccaggagagguugugguaucauauggcgguaugagggugcggcccaaauguuacggguuuagucgcaugauggcaacucuggaagucaauccuccagagcagcgaaucggccaaugcacaggaugucaccuugaaugcaucaacggcggggugagauugauuacccugacgagcgagcuaaaguccgccacuguuugugcuucucauuucugcucgagcgccaccuccggaaagaaaucaacagagauacaguuccacagugguucucucgugggcaagacugcgauccacgucaaaggggcacugguggacggaaccgaauuuacauucgagggcagcuguauguuucccgaugguugcgacgccguagauugcaccuucuguagggaauuucuuaagaauccgcagugcuacccugcuaaaaaguggcuguucauuaucauaguuauuuugcucggguaugccggccugauguuacugacgaacgugcucaaggcaaucggagucuggggcuccugggugaucgcucccgucaaacuuauguuugccauuaucaagaaacugauucggucagugagcuguuugauggggaagcuaauggaccguggacgccaaguuauacaugaggaaaucggugagaauagagagggcaaccaggaugacgugaggauugaaauggcgcggccacgacgcguaagacacuggauguacucuccugucauccugacuauccucgccauugggcuggcagagggaugcgaugaaauggugcaugcugacuccaaacuuguuaguuguaagcagggcagcgguaauaugaaggagugcgugacaaccgggagggcccuguugcccgcugucaacccaggccaggaggccugucuccacuucacugcacccggaucuccugauuccaaaugccugaagauaaaagugaagcggaucaauuuaaaauguaagaagucaaguagcuauuuuguaccagacgcccgcucgagaugcacauccgugaggcguugucggugggcuggcgauugccaaucugggugcccgagccauuucaccucaaacaguuuuuccgacgacugggcgggaaaaauggaucgagcaggccuggguuucucuggguguagcgacggaugcggcggugccgcuuguggcugcuuuaaugccgcacccuccuguauuuucuggagaaaguggguugaaaacccucacgggaucauuuggaaagucucaccaugcgccgcuugggugcccagcgccgugaucgagcuaacgaugccuaguggagaagucaggaccuuccacccaaugucuggcauacccacacagguuuuuaaggggguguccgugacuuaccucggaagcgauauggagguaucgggccugaccgaccuuugugaaaucgaggaguugaaaucaaagaaacuggcacucgcgccgugcaaccaggcugguaugggggucgugggaaagguuggcgaaauucaguguucuagugaggaauccgcccgcacaaucaagaaagaugguugcauuuggaaugcagaccuggugggcaucgagcuucgggucgaugacgccguguguuauagcaagauaacuucuguugaagcuguggccaacuacagcgcaauuccuaccacaaucgggggacugagauucgagaggucccaugauucacaaggcaaaauuagugggagcccauuggacaucaccgcuauacgcggaucuuuuuccguaaauuaucgaggccuccggcugucauuaagugagaucacugccacgugcacaggugaagucaccaacgugagcgggugcuacuccuguaugacuggagcgaaggugucuauuaaacugcacucgagcaagaauagcaccgcccauguccguugcaagggcgaugagacagcuuucuccguucuagaaggugugcacaguuacaccguaucucucagcuuugaccacgcaguggucgaugagcagugucagcugaacugcggcgggcaugaaucccaggugacucuuaaaggaaauuugaucuuccuggacguucccaaguuuguggacggcucauauaugcaaacauaccacucuagcgucccuacgggggccaacauucccaguccaaccgauuggcucaaugcucuguucggaaacggcuuauccagauggauccugggugugauagggguucuuuugggaggccucgcccuguuuuuccuaauuaugagccuguuuaaacucggcacuaaacagguguucaggucucgcacaaagcuggcauga

SEQ ID NO: 11482 - RNA, 3222 nt, Artificial Sequence
  derived and/or modified CDS sequence (opt3) from SFTSV(KAGBH3)__KU507561.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccaacaggguccucuggaucggggauguggcuugucagccaaugacccccauuccugaagagacauuccuggagcucaagagcuuuucgcagucugaauuuccagacaucugcaaaauagauggaauuguauuuaaucagugugaguccgaaucacugccgcaacccuucgacguugccuggauggaugugggccacagucauaagaucauuaugcgggagcacaaaacuaaguggguccaggagagcuccucuaaggacuuugugugcuacaaagaaggcaccgggccuuguagcgagucagaagagaagacaugcaaaaccaguggauccugccgcggugauaugcaguucuguaagguggcaggcugcgaacacggggaggagacuagcgaagccaaauguagaugcucuuuaguccauaagccaggagagguugugguaucauauggcgguaugagggugcggcccaaauguuacggguuuagucgcaugauggcuacacuggaagucaacccuccagagcagcgaaucggccaaugcaccggaugucaccuugaaugcaucaauggcggggugagaauuauaacguugacuagcgagcugaaguccgcaaccguuugugccucucauuucugcucgagcgcuacauccggaaagaaaucaacugagauccaguuccacagugguucucuagugggcaagaccgccauucacgucaaaggggcgcucguggacggaacagaauuuaccuucgagggcagcuguauguuucccgacgguugcgaugcaguagacugcacguucuguagggaauuucugaagaacccgcagugcuacccugccaaaaaguggcuuuucaucauaauuguuauccuguugggguaugcuggccucaugcuguuaacuaaugugcugaaggccaucggagucuggggcuccugggugauugcacccgucaaacucauguuugcuaucauuaagaaacuuaugcggucagugagcugucugauggggaaguugauggaucguggacgccaaguuauacaugaggaaaucggugagaacagagagggcaaucaggacgaugugaggauugaaauggcccggccacgacgcguaagacacuggauguacucuccugucauccuaacaauccuggcgauugggcucgccgagggaugcgacgaaauggugcaugcagauuccaaacugguucuuuguaagcagggcagugguaacaugaaggagugcgugaccacugggagggcucuguugcccgccgucaauccaggccaggaggcuugucuccacuucacagcccccggaagcccugacucuaaaugccugaagauaaaagugaagcggaucaacuuaaaauguaagaaguccucaaguuauuuuguaccagaugcacgcagcagaugcaccucggugaggcguugucggugggccggcgacugccaauccgggugcccgucucauuucacgagcaauucauuuagugaugacugggcuggaaaaauggaccgagcgggccuggguuucuccggguguucugauggaugcggcggugcagccuguggcugcuuuaacgcugcccccagcuguauuuucuggagaaaguggguugaaaacccucacgggaucauuuggaaagucuccccaugcgcagccugggugcccucagcugugaucgagcuaaccaugccuagcggagaagucaggacauuccacccaaugaguggcauacccacucagguuuuuaagggggugucugugaccuaccucggauccgacauggagguaagcggccugacagaucuuugugaaaucgaggaguugaaaucgaagaaacuggcccucgcaccgugcaaucaggcggguaugggggucgugggaaagguuggcgaaauucaguguucaucugaggaaagugcucgcacuaucaagaaagacgguugcauuuggaacgccgaucuggugggcaucgagcuucgggucgacgaugcaguguguuauuccaagauaaccagcguugaagccguggcuaauuacucugccauuccuacaaccaucgggggacugagauucgagaggagccaugacucccaaggcaaaauuucagggaguccauuggauaucacugcaauacgcggcagcuuuucuguaaacuaucgaggacuccggcuguccuuaucagagaucacggcuacaugcaccggugaagucacuaaugugagugggugcuacagcuguaugaccggagccaagguguccauuaaacugcacucuucgaagaacagcacagcgcauguccguugcaagggcgacgagaccgccuucucaguucuagaaggugugcacuccuacgcuguaagucucucuuuugaucacgcaguggucgacgagcagugucagcugaauugcggcgggcaugaaagccaggugacucuuaaaggaaacuugaucuuccuggauguucccaaguuuguggacggcuccuauaugcaaacauaccacucaucugucccuacgggggccaauauucccagcccaaccgacuggcucaacgcucuguucggaaauggcuuaaguagauggauccugggugugauagggguucuuuugggaggccucgcccuguuuuuccuaauuaugucccuguuuaaacucggcacuaaacagguguucaggagccgcacaaagcuggcauga

SEQ ID NO: 11483 - RNA, 3222 nt, Artificial Sequence
  derived and/or modified CDS sequence (opt3) from SFTSV(KAGBH4)__KU507562.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuccuggagcugaagucauuuucgcagucugaauuuccagauaucugcaaaauagacggaauuguauuuaaccagugugaguccgaaucacucccgcaacccuucgauguugccuggauggacgugggccacagucauaagaucauuaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucuuuaguccauaagccaggagagguugugguaucauauggcgguaugagggugcggcccaaauguuacggguuuagucgcaugauggcaacucuggaagucaauccuccagagcagcgaaucggccaaugcacaggaugucaccuugaaugcaucaacggcggggugagauugauuacccugacgagcgagcuaaaguccgccacuguuugugcuucucauuucugcucgagcgccaccuccggaaagaaaucaacagagauacaguuccacagugguucucucgugggcaagacugcgauccacgucaaaggggcacugguggacggaaccgaauuuacauucgagggcagcuguauguuucccgaugguugcgacgccguagauugcaccuucuguagggaauuucuuaagaauccgcagugcuacccugcuaaaaaguggcuguucauuaucauaguuauuuugcucggguaugccggccugauguuacugacgaacgugcucaaggcaaucggagucuggggcuccugggugaucgcucccgucaaacuuauguuugccauuaucaagaaacugaugcggucagugagcuguuugauggggaagcuaauggaccguggacgccaaguuauucaugaggaaauaggugagaauagagagggcaaccaggaugacgugaggaucgaaauggcgcggccacgacgcguaagacacuggauguacucuccugucauucugacuauccucgccaucgggcuggcagagggaugcgaugaaauggugcaugcugacuccaaacuuguuaguuguaagcagggcagcgguaauaugaaggagugcgugacaaccgggagggcccuguugcccgcugucaacccaggccaggaggccugucuccacuucacugcacccggaucuccugauuccaaaugccugaagauuaaagugaagcggauaaauuuaaaauguaagaagucaaguagcuauuuuguaccagacgcccgcucgagaugcacauccgugaggcguugucggugggcuggcgauugccaaucugggugcccgagccauuucaccucaaacaguuuuuccgacgacugggcgggaaaaauggaucgagcaggccuggguuucucuggguguagcgacggaugcggcggugccgcuuguggcugcuuuaaugccgcacccuccuguaucuucuggagaaaguggguugaaaacccucacgggauuaucuggaaagucucaccaugcgccgcuugggugcccagcgccgugauugagcuaacgaugccuaguggagaagucaggaccuuccacccaaugucuggcauccccacacagguuuuuaaggggguguccgugacuuaccucggaagcgauauggagguaucgggccugaccgaccuuugugaaauagaggaguugaaaucaaagaaacuggcacucgcgccgugcaaccaggcugguaugggggucgugggaaagguuggcgaaauccaguguucuagugaggaauccgcccgcacaauuaagaaagaugguugcaucuggaaugcagaccuggugggcauugagcuucgggucgaugacgccguguguuauagcaagaucacuucuguugaagcuguggccaacuacagcgcaauaccuaccacaauugggggacugagauucgagaggucccaugauucacaaggcaaaaucagugggagcccauuggacauuaccgcuauccgcggaucuuuuuccguaaauuaucgaggccuccggcugucauuaagugagauaacugccacgugcacaggugaagucaccaacgugagcgggugcuacuccuguaugacuggagcgaaggugucuaucaaacugcacucgagcaagaauagcaccgcccauguccguugcaagggcgaugagacagcuuucuccguucuagaaggugugcacaguuacaccguaucucucagcuuugaccacgcaguggucgaugagcagugucagcugaacugcggcgggcaugaaucccaggugacucuuaaaggaaauuugauuuuccuggacguucccaaguuuguggacggcucauauaugcaaacauaccacucuagcgucccuacgggggccaacauccccaguccaaccgauuggcucaaugcucuguucggaaacggcuuauccagauggauucugggugugaucgggguucuuuugggaggccucgcccuguuuuuccuaauaaugagccuguuuaaacucggcacuaaacagguguucaggucucgcacaaagcuggcauga

SEQ ID NO: 11484 - RNA, 3222 nt, Artificial Sequence
  derived and/or modified CDS sequence (opt3) from SFTSV(KAGBH5)__KP663738.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccacuuuacaagggcaagguuuucuucgagcgucccacauuugauggguaugugggaugggguuguggcucagggaaaaguagaacugaaagcggagagcugugcagcuccgacucaggcacgagcagugguuugcucccuucugauaggguccuguggaucggggacguggcuugucagccaaugacccccauuccugaagagacauuccuggagcucaaguccuuuagccagucggaauuuccagauaucugcaaaauagacggaauuguauuuaaccagugugagucugaauccuuaccgcaacccuucgauguugccuggauggacgugggccacucacauaagaucauuaugcgggagcacaaaacuaaguggguccaggagaguagcuccaaggauuuugugugcuacaaagaaggcaccgggccuuguucugagagcgaagagaagacaugcaaaaccucaggaaguugccgcggugacaugcaguucuguaagguggcaggcugcgaacacggggaggagacuuccgaagccaaauguagaugcagccugguccauaagccaggagagguugugguaucuuauggcgguaugagggugcggcccaaauguuacggguuuucacgcaugauggcuacacuugaagucaauccuccagagcagcgaaucggccaaugcaccggaugucacuuggaaugcaucaacggcggggugagacugauuacgcuaacuucggagcucaagagcgcaaccguuugugccucccauuucuguucuucggcuacaagcggaaagaaauccacugagauacaguuccacucagguagucuggugggcaagaccgccauccacgucaaaggggcgcuuguggacggaacagaauuuaccuucgaggguaggugcauguuucccgauggcugcgacgcaguagauugcacguucugucgggaauuucugaagaauccgcagugcuacccugccaaaaagugguuguucauuaucauaguuauucuccugggguaugcuggcuuaaugcugcucacuaacgugcuuaaggccgucggaguguggggcucuugggucaucgcacccgugaaacugauguuugcuaucauuaagaaauugaugcguagcguuuccugucuaauggggaagcugauggaccgcggaagacaagugauccaugaggaaauuggugagaauagggagggcaaccaggaugacguacggauagaaauggcccgaccacgcagagucaggcacuggauguacucaccugugauccucgcgauucuggccaucgggcuugcagagggaugcgaugaaaugguucaugcugacagcaaacuggugucuuguaagcagggcuccgguaauaugaaggagugcgucacaaccgggcgggccuugcuccccgcugugaacccaggccaggaggccugucugcacuucacugcacccggaaguccugauagcaaaugcuuaaagaucaaaguaaagcgcauuaaucugaaauguaagaagucuuccucauauuuugugccagacgccagaaguaggugcacaagcguucgucggugucgaugggcuggcgauugccaaucggggugcccgucccauuucaccucuaacagcuuuucagacgacugggcgggaaaaauggauagagcaggccuagguuucaguggguguuccgacggaugcggcggugccgcuuguggcugcuuuaaugccgcacccucuuguauauucuggaggaagugggucgaaaacccucacgggaucauuuggaaagugagcccaugcgccgcuugggugcccuccgccgucaucgagcucacgaugccuucaggagaaguucgcaccuuccacccaaugagcggcauucccacacagguguuuaagggggugaguguaacuuaccugggaucugauauggaggucuccggccuuaccgacuugugugaaaucgaggagcugaaaagcaagaaacucgcacuggcgccgugcaaccaggcugguaugggggugguuggaaaggugggcgaaauacaguguucgucagaggaaucugcccggacaaucaagaaagaugguugcauuuggaaugcagaccuugucggcaucgagcugagaguggaugacgccguuuguuauaguaagauuacuuccguggaagcuguagccaacuacagcgcaaucccuaccacaauagggggauugagguucgagcgcucucaugauagccaaggcaaaauuuccgggucaccacucgacaucaccgcuauucgaggaaguuuuagcgucaauuaucggggccugcguuuaucucuguccgagaucacugccacgugcacaggugaagugaccaacgugucagggugcuacaguuguaugacuggagcgaaggucagcauaaaacuacacuccucuaagaauaguaccgcccauguuagaugcaagggcgaugagacagcuuucagcgugcucgaagguguacacucauacaccgugucccugaguuuugaccacgcagucguggaugagcagugucagcuuaacugcggcgggcaugaaucucagguuacuuugaaaggaaaucugaucuuccucgacgugcccaaguuugucgacggcagcuauaugcaaacauaccacuccucagugccuacgggggccaacauucccucuccaaccgauuggcugaaugcuuuauucggaaacggccugucuagguggauccuugguguuauugggguguugcucggaggccuggcccuauuuuuccugaucaugagucucuuuaaacugggcacuaagcaggucuuccgcucccggacaaaacuugcauga

SEQ ID NO: 11485 - RNA, 3222 nt, Artificial Sequence
  derived and/or modified CDS sequence (opt3) from SFTSV(KAGBH6)__KP663741.1__GP
augaucaaggugauuugguucagcucccugauaugccucgucauccaguguucuggcgacaccgggcccauuaucugcgccggaccuauucacucaaacaaaagugcuaauaucccacaucuucuggguuacagcgagaagauaugucaaaucgauagauugauucacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugaucgugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggauuggggacguggcuugucagccaaugacccccaucccugaagagacauuccuggagcugaaguccuuuucgcagucugaauuuccagauauaugcaaaauugacggaaucguauuuaaccagugugaguccgaaucacucccgcaacccuucgauguugccuggauggacgugggccacagucauaagauuaucaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucuuuaguccauaagccaggagagguugugguaucauauggcgguaugagggugcggcccaaauguuacggguuuagucgcaugauggcaacucuggaagucaauccuccagagcagcgaaucggccaaugcacaggaugucaccuugaaugcauuaacggcggggugagauugauaacccugacgagcgagcuaaaguccgccacuguuugugcuucucauuucugcucgagcgccaccuccggaaagaaaucaacagagauccaguuccacagugguucucucgugggcaagacugcgauucacgucaaaggggcacugguggacggaaccgaauuuacauucgagggcagcuguauguuucccgaugguugcgacgccguagauugcaccuucuguagggaauuucuuaagaauccgcagugcuacccugcuaaaaaguggcuguucaucauaauuguuaucuugcucggguaugccggccugauguuacugacgaacgugcucaaggcaaucggagucuggggcuccugggugauugcucccgucaaacuuauguuugccaucauuaagaaacugauacggucagugagcuguuugauggggaagcuaauggaccguggacgccaaguuauccaugaggaaauuggugagaauagagagggcaaccaggaugacgugaggaucgaaauggcgcggccacgacgcguaagacacuggauguacucuccugucauccugacuauucucgccauagggcuggcagagggaugcgaugaaauggugcaugcugacuccaaacuuguuaguuguaagcagggcagcgguaauaugaaggagugcgugacaaccgggagggcccuguugcccgcugucaacccaggccaggaggccugucuccacuucacugcacccggaucuccugauuccaaaugccugaagaucaaagugaagcggauuaauuuaaaauguaagaagucaaguagcuauuuuguaccagacgcccgcucgagaugcacauccgugaggcguugucggugggcuggcgauugccaaucugggugcccgagccauuucaccucaaacaguuuuuccgacgacugggcgggaaaaauggaucgagcaggccuggguuucucuggguguagcgacggaugcggcggugccgcuuguggcugcuuuaaugccgcacccuccuguaucuucuggagaaaguggguugaaaacccucacgggauuaucuggaaagucucaccaugcgccgcuugggugcccagcgccgugauagagcuaacgaugccuaguggagaagucaggaccuuccacccaaugucuggcauccccacacagguuuuuaaggggguguccgugacuuaccucggaagcgauauggagguaucgggccugaccgaccuuugugaaauugaggaguugaaaucaaagaaacuggcacucgcgccgugcaaccaggcugguaugggggucgugggaaagguuggcgaaauccaguguucuagugaggaauccgcccgcacaauuaagaaagaugguugcaucuggaaugcagaccuggugggcauagagcuucgggucgaugacgccguguguuauagcaagauuacuucuguugaagcuguggccaacuacagcgcaaucccuaccacaauugggggacugagauucgagaggucccaugauucacaaggcaaaaucagugggagcccauuggacauaaccgcuauccgcggaucuuuuuccguaaauuaucgaggccuccggcugucauuaagugagauuagcgccacuugcacgggugaagucacaaacguguccgggugcuacucuuguaugaccggagcgaaggugucgaucaaacugcacagcucaaagaauagcacugcccauguccguugcaagggcgaugagaccgcuuucaguguucuagaaggugugcacucuuacacaguaagccucuccuuugaccacgcaguggucgaugagcagugucagcugaacugcggcgggcaugaaucacaggugacccuuaaaggaaauuugauuuuccuggacguucccaaguuuguggacggcucuuauaugcaaacuuaccacagcagugucccuacaggggccaacauccccuccccaacggauuggcucaaugcucuguucggaaacggcuuaagcagauggauacugggugugauugggguucuuuugggaggccucgcccuguuuuuccuaaucaugucucuguuuaaacucggcaccaagcaggcauucaggucacgcacuaaacuggcguga

SEQ ID NO: 11486 - RNA, 3222 nt, Artificial Sequence
  derived and/or modified CDS sequence (opt3) from SFTSV(KAGNH)__KU507550.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcggcgcggaggccgaucacagguaagcuacuucccggcagaaaauaguuauucccguuggucuggucugcuaagccccugcgacgccgauuggcucgggaugcugguggucaaaaaggcgaaaggauccgacaugauugugccuggcccaucauacaagggcaagguuuucuucgagagacccacauuugauggguaugugggaugggguuguggcagugggaaaagcaggacugaaucuggagagcuuugcuccucagacagcggcacgaguucuggucuguugccuuccgaucggguccucuggaucggggacguggcuugucaaccaaugacccccauuccugaagagacauuccuggagcugaagucauuuucgcagucugaauuuccagauaucugcaaaauagacggaauuguauuuaaccagugugaguccgaaucacucccgcagcccuucgauguugccuggauggacgugggccacagucauaagaucauuaugcgcgagcacaaaacuaaguggguccaagagagcuccucuaaggauuuugugugcuacaaagaaggcaccgggccuuguagcgagucagaagagaagacaugcaaaaccaguggauccugcagaggugacaugcaguucuguaagguggcaggcugcgaacacggggaggaggccagcgaagcuaaauguaggugcucuuuaguccauaagccaggagagguugugguaucauauggcgguaugcgggugcgccccaaauguuacggguuuagucgaaugauggcaacucuggaagucaauccuccagagcagagaaucggccagugcacaggaugucaccuugaaugcaucaacggcggggugagguugauuacccugacgagcgagcuaaaguccgccacuguuugugcuucucauuucugcucgagcgccaccuccggaaagaaaucaacagagauacaauuccacagugguucucucgugggcaagacugcgauccacgucaaaggggcacugguggacggaaccgaauuuacauucgagggcagcuguauguuucccgaugguugcgacgccguagauugcaccuucugucgggaauuucuuaagaauccgcagugcuacccugcuaaaaaguggcuguucauuaucauaguuauuuugcucggguaugccggccugauguuacugacgaacgugcucaaggcaaucggagucuggggcuccugggugaucgcucccgucaaacuuauguuugccauuaucaagaaacugauucguucagugagcuguuugauggggaagcuaauggaccgcggaagacagguuauacaugaggaaaucggugagaauagggagggcaaccaagaugacgugcggauugaaauggcgcgaccacgcagaguaaggcacuggauguacucuccugucauccugacuauccucgccauugggcuggcagagggaugcgaugaaauggugcaugcugacuccaaacuuguuaguuguaagcagggcagcgguaauaugaaggagugcgugacaaccgggcgggcccuguugcccgcugucaacccaggccaggaggccugucuccacuucacugcacccggaucuccugauuccaaaugccugaagauaaaagugaagcgcaucaauuuaaaauguaagaagucaaguagcuauuuuguaccagacgccagaucgaggugcacauccgugcgucggugucgaugggcuggcgauugccagucugggugcccgagccauuucaccucaaacaguuuuuccgacgacugggcgggaaaaauggauagagcaggccuggguuucucuggguguagcgacggaugcggcggugccgcuuguggcugcuuuaaugccgcacccuccuguauuuucuggaggaaguggguugaaaacccucacgggaucauuuggaaagucucaccaugcgccgcuugggugcccagcgccgugaucgagcuaacgaugccuaguggagaaguccgcaccuuccacccaaugucuggcauacccacacaaguuuuuaaggggguguccgugacuuaccucggaagcgauauggagguaucgggccugaccgaccuuugugaaaucgaggaguugaaaucaaagaaacuggcacucgcgccgugcaaccaggcugguaugggggucgugggaaagguuggcgaaauucaguguucuagugaggaauccgcccggacaaucaagaaagaugguugcauuuggaaugcagaccuggugggcaucgagcuuagagucgaugacgccguguguuauagcaagauaacuucuguugaagcuguggccaacuacagcgcaauuccuaccacaaucgggggacugagguucgagcgcucccaugauucacagggcaaaauuagugggagcccauuggacaucaccgcuauacgaggaucuuuuuccguaaauuaucggggccuccgucugucauuaagugagaucacugccacgugcacaggugaagucaccaacgugagcgggugcuacuccuguaugacuggagcgaagauuucuaucaaacugcacucgagcaagaauagcaccgcccaugugagaugcaagggcgaugagacagcuuucuccguccuagaagguguucacaguuacaccgugucucucagcuuugaccacgcaguaguggaugagcaaugucagcugaacugcggcgggcaugaaucccaggucacucuuaaaggaaauuugauuuuccuggacgugcccaaguuuguugacggcucauauaugcagacauaccacucuagcgugccuacgggggccaacauccccaguccaaccgauuggcucaaugcucuguucggaaacggcuuauccagguggauacugggugucauuggggugcuuuugggaggccucgcccuguuuuuccuaaucaugagccuguuuaaacucggcacuaaucaaguuuuccgcucucggacaaagcuggcauga

SEQ ID NO: 11487 - RNA, 3222 nt, Artificial Sequence
  derived and/or modified CDS sequence (opt3) from SFTSV(KAGNH4)__KU507551.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuccuggagcuuaagagcuuuucgcagucugaauuuccagauaucugcaaaauagacggaauuguauuuaaccagugugaguccgaaucacucccgcaacccuucgauguugccuggauggacgugggccacagucauaagaucauuaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucuuuaguccauaagccaggagagguugugguaucauauggcgguaugaggauccggcccaaauguuacggguuuagucgcaugauggcaacucuggaagugaauccuccagagcagcgaaucggccaaugcacaggaugucaccuugaaugcauuaacggcggggucagauugauaacccugacgagcgagcuaaaguccgccacugugugugcuucucauuucugcucgagcgccaccuccggaaagaaaucaacagagauccaguuccacagugguucucucguuggcaagacugcgauucacgugaaaggggcacuggucgacggaaccgaauuuacauucgagggcagcuguauguuucccgaugguugcgacgccguggauugcaccuucuguagggaauuucuuaagaauccgcagugcuacccugcuaaaaaguggcuguucaucauaauuguaaucuugcucggguaugccggccugauguuacugacgaacguucucaaggcaaucggaguguggggcuccugggucauugcucccgugaaacuuauguuugccaucauuaagaaacugaugcggucagucagcuguuugauggggaagcuaauggaccguggacgccaagugauacaugaggaaaucggugagaauagagagggcaaccaggaugacguuaggauugaaauggcgcggccacgacgcgugagacacuggauguacucuccuguaauccugacuauccucgccauugggcuggcaggaggcugcgaugagaugguccaugcugacuccaaacuugugaguuguaggcaggguagcgggaauaugaaggaaugcguuacaaccggccgggcccuguugcccgcugugaacccaggacaggaggccugucuccacuucacugcacccggcucuccugauuccaagugccugaaaauacgcgucaagagaaucaauuuaaaauguaagaaaucaaguagcuauuuugugccagacgccaggucgcguugcacauccguacggcgauguagaugggcuggggauugccaaucuggaugcccgagccauuucaccucaaacaguuuuuccgacgacugggcgggcaagauggauagggcaggucugggguucucuggauguagcgacggcugcgguggcgccgcuugugggugcuuuaaugccgcacccuccuguauuuucuggcgcaaguggguggagaacccucacggaaucauuuggaaaguuucaccaugcgccgcuuggguccccagcgccgugaucgaacuaacgaugccuaguggcgaggugcggaccuuccacccaaugucugggauacccacacaggucuuuaagggaguuuccgugacuuaccucggcagcgauauggaagugucgggucugaccgaccuuugugagaucgaagaguugaaaucaagaaagcuggcacucgcgccgugcaaccaggcugggaugggaguagucggcaaagugggugagauucaguguucuagugaagaguccgccaggacaaucaagaaagauggcugcauuuggaaugcagaccugguugggaucgaacuucgcguggaugacgccgucuguuauagcaagauaacuucuguggaggcuguugccaacuacagcgcaauuccuaccacaaucggaggccugcgauucgaacggucccaugauucacaagggaagauuaguggaagcccauuggacaucaccgcuauacguggcucuuuuuccgugaauuauagaggucucaggcugucauuaagugagaucacugccacgugcacaggggagguaaccaacgucagcggaugcuacuccuguaugacuggcgcgaaagugucuauuaagcugcacucgagcaaaaauucaaccgcccaugugcgcugcaagggugaugaaacagcuuucuccguccuagagggcguucacaguuacaccgugucucucagcuuugaccacgcaguaguggaugaacagugucagcugaacugcgggggacaugagucccaggucacucuuaaaggcaauuugaucuuccuggacgugcccaaguuuguugacgggucauauaugcaaacauaccacucuagcgugccuacgggagccaacauucccaguccaaccgauuggcucaaugcucuguucggcaacgguuuaucccgguggauccugggggucauaggagugcuuuugggcggccucgcccuguuucuacugauuaugagccucuucaagcuggggacuaaacagguuuuuagaucuaggacaaagcuggcauga

SEQ ID NO: 11488 - RNA, 3222 nt, Artificial Sequence
  derived and/or modified CDS sequence (opt3) from SFTSV(KAGWH2)__KU507564.1__GP
augaugaaggugaucugguucagcucccugauuugccucgucauacaguguggcggggacaccggacccaucauuugcgccgguccuauccacucuaacaaaucagcuggcauuccacaucuucugggguacagugagaagaucugucaaauagauagauugauccacguuagcuccugguuaaggaaucauucucaguuucagggauaugugggccagcggggugggcgcucgcaaguaucauacuauccggcagaaaacagcuacagucgaugguccggacugcuaucucccugcgacgccgauuggcucggcaugcugguggucaaaaaggcgaaaggcagcgacaugauugugccugggccauccuauaagggaaagguuuucuuugagcgucccacauucgaugguuacgugggcuggggguguggaucaggcaaaaguagaacugaaagcggugagcuuuguucuuccgacucagggacgagcaguggacuguugccuucugauaggguccucuggaucggcgacguggcuugccagccaaugacccccauuccugaagagacauuucuggagcugaaguccuucagccagucggaauuuccagauguaugcaaaaucgacggcauaguuuucaaucagugugagggggaaucucucccgcaacccuuugauguggccuggauggacgucggacacucccauaagauuaucaugcgggagcacaaaacuaagugggugcaggagucaaguagcaaggauuucgugugcuauaaagaagguaccggcccuuguuccgagucugaagagaagacaugcaaaaccagcgggucaugccgcggagacaugcaguuuuguaaggucgcaggcugcgaacacggugaggaggccagugaagcuaaauguagaugcuccuuaguucauaagccaggggaggugguagugagcuacggcggaaugaggguccggcccaaauguuacggcuucucucgcaugauggcaacucuggaagugaacccuccagagcagcgaauugggcaaugcacaggaugucaccuugaaugcaucaaugguggcguuagauugaucacccugacgucagagcuaaagagugccacugugugugcuagccauuuuugcuccucugccaccucggggaagaaaagcacagagauucaguuccacuccggaucacucgucggcaagacugcgauacacgugaaaggugcacugguagacgggaccgaguucacauuugaaggcaguuguauguuccccgauggaugcgacgccguugauugcaccuuuuguagggaguuccuuaagaacccgcagugcuauccugcuaaaaaguggcuguuuaucauuaucgugauauugcucggcuacgccgggcugauguuacugacgaauguccucaaggcaauuggagugugggguucuugggucaucgcucccgugaaacuuguuuucgccaucauuaagaaacugaugcgggcggugagcuguuugaugggcaagcuaauggaccgugggcgccaaguaauccaugaagaaauuggagagaacagagagggcaaucaggaugacgucaggauagaaauggcccggccacgacgcgugagacacuggauguauuccccuguuauccugacuauucucgcaaucggucuggcugaggggugcgaugaaauggugcaugccgacucaaaacuugucagcuguaggcagggcucuggaaacaugaaggagugcgugacaaccggccgggcucuguugcccgccguaaauccagggcaggaggcaugucuccacuuuacugcccccggauccccugauaguaagugccugaaaaucaaggugaaacgcauuaacuuaaaguguaaaaagucgucuuccuacuucguuccagacgcuagaucaaggugcacaaguguccgucggugucgaugggcgggcgauugccaaagcgguugcccgccccauuuuaccagcaauuccuucucugacgacugggcagggaagauggauagagccggacugggcuuuagcgguuguucagacggcugcgggggagcugccuguggcugcuucaacgcagccccuaguuguauauuuuggaggaaauggguggaaaauccacacgggaucauuuggaaggugucccccugcgcugccugggucccuucugcaguuaucgagcuaacgaugccaagcggagaagugcgcaccuuccaccccauguccggcauuccgacacagguguucaaagguguaucagucacuuaucucgggagcgauauggaggugaguggacugaccgaccuuugugaaaucgaggaguugaagucuaaaaagcuggcgcucgcuccuugcaaccaggccggcauggguguugugggcaaagucggggaaauacaguguuccagcgaggaaucggcacggacaaucaagaaggauggaugcauuuggaacgccgaccuggugggcaucgagcuuagaguugaugacgcuguguguuacucaaaaauuacuucuguagaagccgucgcaaauuauagugcuaucccaaccacaauagggggacugagguuugagcgcucccaugauagccaaggcaagauuucugguagccccuuggacaucaccgccauucgaggguccuucucagugaacuaccggggacuccgucugaguuuaagcgagaucacugcgacgugcacaggcgaagugaccaaugucucugguugcuacuccuguaugacuggcgccaaaguuucaauaaagcugcacaguagcaaaaacuccaccgcucaugugagaugcaagggggaugagacagcauuuucuguacuagaaggagugcacucguauagcgucucacucuccuucgaccacgccgugguugaugagcagugucagcugaauugcggcgggcaugaaagucaggugacccuuaggggaaacuugaucuuucuggacgucccuaaguucguggacggcucuuacaugcaaacuuaucacagcacaguucccacgggugcuaauauuccauccccuaccgauuggcucaacgcccuguuugggaauggauuaucacgcuggauccugggcgugauuggcguccuucucgggggauuggcacuguucuuucuaaucaugucucuguucaaacucgguacuaagcagguauuucggagcagaacaaaacuggcguga

SEQ ID NO: 11489 - RNA, 3222 nt, Artificial Sequence
  derived and/or modified CDS sequence (opt3) from SFTSV(KAGWH3)__KP663735.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugauugugaaaaaggcgaaaggauccgacaugaucgucccuggcccaucauacaagggcaagguguuuuucgagcgucccacauuugauggguauguuggaugggguuguggcagugggaaaagcagaacugaaucuggagagcuuugcuccucagacagcggcacgaguucuggucuguugccuuccgauagggugcucuggauuggggacgucgcuugucagccaaugacccccaucccugaagagacauuccuggagcucaagagcuuuucgcagucugaguucccagauauaugcaaaauugacggaaucguguuuaaccagugugaauccgaaucacugccgcaacccuucgauguagccuggauggacguuggccacagucauaagauuaucaugcgggagcacaaaacuaagugggugcaggagagcuccucuaaggauuuugucugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucuuuagugcauaagccaggagaggucguugugucauauggcgguaugaggguacggcccaaauguuacggguuuagucgcaugauggcaacucuggaagugaauccuccagagcagcgaaucggccaaugcacaggaugucaccuugaaugcauuaacggcggggucagauugauaacccugacgagcgagcuaaaguccgccacugugugugcuucucauuucugcucgagcgccaccuccggaaagaaaucaacagagauccaguuccacagugguucucucguuggcaagacugcgauucacgugaaaggggcacuggucgacggaaccgaauuuacauucgagggcagcuguauguuucccgaugguugcgacgccguggauugcaccuucuguagggaauuucuuaagaauccgcagugcuacccugcuaaaaaguggcuguucaucauaauuguaaucuugcucggguaugccggccugauguuacugacgaacguucucaaggcaaucggaguguggggcuccugggucauugcucccgugaaacuuauguuugccaucauuaagaaacugaugcggucagucagcuguuugauggggaagcuaauggaccguggacgccaagugauacaugaggaaaucggugagguuagagagggcaaucaggaugacgugaggauugaaauggcgcggccacgacgcguaagacacuggauguacucuccugucauccugacuauccucgccauugggcuggcagagggaugcgaugaaauggugcaugcugacuccaaacuuguuaguuguaagcagggcagcgguaacaugaaggagugcgugacaaccgggagggcccuguugcccgcugucaauccaggccaggaggccugucuccacuucacugcacccggaucuccugauuccaaaugccugaagauaaaagugaagcggaucaacuuaaaauguaagaagucaaguagcuauuuuguaccagacgcccgcucgagaugcacauccgugaggcguugucggugggcuggcgauugccaaucugggugcccgagccauuucaccucaaauaguuuuuccgacgacugggcgggaaaaauggaucgagcaggccuggguuucucuggguguagcgacggaugcggcggugccgcuuguggcugcuuuaacgccgcacccuccuguauuuucuggagaaaguggguugaaaauccucacgggaucauuuggaaagucucaccaugcgccgcuugggugcccagcgccgugaucgagcuaacgaugccuaguggagaagucaggaccuuccacccaaugucuggcauacccacacagguuuuuaaggggguguccgugacuuaccucggaagcgauauggagguaucgggccugaccgaccuuugugaaaucgaggaguugaaaucaaagaaacuggcacucgcgccgugcaaccaggcugguaugggggucgugggaaagguuggcgaaauucaguguucuagugaggaauccgcccgcacaaucaagaaagaugguugcauuuggaacgcagaccuggugggcaucgagcuucgggucgaugacgccguguguuauagcaagauaacuucuguugaagcuguggccaauuacagcgcaauuccuaccacaaucgggggacugagauucgagaggucccaugauucacaaggcaaaauuagugggagcccauuggacaucaccgcuauacgcggaucuuuuuccguaaacuaucgaggccuccggcugucauuaagugagaucacugccacgugcacaggugaagucaccaaugugagcgggugcuacuccuguaugacuggagcgaaggugucuauuaaacugcacucgagcaagaacucaaccgcccauguccguugcaagggcgaugagacagcuuucuccguucuagaaggugugcacaguuacaccguaucucucagcuuugaccacgcaguggucgaugagcagugucagcugaauugcggcgggcaugaaucccaggugacucuuaaaggaaacuugaucuuccuggacguucccaaguuuguggacggcucauauaugcaaacauaccacucuagcgucccuacgggggccaauauucccaguccaaccgauuggcucaacgcucuguucggaaauggcuuauccagauggauccugggugugauagggguucuuuugggaggccucgcccuguuuuuccuaauuaugagccuguuuaggcucggcacuaaacagguguuccgcucucggacaaagcuggcauga

SEQ ID NO: 11490 - RNA, 3222 nt, Artificial Sequence
  derived and/or modified CDS sequence (opt3) from SFTSV(KAICH)__KU507565.1__GP
augaugaaggugaucugguucagcucccugauuugccucgucauacaguguggcggggacaccucucccaucauuugcgccggaccuauccacucaaacaaaagugcugauauuccacaucuucuggguuacagcgagaagaucugucaaauagacagauugauccacguuuccucuugguuaaggaaucauucgcaguuucagggcuauguggggcagcggggaggccgcucacaaguaagcuacuauccggcagaaaacaguuacucccgauggucuggucugcuaagccccugcgaugccgacuggcucgggaugcugguggucaaaaaggcgaaaggauccgauaugauugugccuggcccaucauauaagggcaagguuuucuuugagcgucccacauucgacggguacgugggaugggguuguggcagugggaaaagcagaacugaaucuggagagcuuugcuccucagauagcggcacgaguucuggucuguugccuuccgacaggguccucuggaucggggauguggcuugucagccaaugacccccauuccugaagagacauuucuggagcucaagagcuucucgcagucugaauuuccagacaucugcaaaauagauggaauuguauucaaucagugugagggcgaaucccugccgcaacccuuugacguugccuggauggaugugggccacucacauaagaucauuaugcgggagcacaaaacuaaguggguccaggagaguagcuccaaggacuucgugugcuauaaagaagggaccggaccuuguucugagagcgaagagaagacaugcaaaaccucagguaguugccgcggcgacaugcaguuuuguaagguggcagggugcgaacacggagaggaggccuccgaagcuaaauguagaugcagcuuaguccauaagccaggcgagguugugguaucuuacggugggaugagggugcggcccaaauguuacggcuucucacgcaugauggcaacucuggaagucaaccagccugagcaacgaaucggacagugcacaggcugucaccuugaaugcaucagugggggagugagauugauuacccugacgagcgagcuaaaguccgccacuguuugugcuucucauuuuugcucgagcgccaccuccgguaagaaaucaacagagauacaguuccacaguggcucucucguggggaagacugcgauccacgucaaaggagcacugguggauggcaccgaguucacauuugaagguagcuguauguucccagacgggugcgaugccguagacugcaccuuuuguagggaguuccuuaagaauccccaaugcuauccggcuaaaaaguggcuguuuauuaucauaguuauuuugcucggcuacgccggacugauguuacugacgaacgugcucaaggcaaucggcgucuggggguccugggugaucgcuccugucaaacuuguguucgccauuaucaagaaacugaugcgggcgguuucauguuugaugggaaagcuaauggaucguggucgccaggugauucaugaagaaauaggcgagaauagagaggggaaccaggacgauguaaggaucgaaauggcccggccccgacgcgucagacacuggauguauagcccagugauucugacuauccucgcaaucggacuggcugagggcugcgacgaaaugguucaugccgauucuaaacuuguguccuguaggcaggguagugggaauaugaaggagugcgucacaaccggccgggcucuguugccugccgugaaccccggacaagaggcaugucuccacuuuacugccccaggcagccccgacucuaagugccugaaaauuaagguaaaacgcauaaauuuaaaguguaaaaaguccucaaguuacuucgugccugaugcuagaucgaggugcacaagcguucgucggugucgaugggcgggggacugccaguccggaugcccaccgcauuuuaccucuaacagcuucucagacgauugggcaggcaagauggacagagccggucugggguuuaguggauguuccgauggcugcgguggcgcugccugugggugcuucaaugcagcccccucuuguaucuuuuggaggaaaugggucgaaaacccucacggaauuaucuggaaggugagcccaugcgcugccugggugcccuccgcagucauugagcuaacgaugccuucaggcgaaguucgcaccuuccacccaaugagcgggauccccacacagguguucaaaggagugaguguaacuuaucucggcucugacauggaggucuccggucugaccgaucuuugugaaauggaggaguugaaaagcaagaagcuggcgcucgcuccgugcaaucaggccgggaugggagugguuggcaaagugggugaaauacaauguucgucagaggaaucugcacggacaaucaagaaggacggcugcauuuggaacgccgaucuggucgggaucgagcuuagaguggacgaugcuguuuguuacaguaaaauuacuuccguggaagccguaaccaacuauagcgcaaucccuacaaccauaggaggccugagguuugagcgcucucaugacagccaggggaagauuuccggaucaccauuggauaucacugcuauucgaggcaguuucagcgucaauuaccggggucuccgucugucuuuauccgagaucacggccacaugcaccggggaagugacuaacgugucaggaugcuacaguuguaugaccggcgcgaaagucagcauaaagcugcacuccucuaaaaauucgacagcccauguuagaugcaagggugacgagaccgcuuuuagcgugcuagaaggcguacacucauauuccgugagucucucuuucgaucacgcagucguggacgagcagugucagcugaacugcgggggacaugaaagcaagguuacucuuaggggcaauuugaucuuucuggacgugcccaaauucgucgauggguccuacaugcaaacauaucacucaacggugccuaccggagccaacauucccucuccaacugacuggcucaaugcucuguuuggcaacgguuuaagccgcugguuccuggggguuaucggagugcuuuugggcggccucgcccuguuuuuccuaauuaugagucuguuuaagcucgggacaaaacaggucuuccgguccagaagcaagcuggcauga

SEQ ID NO: 11491 - RNA, 3222 nt, Artificial Sequence
  derived and/or modified CDS sequence (opt3) from SFTSV(KAJJH)__KU507566.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccaacaggguccucuggaucggggauguggcuugucagccaaugacccccauuccugaagagacauuucuggagcuuaagagcuucucgcagucugaauuuccagacaucugcaaaauagauggaauuguauucaaucagugugaguccgaaucacucccgcaacccuuugacguugccuggauggaugugggccacagucauaagaucauuaugcgggagcacaaaacuaaguggguccaggagagcuccucuaaggacuucgugugcuauaaagaaggcaccgggccuuguagcgagucagaagaacgcacaugcaagaccaguggauccugcagaggugauaugcaguuuuguaaaguggcaggcugcgaacacggggaggaggccagcgaagcuaaguguaggugcucuuuaguccauaaaccaggagagguugugguaucauacggcgguaugcgggugcgccccaaguguuacggguucagucgaaugauggcaacucuggaagucaacccuccagagcagagaaucggccaaugcacaggaugucacaucgaaugcauuaauggcggggugaggcuuauaaccuugacgagcgagcugaaauccgccacuguuugugcuucucauuuuugcucgagcgccaccuccggaaagaagucaacagagauccaguuccacagugguucucuagugggcaaagcggcaauucacgucaagggggcccucguggacggaacugaauuuaccuuugagggcagcuguauguuccccgacgguugcgaugcuguagacugcacauuuugucgggaguuccugaaaaacccgcagugcuauccugccaagaaauggcuuuuuaucauaauuguuauccuguugggguacgcaggccucaugcuguuaaccaaugugcugaaggcuaucggagucuggggcuccugggugauugcccccgucaagcucauguucgcgaucauuaaaaagcugaugcguucagugagcugucugauggggaaauugauggaucgcggaagacaaguuauacaugaggaaaucggugagaacagggagggcaaucaggacgaugugcggauugaaauggcccgaccacgcagaguaaggcacuggauguauucuccugucauccuaacgauccuggcaauugggcucgcugagggaugcgacgaaauggugcaugccgauuccaagcugguuaguugucggcagggcggugggaacaugaaagagugcgugacuacaggccgcgcccuucugcccgcugucaauccaggacaggaggcauguuugcacuuuaccgcccccggcagcccugacucuaagugccucaagauaaaagugaagagaaucaaccugaaauguaagaaauccucaaguuacuucguaccagaugcuaggagccguugcacuucggugcggcgauguagaugggcgggggacugccaauccggaugcccgucucauuuuacaagcaauucauucagugaugacugggcaggcaagauggacagggccgguuuaggguuuuccggauguucugauggcugcgguggcgcugccugugggugcuucaacgcagcccccagcuguauuuucuggcgcaaguggguugaaaacccucacggaaucauuuggaaagucuccccaugcgcugccugggugcccucagcagugaucgagcugaccaugccuagcggcgaaguccggacguuccacccaaugagugggauacccacccagguuuucaagggagugucugugacauaucuaggcuccgacauggagguaagcggucucacugaucugugugaaaucgaggagcuuaaaucgaagaaauuggcgcuggcuccgugcaaucaggccgggaugggagucgugggcaagguuggugaaauucaguguucaucugaggaaagugcaagaaccaucaaaaaggacggcugcauuuggaacgccgaucucguggggaucgagcugagggucgacgaugcuguguguuacuccaagauaacaagcguugaagccguggcaaauuauucugcuauuccuacuaccaucggaggccuucgcuuugagcgaagccaugacucccaagggaaaauuucaggaaguccacuggauaucacagccauacggggcagcuucucuguaaacuaccgugguuugagacucucccugucagagaucaccgcgacuugcacgggggaagucacaaaugugaguggaugcuacagcuguaugaccggcgccaagguguccauuaaauuacacucuucgaagaacagcacugcucaugucaggugcaaaggugacgagaccgcauuuucaguucuggaaggcgugcacuccuauacaguaagucuaucuuucgaucacgccguggucgacgagcagugucagcucaauugcgggggacaugaaagccaggugacccugaagggcaaccuuaucuuuuuggauguucccaaguucguggacggguccuacaugcaaacuuaucacucaucugucccuacaggagcuaauauucccagcccaacggacuggcugaacgcccucuuuggcaauggucugagucgcuggaucuuaggggugauaggaguucugcuuggcggcuuggcacucuucuuucugauuaugucccuauucaaacuggggaccaaacagguguuucggagcagaacuaagcucgcguga

SEQ ID NO: 11492 - RNA, 3222 nt, Artificial Sequence
  derived and/or modified CDS sequence (opt3) from SFTSV(KAJNH2)__KU507552.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcuggugcuuaaaaaggcgaaagaguccgacaugauugucccuggaccaucauauaagggcaagguguucuuugaacgucccacauucgauggcuacguuggguggggaugugguaguggcaaaagcagaacugagucuggggaacugugcuccucagacagcggaacgaguucuggcuugcucccuuccgauagggugcuguggaucggugacgucgcuugucagccaaugacccccauuccugaggagacauuucuggaacucaagagcuucucgcagucugaguuuccagauaucugcaaaauagacgggauuguguucaaccagugugaauccgagucauuaccgcaacccuuugauguagccuggauggacguuggacacagucauaagaucauuaugcgggagcacaaaacuaagugggugcaggaaagcuccucuaaggauuucgucugcuauaaagagggcaccggcccuuguagcgaaucagaggaaaagacaugcaaaaccaguggguccugccgcggagacaugcaguuuuguaagguggcagguugcgagcacggcgaggaagccagcgaggcuaaauguagaugcucucuggugcauaagccaggggaagucguugugucauacggaggcaugaggguacggcccaaauguuacgguuucagucgcaugauggcaacucuugaggugaauccuccagaacagcgaaucgggcaaugcacaggcugucacuuggagugcaucaacggaggcgucagacugauuacccuaacgagcgagcucaaguccgccacugugugugcuucucauuuuugcucgagcgccaccuccgggaagaaaucaacagaaauacaguuccacaguggaucucugguugguaaggcggcaauccacgugaaaggcgcccuugucgacgggacugaguucaccuuugaaggaagcuguauguuccccgauggcugcgacgcuguggauugcacauuuuguagggaguuccugaagaauccgcagugcuauccugccaaaaagugguuguuuauuaucauaguaauucuccuggguuacgcaggguuaaugcugcucaccaacguucuuaaggcuaucggcguguggggauccugggucaucgcccccgugaaacugauguucgcgauuaucaagaaauugaugcggucagucagcugucuaaugggcaagcugauggaccgugggcgccaagugauucaugaagagauaggagagaauagagaagguaacagggaugacguucggaucgagauggcccgaccacgcagagugaggcacuggauguauucuccuguaauucucacgauccuggcaaucggccuugcugaagggugcgaugagaugguccaugccgacuccaaacuggugaguugucggcagggaagcggcaauaugaaggagugcguuacuacaggucgcgcuuugcuccccgccgugaacccagggcaggaagcaugucugcacuuuaccgcccccggcucuccugauuccaagugcuuaaaaauuaaggucaaaagaauaaaucugaaguguaaaaagucaaguagcuacuucgugccagacgcuaggucgcguugcacuuccguacggcgauguagaugggcgggagauugccagucuggcugcccgagccauuuuacaucaaacaguuucuccgacgacugggcagggaagauggauagggccggacuaggcuuuucugguuguagcgacgggugcggaggcgcugccugugguugcuucaaugcagcccccuccuguaucuuuuggcgcaaauggguggagaacccucacggcauuaucuggaagguuucaccaugcgcugccuggguccccagcgcagugauugaacucaccaugccuaguggggaggugcggacguuccacccaaugucuggaauccccacccaagucuucaaaggcguuuccgugacauaucuggggagcgauauggaagugucgggacuuacugacuugugugagauagaggaacugaagucaaagaagcucgcgcuggcuccgugcaaccaggccggcauggguguagucgggaaagugggagagauccaguguucuagugaagaguccgcaagaaccauuaagaaggauggcugcaucuggaaugccgaccuuguugguauugaacugaggguggaugacgcugucuguuacagcaaaaucacaucuguggaggccguugcaaacuauagcgcuauaccuacuaccauuggcggguugcgcuuugagcgaucccaugauucacagggaaagaucaguggcagcccacucgacauuacagccauccgggggucuuucuccgugaauuaccguggacugagauuaucacugagugaaauaaccgcgacuugcacgggcgagguaacaaacgucagcgguugcuacuccuguaugaccggggccaaagugucuaucaagcuacacucgagcaaaaauucaacugcucaugugaggugcaagggagaugaaaccgcauuuuccguccucgagggcguucacaguuauacagugucucugagcuucgaccacgccguaguggaugaacaaugucagcuuaacugcgguggccaugagucccaggucaccuugaaggggaaucugauuuuucucgacgugcccaaauucguugacggaucauacaugcagacuuaucacucuagcgugccuacaggcgcuaacauccccaguccaacggauuggcugaaugccuuauuugggaacggacugucccgcuggauucuuggcgucaucgguguguugcucgggggacuggcacuauucuuucugauaaugagccucuucaagcugggcaccaaacaaguuuuucggucuagagcgaaacuugccuga

SEQ ID NO: 11493 - RNA, 3222 nt, Artificial Sequence
  derived and/or modified CDS sequence (opt3) from SFTSV(ZL13-32)__KU361342.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcggacggucucaugucugaugggaaaguugauggaucguggucgccaggugauccaugaggaaauuggcgagaacagagaggggaaucaggacgauguuaggaucgaaauggcgcggccccgacgcgugagacacuggauguauagcccaguaauccuaacuauucuggccauaggacucgcagagucuugcgacgaaaugguccaugcugauuccaaacuggugaguuguaggcagggcagcgguaacaugaaggagugcguuacaaccgggcgggcccuucugccugcugugaaucccggccaagaggccuguuugcacuucacugcaccaggaucucccgacuccaagugccucaaaaucaaggucaaacgcauuaaccugaaguguaaaaagucaaguagcuacuuugugccugaugccagaucgaggugcacauccguacgucggugucgaugggcuggcgacugccagucugggugcccaccgcauuucaccagcaauucauuuagugacgauugggcgggaaagauggacagagcaggcuuagguuucuccggguguucugauggaugcggcggugccgcuuguggcugcuuuaacgccgcacccagcuguaucuucuggaggaaauggguggaaaauccucacgggauuaucuggaagguuuccccaugcgccgcuuggguccccucagccgugauagagcugacgaugccuagcggagaagugcgcaccuuccacccaaugaguggcauccccacacaggucuuuaaagggguuucugugacuuaucuaggauccgacauggaggugagcggccucaccgaucugugugaaauugaggagcuuaagucgaaaaaguuggcacuggcgccgugcaaccaggcugguauggggguagucggaaaagugggcgaaauccaauguucaucugaggaaagugcccggacaauuaagaaggacgguugcaucuggaacgcagaucucguuggcauagagcugagaguggacgaugccgucuguuacuccaaaauuacuagcguggaagcuguugccaauuauucugcaaucccuaccacaauugggggacuuagguucgagcgcagccaugacucccagggcaagaucucagggaguccacuggauauaaccgcuauccgaggcagcuuuucugugaacuaccggggauugcgucucucccugucagagauuacugccacgugcacaggugaaguaaccaaugucagugggugcuacagcuguaugacuggagcgaaaguguccaucaaguuacacucuucgaaaaacagcaccgcccaugugagaugcaagggcgacgagacagcuuucucaguccuggaagguguucacuccuauaccgugagucuaucuuuugaucacgcaguaguggacgagcagugucagcucaauugcggcgggcaugaaagccaagucacucugaagggaaaccuuauuuucuuggacgugcccaaauuuguugauggcuccuacaugcagacauaucacucaacggugccuaccggggccaauauccccucuccaacugacuggcugaacgcucucuucggaaauggccugaguagguggauauuaggugucauuggggugcugcuuggaggcuuggcccucuuuuucaugaucaugagccuguuuaagcuaggcacaaaacagguuuuccgcucccggaccaagcuggcauga

SEQ ID NO: 11494 - RNA, 3222 nt, Artificial Sequence
  derived and/or modified CDS sequence (opt3) from SFTSV(AHL/China/2011)__JQ670930.1__GP
augaugaaggugaucugguucagcucccugauuugccucgucauacaguguucuggcgacaccgggcccaucauuugcgccggaccuauccacucaaacaaaagugcugauauuccacaucuucuggguuacagcgagaagaucugucaaauagacagauugauccacguuuccucuugguuaaggaaucauucgcaguuucagggcuauguggggcagcggggaggccgcucacaaguaagcuacuauccggcagaaaacaguuacucccgauggucuggucugcuaagccccugcgaugccgacuggcucgggaugcugguggucaaaaaggcgaaaggauccgauaugauugugccuggcccaucauauaagggcaagguuuucuuugagcgucccacauucgacggguacgugggaugggguuguggcagugggaaaagcagaacugaaucuggagagcuuugcuccucagauagcggcacgaguucuggucuguugccuuccgacaggguccucuggaucggggauguggcuugucagccaaugacccccauuccugaagagacauuucuggagcugaagucuuucucgcagucugaauuuccagacaucugcaaaauagauggaauuguauucaaucagugugagggcgaaucccucccgcaacccuuugacguugccuggauggaugugggccacucacauaagaucauuaugcgggagcacaaaacuaaguggguccaggagaguagcuccaaggacuucgugugcuauaaagaagggaccggaccuuguucugagagcgaagagaagacaugcaaaaccucagguaguugccgcggcgacaugcaguuuuguaagguggcagggugcgaacacggagaggaggccuccgaagcuaaauguagaugcagcuuaguccauaagccaggcgagguugugguaucuuacggugggaugaggauccggcccaaauguuacggcuucucacgcaugauggcaacucuggaagugaacccuccagagcagcgaaucggacaaugcacaggcugucaccuugaaugcauuaaugggggagucagauugauaacccugacgagugagcuaaagagcgccacugugugugcuucccauuuuugcagcucggccaccagcgguaagaaaaacacagagauccaguuccacuccggcucacucguugggaagacugcgauucacgugaaaggagcacuggucgauggcaccgacuucacauuugaagguaguuguauguuccccgaugggugcgacgccguggauugcaccuuuuguagggaguuccuuaagaauccgcagugcuauccugcuaaaaaguggcuguuuaucauaauuguaaucuugcucggcuacgccggacugauguuacugacgaacguucucaaggcaaucggcgugugggggucuugggucauugcucccgugaaacuuauguucgccaucaugaagaaacugaugcggagcgucuccuguuugaugggaaagcuaauggaccguggucgccaagugauucaugaagagauaggcgaaaauagagaggggaaccaggaugacguuaggaucgagauggcgcggccacgacgcgugagacacuggauguauucaccuguaauucugacuauccucgccacaggacuggcagaaggcugcgaugagaugguccaugcugacagcaaacuugugucuuguaggcaggguuccgggaauaugaaggaaugcguuaccacuggccgggcccuguugcccgcugugaacccaggacaggaggccugucuccacuuuacagcacccggcaguccugauagcaagugccugaaaaucaaggucaaacgcauuaauuuaaaguguaaaaagucuuccucauacuucgugccagacgccagaaguaggugcaccagcguacgucggugucgaugggcuggggacugccaaucgggaugcccgccccauuuuacguccaacucuuucagcgaugacugggcgggcaagauggauagagcaggucugggguuuucaggauguagugacggcugcgguggcgccgcuugugggugcuucaaugccgcaccuuccuguauauuuuggaggaaauggguggagaacccacacggaaucauuuggaagguuucucccugcgccgcuugggucccuagcgccgugaucgaacuaaccaugccauccggcgaggugcgcacauuccaccccaugucagggauuccgacucaggucuucaaaggaguuagcgugaccuaucucggcagugauauggaagugucuggucugacagaccuuugugagaucgaagaguugaaguccaaaaagcuggcacucgcgccuugcaaccaggcugggaugggaguagucggcaaagugggugagauacaguguagcucggaagagucagcccggacuaucaagaaggauggcugcauuuggaaugcagaccugguugggaucgaacuuagaguggaugacgccgucuguuacucuaaaauuaccaguguggaggcuguugccaacuauuccgcaaucccaacaaccauaggaggccugagguuugaacgcagccaugauucucaagggaagauuagcggaucccccuuggacaucacugcuauucgaggcucauucagugugaauuaccggggucuccgucugagcuuaucugagaucacggccacaugcaccggggagguaacuaacgucuccggaugcuacucauguaugaccggcgcgaaagugagugugaagcugcacagcuccaaaaauucuacagcccaugucagaugcaagggugaugaaaccgcuuuuucgguucuagagggcgugcacagcuauacuguaucacucuccuucgaccacgcaguggucgacgaacagugucagcugaacugcgggggacaugagagucaggugacacuuaagggcaauuugauauuucuggauguuccuaaauucguggacgggucuuacaugcaaacguaucacagcaccguccccacuggagccaacaucccauccccuacagauuggcucaaugcucuguuuggcaacgguuuaucaagguggauucugggggugaucggaguucuuuugggcggccucgcccuguucuuucuaauuaugucucuguucaagcucgggaccaaacagguguuucgcagccggacaaagcuggcauga

SEQ ID NO: 11495 - RNA, 3222 nt, Artificial Sequence
  derived and/or modified CDS sequence (opt3) from SFTSV(AH-YTY/China/05/2012)__KR017849.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcgggcggucucaugucugaugggaaaguugauggaucguggucgccaggugauccaugaggaaauuggcgagaacagagaggggaaucaggacgauguuaggaucgaaauggcccggccccgacgcgugagacacuggauguauagcccaguaauccuaacgauucuggcaauaggacucgcugagucuugcgacgaaaugguccaugccgauuccaaacuggugaguuguaggcagggcagcgguaacaugaaggagugcguuacuacagggcgggcccuucugccugcugugaaucccggccaagaggcauguuugcacuucaccgccccaggaucucccgacuccaagugccucaaaaucaaggucaaacgcauuaaccugaaguguaaaaagucaaguagcuacuuugugccugaugcuagaucgaggugcacuuccguacgucggugucgaugggcgggcgacugccagucugggugcccaccgcauuucacaagcaauucauuuagugacgauugggcaggaaagauggacagagccggcuuagguuucuccggguguucugauggaugcggcggugcugccuguggcugcuuuaacgcagcccccagcuguaucuucuggaggaaauggguggaaaauccucacgggauuaucuggaagguuuccccaugcgcugccuggguccccucagcagugauagagcugaccaugccuagcggagaagugcgcacguuccacccaaugaguggcauccccacccaggucuuuaaagggguuucugugacauaucuaggauccgacauggaggugagcggccucacugaucugugugaaauugaggagcuuaagucgaaaaaguuggcgcuggcuccgugcaaccaggccgguauggggguagucggaaaagugggcgaaauccaauguucaucugaggaaagugcacggaccauuaagaaggacgguugcaucuggaacgccgaucucguuggcauagagcugagaguggacgaugcugucuguuacuccaaaauuacaagcguggaagccguugcaaauuauucugcuaucccuacuaccauugggggacuuagguucgagcgcagccaugacucccagggcaagaucucagggaguccacuggauauaacagccauccgaggcagcuuuucugugaacuaccggggauugcgucucucccugucagagauuaccgcgacuugcacgggugaaguaacaaaugucagugggugcuacagcuguaugaccggagccaaaguguccaucaaguuacacucuucgaaaaacagcacugcucaugugagaugcaagggcgacgagaccgcauucucaguccuggaagguguucacuccuauacagugagucuaucuuuugaucacgccguaguggacgagcagugucagcucaauugcggcgggcaugaaagccaagucacccugaagggaaaccuuauuuucuuggacgugcccaaauuuguugauggcuccuacaugcagacuuaucacucaacagugccuacgggggcuaauauccccucuccaaccgacuggcugaacgcccucuucggaaauggccugaguagguggauauuaggugucauuggggugcugcuuggaggcuuggcacucuuuuucaugaucaugagccuguuuaagcuaggcacuaaacagguuuuccgcucccggacaaagcuggcguga

SEQ ID NO: 11496 - RNA, 3222 nt, Artificial Sequence
  derived and/or modified CDS sequence (opt3) from SFTSV(AHZ/China/2011)__JQ670931.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggauucucguggucaaaaaggcgaaaggaucagauaugaucgugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggauuggggauguggcuugucagccaaugacgcccaucccugaagagaccuuccucgagcugaagucguuuucucaguccgaauuuccagacauaugcaaaauugauggaaucguauuuaaucagugugagggcgaaucacugccgcaacccuucgacguugccuggauggaugugggccacagucauaagauuaucaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagaucgcagggugcgaacacggagaggaggccagcgaagcuaaauguagaugcucucucgugcauaagccaggcgaggucguugugucauacggugggaugaggguacggcccaaauguuacggcuuuagucgcaugauggcaaccuuagaagugaaccagccugagcaacgaauuggacagugcacuggcugucaccuggaaugcauaaaugggggagucagacuuaucacauugaccagcgagcugaaguccgccacggugugugcuucucauuucugcucgagcgccacuuccgguaagaaaucaaccgagauucaguuccacaguggcucucuaguugggaagacagcgauccacgugaaaggagcacucgucgauggcacugaauuuaccuucgaggguagcuguauguuuccagacgggugcgaugccguggacugcacauucuguagggaauuucugaagaacccccaaugcuauccggcuaaaaaguggcuuuucauaauuaucguaauccuguugggcuacgccggacucaugcuguuaaccaauguucugaaggcaauuggcaucuggggguccugggugauugcuccugucaaacucauauuugccaucauuaagaaacuuaugcggacggugucaugucugaugggaaaguugauggaucguggucgccaggucauccaugaggaaaucggcgagaacagagaggggaaucaggacgaugugaggauugaaauggcgcggccccgacgcguuagacacuggauguauagcccagugauacuaacuauccuggccauuggacucgcagagucuugcgacgaaaugguacaugcugauuccaaacuggucaguuguaggcagggcagcgguaacaugaaggagugcgugacaaccgggcgggcccuucugccugcuguuaaucccggccaagaggccuguuugcacuucacugcaccaggaucucccgacuccaagugccucaaaaucaaggugaaauggauuaaccugaaguguaaaaagucaaguagcuacuuugucccugaugcccgcucgagaugcacauccgugaggcguugucggugggcuggcgacugccagucugggugcccaccgcauuucaccagcaauucauuuagugacgauugggcgggaaagauggaccgagcaggcuuagguuucuccggguguucugauggaugcggcggugccgcuuguggcugcuuuaacgccgcacccagcuguaucuucuggagaaaauggguagaaaauccucacgggauaaucuggaagguguccccaugcgccgcuuggguucccucagccgucauugagcugagcaugccuaguggagaagugaggacguuccacccaaugucuggcauccccacccagguguuuaaaggggucuccguuacauaucuaggaagcgacauggaggugucgggccucacuggucugugugaaauugaggagcuuaagucuaaaaaguuggcacuggcgccgugcaaccaggcugggaugggagugguaggcaaagucggugaaauccaauguucaagugaggaauccgcccgcaccauaaagaaggauggcugcauuuggaacgcagaccucguggggaucgagcugcggguugaugacgccguguguuacagcaaaauuacaucugucgaaagcguggcuaauuauuccgccaucccuacuaccauaggaggccuuagauucgagaggucacaugauagucaggggaagaucagcggaucuccacuggacauuacagcaauccgcggcuccuuuucaguuaacuaccgagguuugcggcucagucugagcgagauuaccgcuacuugcacgggggaagugacaaauguauccggaugcuacucuuguaugaccggcgccaaagucucgaucaaguuacacagcuccaaaaacucaacugcgcaugugcguugcaagggugaugagaccgccuucagugugcuggaaggcguccacucuuauacaguuagccuauccuuugaccacgcugugguagaugagcagugucagcucaauugcgggggacaugaaucacaagugacccugaagggcaaccuuauauucuuggacguccccaaauuuguggacgggucuuacaugcagacuuaucacagcacaguuccuacgggagcaaauauucccaguccaaccgauuggcugaacgcccucuucggcaauggucuguccagauggaucuuagggcugaucggagugcuuuugggcggccucgcucuguuuuucaugauuaugagccuauuuaagcuggggacuaaacaggucuucaggucucgcacaaagcucgccuga

SEQ ID NO: 11497 - RNA, 3222 nt, Artificial Sequence
  derived and/or modified CDS sequence (opt3) from SFTSV(DS02/CHN/2013)__KR698332.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaucugcaaaauagacggaauuguauucaaccagugugaguccgaaucacugccgcaacccuuugauguugccuggauggacgugggccacagucauaagaucauuaugcgggagcacaaaacuaaguggguccaggagagcuccucuaaggauuucgugugcuauaaagaaggcaccgggccuuguagcgagucagaagagaagacaugcaaaaccaguggauccugccgcggugacaugcaguuuuguaagguggcaggcugcgaacacggggaggaggccagcgaagcuaaauguagaugcucuuuaguccauaagccaggagagguugugguaucauacggcgguaugagggugcggcccaaauguuacggguucagucgcaugauggcaacucuggaagucaauccuccagagcagcgaaucggccaaugcacaggaugucaccuugaaugcaucaacggcggggugagauugguuacccugacgagcgagcuaaaguccgccacugugugugcuucucauuuuugcucgagcgccaccuccggaaagaaaucaacagagauucaguuccacagugguucucucgucggcaaggcggcaauacacgugaaaggggcccugguagacggaacugaguucaccuuugaaggcagcuguauguuccccgaugguugcgacgcuguugauugcacauuuuguagggaguuccuuaagaaucugcagugcuauccggccaaaaagugguuguuuaucauuaucgugauacuccugggguacgcaggcuuaaugcugcucaccaacguccuuaaggcuauuggaguguggggcuccugggucaucgccccugugaaacugauguucgcgaucauuaagaaauugaugcggucaguuagcugucuaauggggaagcugauggaccguggacgccaagugauccaugaagaaauuggugagaauagagagggcaaccaggaugacguaaggauagaaaugguccggccccgacgcgugagacacuggauguauucuccaguuauccucacgauucuggccaucgggcuuacugagggaugcgaugaaauggugcaugcagacuccaaacuggucaguuguaggcagggcagcgguaauaugaaggagugcgugacaaccgggcgggcuuugcucccugccguaaaccccggccaggaggcuugucugcacuuuacugccccaggaucucccgauuccaagugcuuaaaaaucaaggugaaacgcauuaaucugaaguguaaaaagucaaguagcuacuucguuccugacgcaagaucgaggugcacauccguccgucggugucgaugggccggcgauugccaaucugggugcccaagccauuuuaccucaaacaguuucuccgacgacugggcuggaaagauggauagagcgggccuagguuuuucuggguguagcgacggaugcggcggugcagccuguggcugcuucaaugcugccccguccuguauauuuuggaggaaauggguggaaaacccccacgggaucauuuggaaggugucaccuugcgcagccugggucccaagcgcuguuaucgagcucacgaugcccaguggagaagugcgcaccuuccacccuaugucuggcauuccaacacagguguucaaagggguauccgucacuuaucugggaagcgauauggaggugucgggccuuaccgacuugugugaaaucgaggagcugaagucaaagaagcucgcccuggcacccugcaaccaggcggguauggggguugugggaaaagucggcgaaauacaguguucuagugaggaauccgcucggacaaucaagaaggaugguugcauuuggaaugccgaccuugugggcaucgagcugagaguugaugacgcaguguguuacagcaaaauuacuucuguagaagccgucgcuaacuauagcgccaucccgaccacaauagggggauugagguuugagcgcucccaugauucacaaggcaagauuagugggagcccucucgacaucaccgcaauucgaggaucuuucuccgugaauuaccggggccugcguuuaucacugagugagaucacugcuacgugcacaggugaagugaccaacgucagcgggugcuacuccuguaugacuggagccaaaguuucuauaaagcuacacucgagcaaaaauucaaccgcgcaugugagaugcaagggcgaugagacagccuuuuccguacucgaaggugugcacaguuauaccgucucucugagcuucgaccacgcugugguugaugagcagugucagcuuaacugcggcgggcaugaaucccaggugacuuugaagggaaaucugaucuuucucgacgucccaaaauucguggacggcucauacaugcaaacauaucacucuagcguucccacgggggcaaacauuccuagucccaccgauuggcugaaugccuuauuuggaaacggccuguccagguggauccuuggugugauuggggucuugcucggaggccuggcucuauucuuucugaucaugagccucuucaagcugggcacuaaacagguauuucgcucucggacaaaacuugccuga

SEQ ID NO: 11498 - RNA, 3222 nt, Artificial Sequence
  derived and/or modified CDS sequence (opt3) from SFTSV(DS03/CHN/2013)__KR698333.1__GP
augaugaaggugaucugguucagcucccugauuuaccucgucauacagugcucuggcgacucagggcccaucauuugugccggaccuauccacaguaacaaaagcgcuaauauuccacaucuucuggguuauuccgagaagaucugccaaauagauagauugauccacguuucuucgugguuaaggaaccauucacaguuucagggcuacguggggcagcggggaggccgcagccaaguaaguuauuacccggcagaaaauuccuauucucgauggagcggucugcuaucccccugugacgccgauuggcucgggaugcugguggucaaaaaggcgaaaggaucagacaugauugugccuggcccaaguuacaagggcaagguuuucuuugagcgucccaccuucgauggguaugugggaugggguugcggcagcgggaaaucuagaacagaauccggagagcuuuguucaagcgacaguggcacuucuuccggucuguugccuagcgauaggguccucuggaucggggacguggcuugccagccaaugacgcccauuccugaagagaccuuucuggagcugaagucguucucucaguccgaauuuccagauaucuguaaaauagacggaauuguauucaaccagugcgagcgggaaucacucccgcaacccuuugauguugccuggauggacgugggccacagucauaagaucauuaugcgcgagcacaaaacaaaguggguccaggagagcuccucuaaggauuucguguguuacaaagaaggcacugggccuugcagcgagucagaagagaagaccuguaaaacaaguggauccugcagaggugacaugcaguuuugcaagguggcaggcugugaacacggggaggaggccagcgaagcuaaauguaggugcucuuuaguccauaagccaggagagguugugguaucauacggcgguaugcgggugcgccccaaaugcuauggguucagucgaaugauggcaacccuggaagucaauccuccagagcagagaaucggccaauguacuggaugccaccuugaauguaucaacggcggggugagguugauuacacugaccagcgagcuaaaguccgccacgguuugcgcuucucauuuuuguucgagcgccacuuccggaaagaaaucaaccgagauacaguuccacagugguucucucgugggccggacagcgauccacgucaagggggcacugguggacggaacugaguucaccuuugaaggcagcugcauguuccccgaugguugugacgccguagauugcacauuuugccgugaguuccuuaaaaauccgcaguguuacccugcuaagaaauggcuguuuauuaucauaguuauuuugcucggguaugccggccugauguuacugaccaacgugcucaaggcaaucggagucuggggcuccugggugaucgcucccgucaaacuuauguucgccauuaucaaaaagcugaugcgcucagugagcugcuugauggggaaacuaauggacagaggaaggcaaguuauucaugaagaaauaggugagaaucgggagggcaaccaggaugacauccgaauugaaauggcgcgcccaagaagggugcggcacuggauguacucuccuguaauccugacgauccucgccgucgggcuggcagagggaugugaugaaauggugcaugcugacuccaaacuuguuaguugcaagcagggcagcgguaauaugaaggagugugugacuacagggcgcgcccuguugcccgcugucaacccaggccaggaggccugccuccacuuuaccgcacccggaucuccugauuccaagugucugaaaauuaaggugaaaagaauaaauuuaaagugcaaaaagucaaguagcuauuucguaccagacgccaggucgcguuguacuuccgugcggcgaugcagaugggcuggcgauugucaaucugggugcccgagccauuuuacaucaaacaguuucuccgacgacugggcgggaaagauggauagggcaggccuggguuuuucugggugcagcgacggauguggcggugccgcuugcggcuguuucaaugccgcacccuccugcaucuuuuggcgcaaauggguugaaaacccucacgggauuaucuggaaggucucaccaugugccgcuugggugcccagcgccgugauugagcuaaccaugccuaguggagaaguccggacguuccacccaaugucuggcauccccacccagguuuucaaagggguguccgugacauaccucggaagcgauauggagguaucgggccugacugaccuuugcgaaauagaggaguugaagucaaagaagcuggcacucgcgccguguaaccaggcugguaugggggucgugggaaaaguuggcgaaauccagugcucuagugaggaauccgccagaaccauuaagaaggaugguuguaucuggaaugcagaccuggugggcauugagcuuagggucgaugacgccgugugcuauagcaaaaucacaucuguugaagcuguggccaacuacagcgcaauaccuacuaccauugggggacugcgcuuugagcgaucccaugauucacaaggcaagaucagugggagcccauuggacauuacagcuauccggggaucuuucuccguaaauuaccguggccucagacugucauuaagugagauaaccgccacuuguacgggugaagucacaaacgugagcgggugcuauuccugcaugaccggagcgaaagugucuaucaagcugcacucgagcaaaaauucaacugcccaugucagguguaagggcgaugagaccgcuuuuuccguucuagaaggugugcacaguuacacaguaucucucagcuucgaccacgcaguggucgaugagcagugccagcugaacuguggcgggcaugaaucccaggugacccuuaagggaaauuugauuuuucuggacguucccaaauucguggacggcucauauaugcaaacuuaccacucuagcgucccuacaggggccaacauccccaguccaacggauuggcucaaugcucuguuuggaaacggcuuaucccgcuggauucugggugugaucgggguucuuuugggaggccucgcccuguucuuucuaauaaugagccuguucaagcucggcaccaaacagguguuucggucuagaacuaagcuggcauga

SEQ ID NO: 11499 - RNA, 3222 nt, Artificial Sequence
  derived and/or modified CDS sequence (opt3) from SFTSV(DS04/CHN/2013)__KR698334.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaucugcaaaauagacggaauuguauucaaccagugugaguccgaaucacugccgcaacccuuugauguugccuggauggacgugggccacagucauaagaucauuaugcgggagcacaaaacuaaguggguccaggagagcuccucuaaggauuucgugugcuauaaagaaggcaccgggccuuguagcgagucagaagagaagacaugcaaaaccaguggauccugccgcggugacaugcaguuuuguaagguggcaggcugcgaacacggggaggaggccagcgaagcuaaauguagaugcucuuuaguccauaagccaggagagguugugguaucauacggcgguaugagggugcggcccaaauguuacggguucagucgcaugauggcaacucuggaagucaauccuccagagcagcgaaucggccaaugcacaggaugucaccuugaaugcaucaacggcggggugagauugauuacccugacgagcgagcuaaaguccgccacuguuugugcuucucauuuuugcucgagcgccaccuccggaaagaaaucaacagagauacaguuccacagugguucucucgugggcaaggcggcaauccacgucaaaggggcccugguggacggaacugaguucaccuuugaaggcagcuguauguuccccgaugguugcgacgcuguagauugcacauuuuguagggaguuccuuaagaauccgcagugcuauccugccaaaaaguggcuguuuauuaucauaguuauuuugcucggguacgcaggccugauguuacugaccaacgugcucaaggcuaucggagucuggggcuccugggugaucgcccccgucaaacuuauguucgcgauuaucaagaaacugaugcggucagugagcuguuugauggggaagcuaauggaccguggacgccaaguuauucaugaagaaauaggugagaauagagagggcaaccaggaugacgugaggaucgaaaugguacggccacgacgcgucagacacuggauguauucuccugugauucugacgauccucgccaucgggcugacugagggaugcgaugaaaugguucaugcagacuccaaacuugugaguuguaggcagggcagcgguaauaugaaggagugcgucacaaccgggcgggcucuguugcccgccgugaacccaggccaggaggcuugucuccacuuuacugcccccggaucuccugauuccaagugccugaaaauuaagguaaaacgcauaaauuuaaaguguaaaaagucaaguagcuacuucgugccagacgcaagaucgaggugcacauccguucgucggugucgaugggccggcgauugccaaucugggugcccgagccauuuuaccucaaacaguuucuccgacgacugggcuggaaagauggauagagcgggccuggguuuuucuggguguagcgacggaugcggcggugcagccuguggcugcuucaaugcugcccccuccuguaucuuuuggaggaaaugggucgaaaacccucacgggauuaucuggaaggugucaccaugcgcagccugggugcccagcgcugucauugagcuaacgaugccuaguggagaaguucgcaccuuccggccaaugucuggcauccccacacagguguucaaagggguguccguaacuuaucucggaagcgauauggaggucucgggccugaccgaccuuugugaaauagaggaguugaagucuaaaaagcuggcccucgcaccgugcaaccaggcggguaugggggugguuggaaaagugggcgaaauccaguguucaagugaggaauccgcuagaacaauuaagaaggaugguugcaucuggaaugccgaccuggucggcauugagcuuaggguggaugacgcaguuuguuacagcaaaaucacuucuguggaagccguagucaacuauagcgcuauaccuaccacaauugggggacugcgcuuugagcgaucccacgauucacaaggcaagaucagugggagcccauuggacauuaccgccauccggggaucuuucuccgugaauuaccguggccucagacugucauuaagugagauaacugcaacgugcacaggugaagugaccaacgucagcgggugcuacuccuguaugacuggagcuaaaguuucuaucaagcugcauucgagcaaaaauucaaccgcccacgugaggugcaagggcgaugagacagcguuuuccguacuagaaggugugcauaguuauaccgucucucucagcuucgaccacgccgugguugaugagcagugucagcugaacugcggcgggcacgaaucccaggugacucuuaagggaaauuugauuuuucuggacguccccaaauucguggacggcucauacaugcaaacauaucauucuagcguuccuacgggggcuaacauccccaguccaaccgauuggcucaaugcacuguuuggaaacggcuuaucccgcuggauucugggugugaucgggguccuuuugggaggccucgcccuguucuuucuaauaaugagccuguucaagcucggcacuaaacagguauuucggucuagaacaaagcuggcuuga

SEQ ID NO: 11500 - RNA, 3222 nt, Artificial Sequence
  derived and/or modified CDS sequence (opt3) from SFTSV(DS05/CHN/2013)__KR698335.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaucugcaaaauagacggaauuguauucaaccagugugaguccgaaucacugccgcaacccuuugauguugccuggauggacgugggccacagucauaagaucauuaugcgggagcacaaaacuaaguggguccaggagagcuccucuaaggauuucgugugcuauaaagaaggcaccgggccuuguagcgagucagaagagaagacaugcaaaaccaguggauccugccgcggugacaugcaguuuuguaagguggcaggcugcgaacacggggaggaggccagcgaagcuaaauguagaugcucuuuaguccauaagccaggagagguugugguaucauacggcgguaugagggugcggcccaaaugucacggguucagucgcaugauggcaacucuggaagucaauccuccagagcagcgaaucggccaaugcacaggaugucaucuugaaugcaucaacggcggggugagauugauuacccugacgagcgagcuaaaguccgccacuguuugugcuucucacuuuugcucgagcgccaccuccggaaagaaaucaacagagauacaguuccacagugguucucucgugggcaaggcggcaauccaugucaaaggggcccugguggacggaacugaguucaccuuugaaggcagcuguauguuccccgaugguugcgacgcuguagauugcacauuuuguagggaguuccuuaagaauccgcagugcuacccugccaaaaaguggcuguuuauuaucauaguuauuuugcucggguaugcaggccugauguuacugaccaacgugcucaaggcuaucggagucuggggcuccugggugaucgcccccgucaaacuuauguucgcgauuaucaagaaacugaugcggucagugagcuguuugauggggaagcuaauggaccguggacgccaaguuauucacgaagaaauaggugagaauagagagggcaaccaggaugacgugaggaucgaaaugguacggccacgacgcgucagacauuggauguacucuccugugauucugacgauccucgccaucgggcugacugagggaugcgaugaaaugguucacgcagacuccaaacuugugaguuguaggcagggcagcgguaauaugaaggagugcgucacaaccgggcgggcucuguugcccgccgugaacccaggccaggaggcuugucuccauuuuacugcccccggaucuccugauuccaagugccugaaaauuaagguaaaacgcauaaauuuaaaguguaaaaagucaaguagcuauuucgugccagacgcaagaucgaggugcacauccguucgucggugucgaugggccggcgauugccaaucugggugcccgagccacuuuaccucaaacaguuucuccgacgacugggcuggaaagauggauagagcgggccuggguuuuucuggguguagcgacggaugcggcggugcagccuguggcugcuucaaugcugcccccuccuguaucuuuuggaggaaaugggucgaaaacccucacgggauuaucuggaaggugucaccaugcgcagccugggugcccagcgcugucauugagcuaacgaugccuaguggagaaguucgcaccuuccauccaaugucuggcauccccacacagguguucaaagggguguccguaacuuaccucggaagcgauauggaggucucgggccugaccgaccuuugugaaauagaggaguugaagucuaaaaagcuggcccucgcaccgugcaaccaggcggguaugggggugguuggaaaagugggcgaaauccaguguucaagugaggaauccgcucggacaauuaagaaggaugguugcaucuggaaugccgaccuggucggcauugagcuuagaguggaugacgcaguuuguuauagcaaaaucacuucuguggaagccguagcuaacuacagcgccauaccuaccacaauugggggacugagguuugagcgcucccacgauucacaaggcaagaucagugggagcccauuggacauuaccgcaauccgaggaucuuucuccgucaauuaucggggccuccgucugucauuaagugagauaacugcuacgugcacaggugaagugaccaacgugagcgggugcuacuccuguaugacuggagccaaagucucuaucaagcugcauucgagcaaaaauucaaccgcgcacguuagaugcaagggcgaugagacagccuuuuccgugcuagaagguguacacaguuacaccgugucucucagcuucgaccaugcugucguggaugagcagugucagcugaacugcggcgggcacgaaucccagguuacucuuaagggaaauuugauuuuucuggacgugcccaaauucgucgacggcucauauaugcaaacauaccauucuagcgugccuacgggggcaaacauccccaguccaaccgauuggcucaaugcccuguuuggaaacggcuuauccagguggauucuggguguuaucggggugcuuuugggaggccucgcucuguucuuucuaauaaugagccuguucaagcucggcacuaaacaggucuuucgcucucggacaaagcuggccuga

SEQ ID NO: 11501 - RNA, 3222 nt, Artificial Sequence
  derived and/or modified CDS sequence (opt3) from SFTSV(HB154/China/2011)__JQ733560.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauguugccuggauggacgugggccacagucauaagaucauuaugcgggagcacaaaacaaaguggguccaggaaagcuccucuaaggauuucgugugcuauaaagaggggacuggaccuuguagcgaaucagaggaaaaggcaugcaaaaccagugguuccugccgcggcgacaugcaguuuuguaagguggccgggugcgagcacggagaggaagcuagcgaggcaaaauguagaugcucuuuaguccauaagccaggcgaaguugugguaucauacggugggaugagggugcggcccaaauguuacggcuucagucgcaugauggccacacuggaggucaacccuccagaacagcgaaucggacaaugcaccggcugucaccuugagugcaucaaugggggagugagauugauuacucugacaagcgagcuaagguccgcuaccguuugugccucucauuuuugcucgagcgcgacguccgguaagaagucaacugaaauacacuuccacaguggcucucucguggggaaaaccgcaauccaugucaagggagcccugguggacggcacagaguucacuuuugaagguagcuguauguuccccgaugggugcgacgcuguagauugcaccuuuugucgggaguuccuuaaaaacccgcagugcuauccugccaagaaauggcuguuuauuaucauaguuauuuugcucggcuacgcaggacugauguuacugacaaaugugcucaaggcuaucggcgucuggggguccugggugaucgcccccgucaaacuuauguucgcgauuaucaagaagcugaugcguaccgugucauguuugguuggaaaacuaauggaccgcgguagacaggugauuaacgaagagauaggcgagaauggggaaggaaaccaagaugacguaaggaucgagauggcccggccacgacgcgucagacacuggauguauagcccugugauucugacgauccucgcaaucggccuggcugaagguugcgaugagaugguucaugccgacucuaaacuuguguccuguaggcaggggaguggcaauaugaaggagugcauuacuacaggacgggcucuguugcccgccgucaacccaggccaggaagcaugucuccacuuuaccgcccccgggagcccugauucuaagugccugaagauaaaagugaagcgcaucaauuuaaaauguaagaaauccucaaguuacuucguaccagacgcuagaucgaggugcacuucggugcgucggugucgaugggcgggagauugccaguccggcugcccgccccauuuuacaucuaacagcuucucagacgacugggcagguaagauggauagagccgggcugggauuuaguggcuguuccgacgguugcggcggggcugccuguggaugcuucaaugcagccccuucuuguaucuuuuggaggaaguggguugagaacccacacggcauuauuuggaaagucagccccugcgcugccugggugccuuccgcagugaucgaacuaaccaugccaucaggggagguccgcacguuccaccccaugagcggaauaccgacccaaguuuucaagggcgugagugugacauaucucgguucugauauggaaguauccgggcugacugaccuuugugagaucgaggaauugaaaagcaagaaacuggcgcucgcuccuugcaaccaggccggaaugggcgucguggguaagguuggcgagauucaguguucgucagaagagucugcacggaccaucaaaaaggaugggugcauuuggaaugccgaccuggugggaaucgaacuuagagucgaugacgcuguguguuacaguaagauaacauccguugaggccguggcaaacuauagcgcuauuccaacuaccaucggcgggcugagguuugagcgcucucaugauagccagggaaaaauuuccggcucacccuuggacaucacagccauacgagguaguuucagcguaaauuaccgggggcuccgucugucuuuauccgaaaucaccgcgacuugcacgggagaggucacaaacgugucaggcugcuacaguuguaugaccggugccaaggugagcauuaaacugcacuccucuaagaauagcacugcucaugucagaugcaaaggcgaugaaaccgcauuuagcguucuagagggggugcacucauauaucguaucccucaguuucgaccacgccguggucgaugaacaaugucagcugaacugcggaggccaugagucucaggugacacuuaaggggaauuugauuuuucuggacguuccuaaguucguggacggaagcuacaugcagaccuaucacuccacuguccccacaggcgcuaacaucccaucaccuacggauuggcucaaugcccuguuugguaacggguuaucuagguggauacugggagugauuggcguucuuuugggcgggcucgcacuguucagccuaaucauguuucugcucaaacugggaaccaagcaaguguuccgcagucggacuaaacuugcguga

SEQ ID NO: 11502 - RNA, 3222 nt, Artificial Sequence
  derived and/or modified CDS sequence (opt3) from SFTSV(HB155/China/2011)__JQ733563.1__GP
augaugaaggugaucugguucagcucccugauuugccucgucauacaguguucuggcgacucagggcccaucauuugcgccggaccuauccacaguaacaagagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauguugccuggauggacgugggccacagucauaagaucauuaugcgggagcacaaaacaaaguggguccaggaaagcuccucuaaggauuucgugugcuauaaagaggggacuggaccuuguagcgaaucagaggaaaaggcaugcaaaaccagugguuccugccgcggcgacaugcaguuuuguaagguggccgggugcgagcacggagaggaagcuagcgaggcaaaauguagaugcucuuuaguccauaagccaggcgaaguugugguaucauacggugggaugagggugcggcccaaauguuacggcuucagucgcaugauggccacacuggaggucaacccuccagaacagcgaaucggacaaugcaccggcugucaccuugagugcaucaaugggggagugagauugauuacucugacaagcgagcuaagguccgcuaccguuugugccucucauuuuugcucgagcgcgacguccgguaagaagucaacugaaauacacuuccacaguggcucucucguggggaaaaccgcaauccaugucaagggagcccugguggacggcacagaguucacuuuugaagguagcuguauguuccccgaugggugcgacgcuguagauugcaccuuuugucgggaguuccuuaaaaacccgcagugcuauccugccaagaaauggcuguuuauuaucauaguuauuuugcucggcuacgcaggacugauguuacugacaaaugugcucaaggcuaucggcgucuggggguccugggugaucgcccccgucaaacuuauguucgcgauuaucaagaagcugaugcguaccgugucauguuugguuggaaaacuaauggaccgcgguagacaggugauucacgaagagauaggcgagaacggggaaggaaaucaagaugacguaaggaucgagauggcccggccacgacgcgucagacauuggauguauagcccugugauucugacgauccucgcaaucggccuggcugaagguugcgaugagaugguucacgccgacucuaaacuuguguccuguaggcaggggaguggcaacaugaaggagugcauuacuacaggacgggcucuguugcccgccgucaauccaggccaggaagcaugucuccauuuuaccgcccccgggagcccugauucuaagugccugaagauaaaagugaagcgcaucaacuuaaaauguaagaaauccucaaguuacuucguaccagacgcuagaucgaggugcacuagcgugcgucggugucgaugggcgggagauugccaguccggcugcccgccccacuuuacaucuaauagcuucucagacgacugggcagguaagauggauagagccgggcugggauuuaguggcuguuccgacgguugcggcggggcugccuguggaugcuucaacgcagccccuucuuguaucuuuuggaggaaguggguugagaauccacacggcauuauuuggaaagucagccccugcgcugccugggugccuuccgcagugaucgaacuaaccaugccaucaggggagguccgcacguuccaucccaugagcggaauaccgacccaaguuuucaagggcgugagugugacauaucucgguucugauauggaaguauccgggcugacugaccuuugugagaucgaggaauugaaaagcaagaaacuggcgcucgcuccuugcaaccaggccggaaugggcgucguggguaagguuggcgagauucaguguucgucagaagagucugcacggaccaucaaaaaggaugggugcauuuggaacgccgaccuggugggaaucgaacuuagagucgaugacgcuguguguuacaguaagauaacauccguugaggccguggcaaauuauagcgcuauuccaacuaccaucggcgggcugagguuugagcgcucucacgauagccagggaaaaauuuccggcucacccuuggacaucacagccauacgagguaguuucagcguaaacuaccgggggcuccgucugucuuuauccgaaaucaccgcgacuugcacgggagaggucacaaaugugucaggcugcuacaguuguaugaccggugccaaggugagcauuaaacugcauuccucuaagaacucgacugcucacgucagaugcaaaggcgaugaaaccgcauuuagcguucuagagggggugcacucauauaucguaucccucaguuucgaccaugccguggucgaugaacaaugucagcugaauugcggaggccacgagucucaggugacacuuaaggggaacuugauuuuucuggacguuccuagguucguggacggaagcuacaugcagaccuaucauuccacuguccccacaggcgcuaauaucccaucaccuacggauuggcucaacgcccuguuugguaauggguuaucucgcuggauacugggagugauuggcguucuuuugggcgggcucgcacuguucuuucuaaucauguuccugcucaagcugggaaccaaacaaguguuucggagcagaacuaaacuugcguga

SEQ ID NO: 11503 - RNA, 3222 nt, Artificial Sequence
  derived and/or modified CDS sequence (opt3) from SFTSV(HB156/China/2011)__JQ733566.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauguugccuggauggacgugggccacagucauaagaucauuaugcgggagcacaaaacaaaguggguccaggaaagcuccucuaaggauuucgugugcuauaaagaggggacuggaccuuguagcgaaucagaggaaaaggcaugcaaaaccagugguuccugccgcggcgacaugcaguuuuguaagguggccgggugcgagcacggagaggaagcuagcgaggcaaaauguagaugcucuuuaguccauaagccaggcgaaguugugguaucauacggugggaugagggugcggcccaaauguuacggcuucagucgcaugauggccacacuggaggucaacccuccagaacagcgaaucggacaaugcaccggcugucaccuugagugcaucaaugggggagugagauugauuacucugacaagcgagcuaagguccgcuaccguuugugccucucauuuuugcucgagcgcgacguccgguaagaagucaacugaaauacacuuccacaguggcucucucguggggaaaaccgcaauccaugucaagggagcccugguggacggcacagaguucacuuuugaagguagcuguauguuccccgaugggugcgacgcuguagauugcaccuuuugucgggaguuccuuaaaaacccgcagugcuauccugccaagaaauggcuguuuauuaucauaguuauuuugcucggcuacgcaggacugauguuacugacaaaugugcucaaggcuaucggcgucuggggguccugggugaucgcccccgucaaacuuauguucgcgauuaucaagaagcugaugcguaccgugucauguuugguuggaaaacuaauggaccgcgguagacaggugauucacgaagagauaggcgagaacggggaaggaaaucaagaugacguaaggaucgagauggcccggccacgacgcgucagacauuggauguauagcccugugauucugacgauccucgcaaucggccuggcugaagguugcgaugagaugguucacgccgacucuaaacuuguguccuguaggcaggggaguggcaacaugaaggagugcauuacuacaggacgggcucuguugcccgccgucaauccaggccaggaagcaugucuccauuuuaccgcccccgggagcccugauucuaagugccugaagauaaaagugaagcgcaucaacuuaaaauguaagaaauccucaaguuacuucguaccagacgcuagaucgaggugcacuagcgugcgucggugucgaugggcgggagauugccaguccggcugcccgccccacuuuacaucuaauagcuucucagacgacugggcagguaagauggauagagccgggcugggauuuaguggcuguuccgacgguugcggcggggcugccuguggaugcuucaacgcagccccuucuuguaucuuuuggaggaaguggguugagaauccacacggcauuauuuggaaagucagccccugcgcugccugggugccuuccgcagugaucgaacuaaccaugccaucaggggagguccgcacguuccaucccaugagcggaauaccgacccaaguuuucaagggcgugagugugacauaucucgguucugauauggaaguauccgggcugacugaccuuugugagaucgaggaauugaaaagcaagaaacuggcgcucgcuccuugcaaccaggccggaaugggcgucguggguaagguuggcgagauucaguguucgucagaagagucugcacggaccaucaaaaaggaugggugcauuuggaacgccgaccuggugggaaucgaacuuagagucgaugacgcuguguguuacaguaagauaacauccguugaggccguggcaaauuauagcgcuauuccaacuaccaucggcgggcugagguuugagcgcauucacgauucucagggaaaaaucagcggcucccccuuggacauaacagccauccgagguucauucaguguaaacuaccgggggcuccgucugagcuuaucugaaauuaccgcgacuugcacgggagaggucacaaauguguccggcugcuacucauguaugaccggugccaaggugaguaucaaacugcauagcuccaagaacucuacugcucacgucagaugcaaaggcgaugaaaccgcauuuucgguucuagagggggugcacagcuauauuguaucacucuccuucgaccaugccguggucgaugaacaaugucagcugaauugcggaggccacgagagucaggugacacuuaaggggaacuugaucuuucuggacguuccuaaguucguggacggaucuuacaugcagaccuaucauagcacuguccccacaggcgcuaauauaccauccccuacggauuggcucaacgcccuguuugguaauggguuaucaagguggauucugggagugaucggcguucuuuugggcgggcucgcacuguucuuucuaaucauguuccugcucaaacugggaaccaagcaaguguuucgcucucggacuaaacuugcguga

SEQ ID NO: 11504 - RNA, 3222 nt, Artificial Sequence
  derived and/or modified CDS sequence (opt3) from SFTSV(HB2014-04)__KR080475.1__GP
augaugaaggugaucugguuccccagccugauuugcuuugucauacaguguuccggcgacucugggccuaucauuugcgccggaccaauccacucaaacaaaagugcugauauuccgcaucuccuugguuacagcgagaagaucugucaaauagacagacugauccacguuuccucuugguugaggaaucauucgcaguuccagggcuauguggggcagcggggaggccgcucacacguaagcuacuaucccgcagaaaacaguuacucccgauggucugguuuacugagcccuugcgaugccgacuggcuagggaugcucguggucaaaaaggcgaaaggauccgauaugauugugccaggccccucauauaagggcaagguuuucuucgagcguccuaccuuugacggguacgugggaugggguuguggcagugggaaaagcagaacagaaucuggagagcugugcuccucagauagcggcacuagcucuggucuucugccauccgacagggucuuguggaucggggauguggcuugucaacccaugacgccuauuccagaagagaccuuccucgagcugaagaguuuuucgcagucugaauuuccggacaucugcaaaauagauggaauuguauuuaaucagugugagggcgaaucccugccccagccuuucgacguugccuggauggaugugggccauucacacaagaucauuaugcgggagcacaaaacaaaguggguccaagagaguagcuccaaggacuuugugugcuauaaagaagggacuggaccauguucugagagcgaagagaagaccugcaaaacaucagguaguugccgcggcgacaugcaguucuguaagguggcagggugcgaacauggagaggaggccuccgaagcuaaauguagaugcagccucguccacaagcccggcgagguugugguaucuuacggugggaugagggugcggccuaaauguuacggcuuuucacgcaugauggcaaccuuagaagucaaccagccagagcagcgaaucggacaaugcacuggcugucaucuggaaugcaucaaugggggagugagacuuauuacauugaccagugagcuaaagagcgccacgguuugugcuucccacuucugcagcucggccacuagcgguaagaaauccaccgagauacaguuccacucaggcagucugguggggaagacagcgauccaugucaaaggagcacucguggauggcacugaauuuaccuucgaggguucuuguauguuucccgacgggugcgaugccguagacugcacauucuguagggaauuucugaagaacccgcagugcuauccugcuaaaaaguggcuuuucauuaucauaguuauucuguugggcuacgccggacucaugcuguuaaccaaugugcugaaggcaaucggcaucugggggagcugggucauugcucccgugaaacucaucuuugccauuauaaagaaacuuaugcggacggucuccugucugaugggaaaguugauggaucguggucgccaagugauccacgaggaaauuggcgagaacagagaggggaaucaggacgauguuaggaucgaaauggcgcggccacgacgcgugagacauuggauguauucaccuguaauccuaacuauucuggccauaggacucgcagagagcugcgacgaaaugguccacgcugauucuaaacugguguccuguaggcagggcagugguaacaugaaggagugcguuacaaccgggcgggcccuucugcccgcugugaauccaggccaggaggccuguuugcauuucacugcacccggaagcccugacucuaagugccucaaaaucaaggucaaacgcauuaaccugaaguguaaaaaguccucaaguuacuuugugccagaugccagaucuaggugcacaucgguacgucggugucgaugggcuggcgacugccaauccgggugcccgccccacuucaccucuaauagcuuuucagacgauugggcgggaaagauggacagagcaggcuuagguuucaguggguguuccgauggaugcggcggugccgcuuguggcugcuuuaacgccgcaccuucuuguaucuucuggaggaaauggguggaaaauccacacgggauuaucuggaagguuagccccugcgccgcuugggucccuuccgccgugauagagcugacgaugccaucaggagaagugcgcaccuuccaucccaugagcggcaucccgacacaggucuuuaaagggguuagugugacuuaucuaggaucugacauggagguguccggccucaccgaucugugugaaauugaggagcuuaagagcaaaaaguuggcacuggcgccuugcaaccaggcugguauggggguagucggaaaagugggcgaaauccaguguucgucagaggaaucugcccggacaauuaagaaggacgguugcaucuggaacgcagaucucguuggcauagagcugagaguggacgaugccgucuguuacaguaaaauuacuuccguggaagcuguugccaauuauagcgcaaucccaaccacaauugggggacuuagguucgagcgcucucacgacagccaaggcaagaucuccgggucaccccuggauauaaccgcuauccgaggaaguuuuagcgugaacuaccggggcuugcgucucucucuguccgagauuacugccacgugcacaggugaaguaaccaaugucucagggugcuacaguuguaugacuggagcgaaagugagcaucaaguuacauuccucuaaaaacucgaccgcccacgugagaugcaagggcgacgagacagcuuucagcguccuggaagguguucacucauauaccgugucccuaaguuuugaucaugcaguaguggacgagcagugucagcucaauugcggcgggcacgaaucucaggucacucugaagggaaaccuuauuuucuuggacgugccuaaauuuguugauggcagcuacaugcaaacauaucauuccacggugcccaccggggccaauaucccaucaccuacugacuggcugaacgcucucuucggaaauggccugucuagguggauauuaggugucauuggggugcugcuuggaggcuuggcccucuuuuucaugaucaugagccuguuuaagcuaggcacaaaacagguuuuccgcagucgguccaagcuggcauga

SEQ ID NO: 11505 - RNA, 3222 nt, Artificial Sequence
  derived and/or modified CDS sequence (opt3) from SFTSV(HNXH)__KT254590.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuugcaguuccgauucagguacgagcagugggcuguugccuucugacaggguccucuggaucggagauguggcuugucagccaaugacccccauuccugaagagacauuucuggagcugaaguccuucagccagucggaauuuccagacaucugcaaaauagauggcauuguauucaaucagugugagggcgaaucucucccgcaacccuuugacguugccuggauggauguggggcacucccauaagaucauuaugcgggagcacaaaacuaaguggguccaggagucaaguagcaaggacuucgugugcuauaaagaaggaaccgguccuuguuccgagucugaagagaagacaugcaaaaccagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacucuggaagucucacagccugagcaacgaaucggccagugcacagggugucaccuugaaugcaucaacggaggugugagauugauuacccugacgagugagcuaaagagcgccacuguuugugcuucccauuuuuguucuucggccaccagcggcaagaaauccacagagauacaguuccacucagggagucucgugggaaagacugcgauccacgucaaaggcgcacugguggaugguaccgaguucacauuugaagggucuugcauguucccagacggcugcgaugccguagacugcaccuuuuguagggaguuccuuaagaauccccaaugcuauccggcuaaaaaguggcuguuuauuaucauaguuauuuugcucggauacgccggccugauguuacugacgaacgugcucaaggcaaucggggucuggggaagcugggugaucgcuccugucaaacuuguguucgcccugauuaagaaauugaugcgggcgguuuccugucuaauggguaagcugauggaucguggccgccaggugauccaugaagaaauuggggagaauagagagggaaaccaggacgauguaaggauagaaauggcccggccccgacgcgucagacacuggauguauucaccagugauccucacuauucuggcaaucggccuugcugaggguugcgacgaaaugguucaugccgauagcaaacuggugucuuguaggcagggguccggcaauaugaaggagugcgucacaaccggacgggcuuugcucccugccgugaaccccggccaagaggcaugucugcacuuuacugccccagggagucccgacagcaagugcuuaaaaaucaagguaaaacgcauuaaucugaaguguaaaaagucuuccucauacuucgugccugaugcuagaaguaggugcacaagcguucgucggugucgaugggcgggagacugccagucgggcugcccaccgcauuuuaccuccaacucuuucagcgacgauugggcagguaagauggacagagccgggcuaggauuuucaggcuguagugaugguugcggcggggcugccuguggaugcuucaaugcagcccccuccuguauauuuuggaggaaaugggucgaaaacccucacggcaucauuuggaaggugucuccaugcgcugccugggugcccagcgcagucaucgagcucacgaugccuuccggggaaguucgcaccuuccacccaaugucaggcauucccacacagguguucaaaggagugagcguaacuuaucuggguagugacauggaggucucugggcuuaccgauuugugugaaaucgaggagcugaaguccaaaaagcucgcgcuggcuccgugcaaucaggccggaaugggcgugguugguaaagugggcgaaauacaauguagcucggaggaaucagcacggacaaucaagaaggacgggugcauuuggaacgccgaucuugucggaaucgagcugagaguggacgaugcuguuuguuacucuaaaauuacuucuguggaagccguagcaaacuauuccgcuaucccuaccacaauaggcggguugagguuugagcgcagccaugacucucagggaaagauuagcggcuccccacucgauaucaccgccauucgagguucauucagugucaauuaccgggggcugcguuuaagccugucugagaucacugcgacgugcacaggagaagugaccaacguguccggcugcuacucauguaugacuggugccaaagucaguauaaagcuacacagcuccaaaaauucuaccgcucauguuagaugcaagggcgacgagacagcauuuucggugcucgaagggguacacagcuauucagugucccugaguuucgaucacgccgucguggacgagcagugucagcuuaacugcggaggccaugaaucucaaguuaccuugagggggaaucugaucuuucucgacgugcccaaguucgucgauggaagcuacaugcagacuuaucacuccacagugccuacgggcgcuaacauucccucaccaaccgacuggcugaaugccuuauuugguaacgggcugucucgcuggauccuuggaguuacuggcguguugcucggcgggcuggcacuauucuuucugauuaugagccucuucaaacugggaacaaagcagaucuuucggaguagaaccaaacuugcguga

SEQ ID NO: 11506 - RNA, 3222 nt, Artificial Sequence
  derived and/or modified CDS sequence (opt3) from SFTSV(JS2012-goat01)__KC473538.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugaggauccggcccaaauguuacggcuuuagucgcaugauggcaaccuuagaagugaaccagccugagcaacgacugggacagugcacuggcugucaccuugaaugcaucaaugggggagucagauugauuacacugaccagcgagcuaaaguccgccacggugugugcuucucauuucugcucgagcgccacuuccgguaagaaaucaaccgagauacaguuccacaguggcucucucguugggaagacagcgauccacgugaaaggagcacuggucgauggcacugaauuuaccuucgaggguagcuguauguuuccagacgggugcgaugccguggacugcacauucuguagggaauuucuuaagaacccccaaugcuauccggcuaaaaaguggcuguucauuaucauaguaauuuugcucggcuacgccggacugauguuacugaccaauguucucaaggcaaucggcaucuggggguccugggugauugcuccugucaaacuuauguuugccaucauuaagaaacugaugcggacggugucauguuugaugcguaagcuaauggaucgcggaagacaggucauacaugaggaaaucggugagaacagggagggcaaucaggacgaugugcggauugaaauggcgcgaccccgcagaguuaggcacuggauguauagcccagugauccugacuauccucgccauugggcuggcagagucuugcgacgaaaugguacaugcugauuccaaacuugucaguugucggcagggaagcggcaacaugaaggagugcgugacaaccggucgcgcccuguugccugcuguuaaucccgggcaagaggccugucuccacuucacugcaccaggcucucccgacuccaagugccugaaaauaaaggugaaaagaaucaacuuaaaguguaaaaagucaaguagcuacuuugucccugaugccaggucgcguugcacauccgugcggcgauguagaugggcuggagacugccagucuggcugcccaccgcauuucaccagcaauucauuuagugacgauugggcggggaagauggacagggcaggacugggcuucuccgguuguucugaugggugcggaggcgccgcuugugguugcuuuaacgccgcacccagcuguauuuucuggcgcaaauggguagaaaauccucacggcaucauuuggaagguguccccaugcgccgcuuggguucccucagccgucaucgagcuaacgaugccuagcggggaagugcggaccuuccacccaaugaguggaauacccacacagguguuuaaaggcgucucuguuacuuaucucggguccgacauggaggugagcggacugaccgaucuuugugaaaucgaggaguugaagucgaaaaagcuggcacucgcgccgugcaaccaggcuggcaugggugugguagggaaagucggagaaauucaauguucaucugaggaaagugccagaacaaucaagaaggacggcugcauuuggaacgcagaucugguggguaucgagcuuaggguugacgaugccguguguuacuccaaaauaacuagcgucgaagcuguggccaauuauucugcaauuccuaccacaaucggcgggcugcgcuucgagcggagcuuggacucccagggaaagauuucaggcaguccacucgauaucaccgcuauacgagggagcuuuucuguuaacuaccguggacugagauuaucccugucagagaucacugccacgugcacaggcgaagugaccaauguaagugguugcuacagcuguaugacuggggcgaaagucuccauuaagcuacauucuucgaaaaacagcaccgcccacgugaggugcaagggagacgagacagcuuucucagugcucgaaggcguccauuccuauaccguuagucugucuuuugaucacgcagugguagacgagcagugucagcuuaauugcgguggccacgaaagccaagugacuuugaaggggaaccugaucuuccucgacguccccaaauuuguggauggauccuacaugcagacauaucauucaacgguuccuaccggcgccaauauucccucuccaacugacuggcugaacgcuuuauucgggaauggacugagccgcuggauccuuggcgugauaggugucuugcucgggggacuggcccuauuuuucaugauuaugagucuguuuaagcucggcacaaaacagguguuccgguccagaaccaagcuggcauga

SEQ ID NO: 11507 - RNA, 3222 nt, Artificial Sequence
  derived and/or modified CDS sequence (opt3) from SFTSV(JS2012-tick01)__KC473541.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgacugggacagugcacuggcugucaccuugaaugcaucaaugggggagugagauugaucacacugaccagcgagcuaaaguccgccacgguuugugcuucucauuucugcucgagcgccacuuccgguaagaaaucaaccgagauucaguuccacaguggcucucucguggggaagacagcgauacacgucaaaggagcacugguggauggcacugaauuuaccuucgaggguagcuguauguuuccagacgggugcgaugccguagacugcacauucuguagggaauuucuuaagaacccccaaugcuauccggcuaaaaaguggcuguucaucauuaucguuauauugcucggcuacgccggacugauguuacugaccaaugugcucaaggcaauuggcaucuggggguccugggucaucgcuccugugaaacuuauguuugccauuaucaagaaacugaugcggacggucucauguuugaugcguaagcuaauggaucgcggaagacaggugauucaugaggaaauaggugagaacagggagggcaaucaggacgauguucggaucgaaauggcgcgaccccgcagagugaggcacuggauguauagcccaguaauucugacuauccucgccaucgggcuggcagagucuugcgacgaaaugguccaugcugauuccaaacuugugaguugucggcagggaagcggcaacaugaaggagugcguuacaaccggucgcgcccuguugccugcugugaaucccgggcaagaggccugucuccacuucacugcaccaggcucucccgacuccaagugccugaaaauuaaggucaaaagaauaaacuuaaaguguaaaaagucaaguagcuacuuugugccugaugccaggucgcguugcacauccguacggcgauguagaugggcuggagacugccagucuggcugcccaccgcauuucaccagcaauucauuuagugacgauugggcggggaagauggacagggcaggacugggcuucuccgguuguucugaugggugcggaggcgccgcuugugguugcuuuaacgccgcacccagcuguaucuucuggcgcaaauggguggaaaauccucacggcauuaucuggaagguuuccccaugcgccgcuuggguccccucagccgugauugagcuaacgaugccuagcggggaagugcggaccuuccacccaaugaguggaauccccacacaggucuuuaaaggcguuucugugacuuaucucggguccgacauggaggugagcggacugaccgaucuuugugaaauagaggaguugaagucgaaaaagcuggcacucgcgccgugcaaccaggcuggcauggguguagucgggaaagugggagaaauccaauguucaucugaggaaagugccagaacaauuaagaaggacggcugcaucuggaacgcagaucugguugguauugagcuuaggguggacgaugccgucuguuacuccaaaaucacuagcguggaagcuguugccaauuauucugcaauaccuaccacaauuggcgggcugcgcuucgagcgaagccaugacucccagggaaagaucucaggcaguccauuggauauuaccgcuauccgggggagcuuuucugugaacuaccguggacucagacuguccuuaucagagauaacugccacgugcacaggcgaaguaaccaaugucagugguugcuacagcuguaugacuggggcgaaaguguccaucaagcugcacucuucgaaaaacagcaccgcccaugugaggugcaagggagacgagacagcuuucucaguccuagaaggcguucacuccuauaccgugagucucucuuuugaucacgcaguaguggacgagcagugucagcugaauugcgguggccaugaaagccaagucacucuuaaggggaacuugauuuuccuggacgugcccaaauuuguugauggauccuacaugcagacauaucacucaacggugccuaccggcgccaauauccccucuccaacugacuggcucaacgcucuguucgggaauggauuaagccgcuggauucugggcgucaucggugugcuucucgggggauuggcccuguuuuucaugauaaugagucuauuuaagcugggcacaaaacagguuuuccgguccagaaccaagcucgcauga

SEQ ID NO: 11508 - RNA, 3222 nt, Artificial Sequence
  derived and/or modified CDS sequence (opt3) from SFTSV(LN2012-14)__KF887436.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcggacggucucaugucugaugggaaaguugauggaucguggucgccaggugauccaugaggaaauuggcgagaacagagaggggaaucaggacgauguuuggaucgaaauggcgaggccccggcgagugcgcuauuggauguacagcccaguaauccuaacuauucuggccgucggacucgcagagucuugcgacgaaauggugcacgcugauuccaaacugguuaguuguagacagggcagcgguaacaugaaggagugcgugacaaccgggagggcccuucugccugcugucaaucccggccaagaggccuguuugcauuucacugcaccaggaucucccgacuccaagugccucaaaauacgggugaagcgcaucaaccugaaauguaagaaaucaaguagcuauuuuguaccugaugccagaucgaggugcacauccgugcgucggugucgaugggcuggcgacugccagucugggugcccaccgcacuucaccagcaauucauuuagugacgauuggguuggaaagauggacagagcgggcuuagguuucuccggguguucugauggaugcggcggugcagccuguggcugcuuuaacgcugcccccagcuguauuuucuggaggaagugggucgaaaauccucaugggaucauuuggaaaguguccccaugcgcagccugggugcccucagcugucaucgagcugacgaugccuagcggagaaguucgcaccuuccacccaaugaguggcauacccacacagguguuuaagggggugucuguaacuuaccuaggauccgacauggaggucagcggccucaccgaucugugugaaaucgaggagcuuaaaucgaagaaauuggcccuggcaccgugcaaccaggcggguaugggggugguuggaaaggugggcgaaauucaauguucaucugaggaaagugcucggacaaucaaaaaggacgguugcauuuggaacgccgaucucgucggcaucgagcugagaguggacgaugcaguuuguuauuccaagauaacuagcguggaagccguagcuaauuacucugccauuccuaccacaaucgggggacuuagguucgagcgcagccacgacucccagggcaaaauuucagggaguccacuggauaucaccgcaauacgaggaucguuuucugucaacuaccggggcuugcgucucucccugucagagaucacugcuacgugcacaggugaagugaccaaugugagugggugcuauagcuguaugacuggagccaaggucuccauuaaauuacauucuaacaagaauagcaccgcgcacguuagaugcaaaggcgacgagacagccuucagcgugcuggaagguguacauucauacaccgugucccuaaguuuugaucacgcugucguggacgagcagugucagcucaacugcggcgggcacgaaucucaaguuacucugaagggaaaucuuaucuucuuggacgugcccaaguuugucgauggcagcuauaugcagacauaccauuccacggugccuaccggggcaaacauucccucaccaacugacuggcugaaugcccucuucggaaacggccugucuagguggaucuuagguguuauaggggugcugcuuggaggcuuggcucucuuuuucaugauuaugagccuguuuaaacuaggcacaaagcaggucuuccgcagucggaccaaacuggccuga

SEQ ID NO: 11509 - RNA, 3222 nt, Artificial Sequence
  derived and/or modified CDS sequence (opt3) from SFTSV(LN2012-34)__KF887437.1__GP
augaugaaggugaucugguucuuuagccugauuugcuucgucauacaguguuccggcgacucugggcccaucauuugcgccggaccuauccacucaaacaaaagugcugauauuccacaucuccuugguuacagcgagaagaucugucaaauagacagacugauccacguuuccucuugguugaggaaucauucgcaguuucagggcuauguggggcagcggggaggccgcucacaaguaagcuacuauccggcagaaaacaguuacucccgauggucugguuuacugagccccugcgaugccgacuggcuagggaugcucguggucaaaaaggcgaaaggauccgauaugauugugccuggcccaucauauaagggcaagguuuucuuugagcgucccaccuucgacggguacgugggaugggguuguggcagugggaaaagcagaacagaaucuggagagcugugcuccucagauagcggcacuucuucuggucuucugccuuccgacagggucuuguggaucggggauguggcuugucagccaaugacgcccauuccugaagagaccuuucucgagcucaagagcuucucgcagucugaauuuccagacaucugcaaaauagauggaauuguauucaaucagugugagggcgaaucccugccgcaacccuuugacguugccuggauggaugugggccacucacauaagaucauuaugcgggagcacaaaacaaaguggguccaggagaguagcuccaaggacuucgugugcuauaaagaagggacuggaccuuguucugagagcgaagagaagaccugcaaaacaucagguaguugccgcggcgacaugcaguuuuguaagguggcagggugcgaacacggagaggaggccuccgaagcuaaauguagaugcagccugguccauaagccaggcgagguugugguaucuuacggugggaugaggauccggcccaaauguuacggcuucucacgcaugauggcaaccuuagaagugaaccagccugagcaacgaaucggacagugcacuggcugucaccuggaaugcauuaaugggggagucagacuuauaacauugaccagugagcuaaagagcgccacggugugugcuucccauuucuguucuucggccacuagcgguaagaaauccaccgagauccaguuucacucaggcagucugguugggaagacagcgauucacgugaaaggagcacucgucgauggcacugaguucaccuuugaagguucuugcauguucccagacgggugcgaugccguggacugcacauuuuguagggaguuccugaagaacccccaaugcuauccggcuaaaaaguggcuuuuuaucauaauuguaauccuguugggcuacgccggacucaugcuguuaaccaauguucugaaggcaaucggcauuugggggagcugggugaucgcuccugucaaacucauuuucgccauaaucaagaaacuuaugcggacgguguccugucugaugggaaaguugauggaucguggucgccaggucauucaugaagaaaucggcgagaacagagaggggaaucaggacgaugugaggaucgaaauggcgcggccccgacgcguuagacacuggauguauucaccagugauucuaacuauacuggccaucggacucgcagagagcugcgacgaaaugguacaugcugauucuaaacuggucuccuguaggcagggcagugguaacgugaaggagugcguuacaaccgggcgggcccuucugccugcugugaaucccggccaagaggccuguuugcacuuuacugcaccaggaagccccgacucuaagugccucaaaauucgcgucaagagaaucaaccugaaauguaagaaauccucaaguuacuucgugccugaugccaggagccguugcacaucgguacggcgauguagaugggcuggcgacugccaguccgggugcccaccgcauuuuaccucuaauagcuucucagacgauugggcgggaaagauggacagggcaggcuuagguuuuaguggguguuccgauggaugcggcggugccgcuuguggcugcuucaacgccgcacccucuuguauuuucuggcgcaaguggguggaaaauccucacgggaucauauggaaaguuagcccaugcgccgcuuggguccccuccgccgugaucgagcugacgaugccuucaggagaagugcggaccuuucacccaaugagcggcauucccacacaggucuucaaggggguuaguaucacuuaucuaggaucugacauggagguguccggccucaccgaucugugugaaauugaggagcuuaaaagcaagaaauuggcacuggcgccgugcaaccaggcugguaugggggugguaggaaaggucggcgaaauccaauguucgucagaggaaucugccagaacaauaaagaaggacgguugcauuuggaacgcagaucucgugggcaucgagcugaggguugacgaugccguguguuacaguaagauuacuuccgucgaagcuguggccaauuauagcgcaaucccuaccacaauagggggacuucgcuuugagcgaucucaugacagccagggcaaaaucuccgggucaccacuggauauuaccgcuauccggggaaguuucagcguuaacuaccguggcuugagacucucucuguccgagauuacugccacgugcacaggugaagugaccaauguaucagggugcuacaguuguaugacuggagcgaaggucagcaucaaauuacacuccaacaagaauaguaccgcccaugugaggugcaaaggcgacgagacagcuuuuucggugcuggaagguguccacagcuauaccguuucacuauccuucgaucacgcagugguagacgagcagugucagcucaacugcggcgggcaugaaagucaagugacucugaagggaaaucuuauauuuuuggacguccccaaguucguggauggcucuuacaugcagacauaucacagcacgguuccuaccggggccaacauucccuccccaacugacuggcugaaugcucucuuuggaaacggccugucacgcuggaucuuaggugugaucgggguccugcuuggaggcuuggcccucuucuuuaugauuaugucucuguucaaacuaggcacaaaacagguguuucggagcagaaccaaacuggcauga

SEQ ID NO: 11510 - RNA, 3222 nt, Artificial Sequence
  derived and/or modified CDS sequence (opt3) from SFTSV(LN2012-41)__KF887438.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcggacggucucaugucugaugggaaaguugauggaucguggucgccaggugauccaugaggaaauuggcgagaacagagaggggaaucaggacgauguuaggaucgaaauggcgcggccccgacgcgugagacacuggauguauagcccaguaauccuaacuauucuggccauaggacucgcagagucuugcgacgaaaugguccaugcugauuccaaacuggugaguuguaggcagggcagcgguaacguuaaggagugcgugacaaccgggcgggcccuucugccugcugucaaucccggccaagaggccuguuugcacuucacugcaccaggaucucccgacuccaagugccucaaaauccgcgugaagagaauuaaccugaaauguaagaaaucaaguagcuacuuuguaccugaugccaggucgcguugcacauccgugcggcgauguagaugggcuggcgacugccagucugggugcccaccgcauuucaccagcaauucauuuagugacgauugggcgggaaagauggacagggcaggcuuagguuucuccggguguucugauggaugcggcggugccgcuuguggcugcuuuaacgccgcacccagcuguaucuucuggcgcaaguggguugaaaauccucacgggauuaucuggaaagucuccccaugcgccgcuugggugcccucagccgugauagagcugacgaugccuagcggagaaguccggaccuuccacccaaugaguggcauccccacacagguuuuuaagggggugucugugacuuaucuaggauccgacauggagguaagcggccucaccgaucugugugaaauugaggagcuuaaaucgaagaaauuggcacuggcgccgugcaaccaggcugguaugggggucgugggaaagguuggcgaaauccaauguucaucugaggaaagugccagaacaauuaaaaaggacgguugcaucuggaacgcagaucucgugggcauagagcugagggucgacgaugccguguguuacuccaagauuacuagcguugaagcugugguaaauuauucugccaucccuaccacaauugggggacuucgcuucgagcgaagccaugacucccagggcaaaaucucagggaguccacuggauauaaccgcaauccggggaucguuuucugucaacuaccguggcuugagacucucccugucagagauuacugcuacgugcacaggugaagugaccaaugugagugggugcuacagcuguaugacuggagccaaggucuccaucaaauuacacucuaacaagaauagcaccgcgcauguuaggugcaaaggcgacgagacagccuucagcgugcuggaagguguacacucauauaccgugucccuaaguuuugaucacgcugucguggacgagcagugucagcucaacugcggcgggcaugaaucucaaguuacucugaagggaaaucuuauuuucuuggacgugcccaaguuugucgauggcagcuacaugcagacauaucacuccacggugccuaccggggcaaacauccccucaccaacugacuggcugaaugcccucuucggaaacggccugucucgcuggauauuagguguuauuggggugcugcuuggaggcuuggcucucuuuuucaugaucaugagccuguuuaaacuaggcacaaagcaggucuuccggaguagaaccaaacuggccuga

SEQ ID NO: 11511 - RNA, 3222 nt, Artificial Sequence
  derived and/or modified CDS sequence (opt3) from SFTSV(LN2012-58)__KF887440.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugugcaacgaaucggacagugcacuggcugucaccuggagugcaucaaugggggaguuagacuuauuacauugaccagcgaacugaaguccgccacggugugugcuucucauuucugcucgagcgccacuuccgguaagaaaucaaccgagauacaguuccacaguggcucucuagucgggaagacagcgauccacgugaaaggagcacucguagauggcacugaguuuaccuucgaagguagcuguauguuuccagacgggugcgaugccguugacugcacauucuguagggaguuucugaagaacccccaaugcuauccggcuaaaaaguggcuuuucauuaucauagugauucuguugggcuacgccggacucaugcuguuaaccaauguccugaaggcaaucggcaucuggggguccugggugauugcuccugucaaacucaucuuugccauuauaaagaaacuuaugcggacggugucaugucugaugggaaaguugauggaucguggucgccagguuauccaugaagagauuggcgaaaacagagaggggaaucaggacgaugugaggaucgagauggcgcggccccgacgcguaagacacuggauguauagcccagucauccuaacuauucuggugaugggacucgccgaaucuugcgacgagaugguucaugcagauuccaaacuggugaguuguaggcagggcagcgguaacaugaaggaaugcgucacaaccgggcgggcccuucugccugcugugaaucccggccaagaggcuuguuugcacuucacugccccaggaucucccgacuccaagugccucaaaauaaagguaaaacgcaucaaccugaaguguaaaaagucaaguagcuacuuugugccugaugcaagaucgaggugcacauccguucgucggugucgaugggccggcgacugccagucugggugcccaccgcauuucaccagcaauucauuuagugacgauugggcuggaaagauggacagagcgggcuuagguuucuccggguguucugauggaugcggcggugcagccuguggcugcuuuaacgcugcccccagcuguauuuucuggaggaaaugggucgagaauccucacgggaucauuuggaagguguccccaugcgcagccugggugcccucagcugucaucgaacugacgaugccuagcggagagguucgcaccuuccacccaaugaguggcauacccacacagguguuuaaaggggugucuguaacuuaucuaggauccgacauggaagucagcggccucaccgaucugugugagaucgaggaacuuaagucgaaaaaguuggcccuggcaccgugcaaccaggcggguaugggggugguuggaaaagugggcgagauucaauguucaucugaagagagugcucggacaaucaagaaggacgguugcauuuggaacgccgaucucgucggcaucgaacugagaguggacgaugcaguuuguuacuccaaaauaacuagcguggaggccguagcuaauuauucugccauuccuaccacaaucgggggacuuagguucgaacgcagccaugacucccagggcaagauuucagggaguccacuggauaucaccgcaauacgaggcagcuuuucugucaacuaccggggauugcgucucucccugucagagaucacugcuacgugcacaggugaggugaccaaugugagugggugcuacagcuguaugacuggagccaaagucuccauuaaguuacacucuucgaaaaacagcaccgcgcauguuagaugcaagggcgacgaaacagccuucucagugcuggaggguguacacuccuauaccgugagucuaucuuuugaucacgcugucguggacgaacagugucagcucaauugcggcgggcaugagagccaaguuacucugaagggaaaccuuaucuucuuggacgugcccaaauuugucgauggcuccuacaugcagacauaucacucaacggugccuaccggggcaaauauucccucuccaacugacuggcugaacgcccucuucggaaauggccugaguagguggaucuuagguguuauaggggugcugcuuggaggcuuggcucucuuuuucaugauuaugagccuguuuaagcuaggcacaaaacaggucuuccgcucccggaccaagcuggccuga

SEQ ID NO: 11512 - RNA, 3222 nt, Artificial Sequence
  derived and/or modified CDS sequence (opt3) from SFTSV(NB24/CHN/2013)__KR698337.1__GP
augaugaaggugaucugguucagcucccugauuugccucgucauacaguguucuggcgacaccgggcccaucauuugcgccggaccuauccacucaaacaaaagugcugauauuccacaucuucuggguuacagcgagaagaucugucaaauagacagauugauccacguuuccucuugguuaaggaaucauucgcaguuucagggcuauguggggcagcggggaggccgcucacaaguaagcuacuauccggcagaaaacaguuacucccgauggucuggucugcuaagccccugcgaugccgacuggcucgggaugcugguggucaaaaaggcgaaaggauccgauaugauugugccuggcccaucauauaagggcaagguuuucuuugagcgucccacauucgacggguacgugggaugggguuguggcagugggaaaagcagaacugaaucuggagagcuuugcuccucagauagcggcacgaguucuggucuguugccuuccgacaggguccucuggaucggggauguggcuugucagccaaugacccccauuccugaagagacauuucuggagcucaagagcuucucgcagucugaauuuccagacaucugcaaaauagauggaauuguauucaaucagugugaguccgaaucacugccgcaacccuuugacguugccuggauggaugugggccacagucauaagaucauuaugcgggagcacaaaacuaaguggguccaggagagcuccucuaaggacuucgugugcuauaaagaaggcaccgggccuuguagcgagucagaagagaagacaugcaaaaccaguggauccugccgcggugacaugcaguuuuguaagguggcaggcugcgaacacggggaggaggccagcgaagcuaaauguagaugcucuuuaguccauaagccaggagagguugugguaucauacggcgguaugagggugcggcccaaauguuacggguucagucgcaugauggcaacucuggaagucaacccuccagagcagcgaaucggccaaugcacaggaugucaccuugaaugcgugaauggcgggguuagauugaucacccugacgagcgagcuaaaguccgccacugugugugcuucucauuuuugcucgagcgccaccuccggaaagaaaucaacagagauucaguuccacagugguucucucgucggcaagacugcgauacacgugaaaggggcacugguagauggaaccgaguucacauuugaaggcagcuguauguuccccgacgguugcgaugccguugacugcaccuuuuguagggaguuccuuaagaacccgcagugcuauccugcuaaaaaguggcuguuuaucaauauugugaucuugcucggguacgccggccugauguuacugacgaacguccucaaggcaauaggaguguggggcuccugggucauugcucccgugaaacuuauguucgccaucaucaagaaacugaugcggucaguuagcuguuugauggggaagcuaauggaucguggacgccaagugauucaugaagaaaucggugagaauagagagggcaaccaggacgauguaaggauugaaauggcgcggccacgacgcgucagacacuggauguauucuccugugauacugacuauccucgccguugggcuggcagagggaugcgacgaaauggugcaugcugauuccaaacuugucaguuguaagcagggcagcgguaauaugaaggagugcgugacaaccgggagggcccuguugcccgcuguaaacccaggccaggaggccugucuccacuuuacugcacccggaucuccugacuccaaaugccugaagauuaaagugaagaaaaucaauuuaaaguguaagaaaucaaguagcuacuucguuccagaugcccggucgcgcugcacauccgucagaaggugucguugggcuggcgacugccaaucugggugcccgagccauuuuaccucaaacaguuucuccgacgauugggcgggaaagauggaccgggcaggccuggguuuuucuggguguagcgauggaugcggcggugccgcuuguggcugcuucaaugccgcacccuccuguaucuuuuggcgaaaauggguggaaaacccucacgggauuauauggaaggugucaccaugcgccgcuuggguccccagcgccguuaucgagcuaacgaugccuaguggagaagugagaaccuuccacccaaugucuggcauucccacacagguguucaaagggguauccgucacuuaucucggaagcgacauggaggugucgggccugaccgaucuuugugaaaucgaggaguugaagucuaaaaagcuggcacucgcgccgugcaaccaggcugguauggggguugugggaaaggucggcgaaauucaguguucaagugaggaauccgccaggacaaucaaaaaggacgguugcauauggaaugcagaucuggugggcaucgagcuucgcguugacgaugccguguguuacagcaaaauuacuucuguagaagcugucgccaacuauagcgcaaucccuaccacaauugggggacugcgguuugagagaucccaugacucacaaggcaagaucagugggagcccauuggauauaaccgcuauuaggggaucuuucuccgugaauuaccgcggccuccgacugucauuaagugagaucacugccacgugcacaggugaagugaccaacgucagcgggugcuacuccuguaugacuggagcgaaaguuucuauuaagcugcacucgaauaagaacagcaccgcccaugugcggugcaaaggcgacgagacagcuuuuucaguacuagaaggugugcacuccuauaccgucagucucucuuucgaucacgcagugguugacgagcagugucagcugaauugcggcgggcaugaaagccaggugacucuuaagggaaacuugaucuuucuggacguccccaaauucguggauggcuccuacaugcaaacauaucacucaucuguuccuacgggggccaauauacccagcccaaccgacuggcucaacgcucuguuuggaaauggcuuaagucguuggauccugggugugauugggguccuuuugggaggccucgcccuguucuuucuaaucaugucccuguucaagcucggcacuaaacagguauuuagaagcaggucuaagcuggcauga

SEQ ID NO: 11513 - RNA, 3222 nt, Artificial Sequence
  derived and/or modified CDS sequence (opt3) from SFTSV(NB31/CHN/2013)__KR698338.1__GP
augaugaaggugaucugguucagcucccugauuugcuuugucauacaguguucuggcgacaccgggcccaucauuugcgccggaccuauccacucaaacaaaagugcuaauauuccacaucuccuugguuacagcgagaagaucugucaaauagauagacugauccacguuuccucuugguugaggaaccauucgcaguuccagggcuauguggggcagcggggaggccgcucacaaguaagcuacuauccgagugaaaauuccaacucucgauggagcgguuuacugucccccugcgacgcagauuggcuagggaugcucguggucaaaaaggccaaaggaucagacaugauugugccuggcccaaguuacaagggcaagguuuucuucgagcgucccacauuugauggguaugugggaugggguuguggcagcgggaaaucuagaacugaauccggagagcugugcucaagcgacaguggcacgucuuccggucuucugccuagcgauagggucuuguggaucggggacguggcgugucagccaaugacccccauuccugaagagacauuccucgagcugaagucguuuucucaguccgaauuuccagauaucugcaaaauagacggaauuguauuuaaucagugugagucagaaagucugccgcaacccuucgauguugcuuggauggacgugggccacagccauaagaucauuaugcgggagcacaaaacuaaguggguccaggaguccucuagcaaggauuuugugugcuacaaagaaggcaccgggccuuguucagagagugaagagaagacaugcaaaaccuccggaagcugccgcggugacaugcaguucuguaagguggccggcugcgaacacggggaggaggcaucugaagccaaauguagaugcucacucguccauaagccaggagagguugugguaaguuauggcgguaugagggugcggcccaaauguuacggguuuagccgcaugauggcuacuuuagaagucaacccuccagagcagcgaaucggccaaugcacaggaugucaccuggaaugcaucaauggcggggugagacuuauuaccuugacguccgagcugaagucugcaacuguuugugccucgcauuucugcagcuccgcuaccucaggaaagaaaaacacagagauacaguuccacagugguucucuagugggcaagacugucauccacgugaaaggggcccucguagacggaaccgaauuuacauucgagggcagcuguauguuucccgaugguugcgaagcgguugacugcaccuucuguagggaguuucugaagaauccgcagugcuacccugcuaaaaaguggcuuuucauuaucauagugauucuguugggguaugccggccucaugcuguuaacgaacguccugaaggcuaucggaguguggggcuccugggucaucgcccccgugaaacucauguuugcaauuaucaagaaacuuaugcggucaguuagcugucugauggggaaguugauggaucguggacgccaagugauucaugaagagauaggugagaauagagaaggcaacagggacgauguacggaucgagauggcucgaccacgcagagucaggcacuggauguacucuccugugauucuaacuauccuggccaucgggcucgcggaaggaugcgacgagaugguucaugccgauuccaaacuggugaguuguaagcagggcagcgguaauaugaaggagugcgucacaaccgggcgggugcuucugcccgcaguaaacccaggccaggaagcauguuugcacuucacugcccccggaucuccugacuccaaaugccucaagauuaaagugaagcgcauaaaucugaaauguaagaagucaaguagcuauuuuguuccagaugcuagaucgaggugcacauccguccgucggugucgaugggccggcgacugccagucugggugcccgagccauuucaccucaaacaguuuuuccgaugacugggcaggaaaaauggacagagccggcuuagguuucucuggguguagcgauggaugcggcggugcugcguguggcugcuuuaacgcagcccccuccuguaucuucuggaggaaguggguggagaauccucacgggauuaucuggaaagugucaccaugcgcugccuggguccccagcgcaguuauugaacugacgaugccuaguggagaggugcgcaccuuccacccaaugucuggcauccccacacaaguguuuaaggggguauccgucacuuaccuaggaagcgacauggaagugucgggccucaccgaucugugugagauagaggaacuuaaaucaaagaaauuggcccuggcuccgugcaaccaggccgguauggggguugugggaaaggucggcgagauccaguguucuagugaagaguccgcacggacaauuaagaaagacgguugcaucuggaaugcggaucucgugggcauugaacugagaguugacgaugcuguguguuauagcaagaucacuucuguagaggccgucgcaaacuacagcgccauaccuaccacaauugggggacuuagguucgagcgcucccaugacucacagggcaaaaucagugggagcccacuggauauuaccgcuauccgaggaucuuuuuccgugaauuaucggggcuugcgucucucacugagugaaauaacugccacgugcacaggugaggugaccaacgucagcgggugcuacuccuguaugacuggagcaaagguuucuaucaaauuacacucgagcaagaauagcaccgcucaugugagaugcaagggcgacgaaacagccuucuccguacuggagggugugcacaguuacaccgucucucuaucauuugaucacgcggugguugacgaacaaugucagcucaacugcggcgggcaugagucccaggugacucugaaaggaaaucuuauuuucuuggauguccccaaguuuguggacggcucauauaugcagacauaccacucuagcguuccuacgggggccaacauccccaguccaaccgacuggcugaaugcucucuucggaaacggccuguccagguggauuuuagguguggucgggguacugcuuggaggcuuggugcucuuuuuccugaucaugagccuauuuaaacugggcacuaagcaaguuuuccgcucucggacaaaacucgcauga

SEQ ID NO: 11514 - RNA, 3222 nt, Artificial Sequence
  derived and/or modified CDS sequence (opt3) from SFTSV(NB38/CHN/2013)__KR698341.1__GP
augaugaaggugaucugguucagcucccugauuugccucgucauacaguguggcggggacaccucucccaucauuugcgccggaccuauccacucaaacaaaagugcugauauuccacaucuucuggguuacagcgagaagaucugucaaauagacagauugauccacguuuccucuugguuaaggaaucauucgcaguuucagggcuauguggggcagcggggaggccgcucacaaguaagcuacuauccggcagaaaacaguuacucccgauggucuggucugcuaagccccugcgaugccgacuggcucgggaugcugguggucaaaaaggcgaaaggauccgauaugauugugccuggcccaucauauaagggcaagguuuucuuugagcgucccacauucgacggguacgugggaugggguuguggcagugggaaaagcagaacugaaucuggagagcuuugcuccucagauagcggcacgaguucuggucuguugccuuccgacaggguccucuggaucggggauguggcuugucagccaaugacccccauuccugaagagacauuucuggagcucaagagcuucucgcagucugaauuuccagacaucugcaaaauagauggaauuguauucaaucagugugagggcgaaucccugccgcaacccuuugacguugccuggauggaugugggccacucacauaagaucauuaugcgggagcacaaaacuaaguggguccaggagaguagcuccaaggacuucgugugcuauaaagaagggaccggaccuuguucugagagcgaagagaagacaugcaaaaccucagguaguugccgcggcgacaugcaguuuuguaagguggcagggugcgaacacgaggaggaagccuccgaggcuaaauguagaugcagcuuaguccauaagccaggagaaguugugguaucuuacggcgguaugagggugcggcccaaauguuacggguucucacgcaugauggcaacucuggaggucaaccagccugaacaacgaaucggccagugcacaggaugucaccuugagugcaucaguggcggggugagauugauuacccugacgagcgagcuaaaguccgccacuguuugugcuucucauuuuugcucgagcgccaccuccggaaagaaaucaacagaaauacaguuccacagugguucucucgugggcaagacugcgauccacgucaaaggggcacugguggauggaaccgaguucacauuugaaggcagcuguauguucccagacgguugcgaugccguagacugcaccuuuuguagggaguuccuuaagaauccccaaugcuauccggcuaaaaaguggcuguuuauuaucauaguuauuuugcucggguacgccggccugauguuacugacgaacgugcucaaggcaaucggagucuggggcuccugggugaucgcuccugucaaacuuguguucgccauuaucaagaaacugaugcgggcgguuucauguuugauggggaagcuaauggaucguggacgccaggugauucaugaagagauaggugagaauagagaaggcaaccaggacgauguaaggaucgagauggcccggccccgacgcgucagacacuggauguauagcccagugauucugacuauccucgcaaucgggcuggcugaaggaugcgacgagaugguucaugccgauucuaaacuuguguccuguaggcagggcagugguaauaugaaggagugcgucacaaccgggcgggcucuguugccugccgugaaccccggccaagaagcaugucuccacuuuacugccccaggaagccccgacucuaagugccugaaaauuaagguaaaacgcauaaauuuaaaguguaaaaaguccucaaguuacuucgugccugaugcuagaucgaggugcacaagcguucgucggugucgaugggcgggcgacugccaguccgggugcccaccgcauuuuaccucuaacagcuucucagacgauugggcaggaaagauggacagagccggccuggguuuuaguggguguuccgauggaugcggcggugcugccuguggcugcuucaaugcagcccccucuuguaucuuuuggaggaaaugggucgagaacccucacgggauuaucuggaaggugagcccaugcgcugccugggugcccuccgcagucauugaacuaacgaugccuucaggagagguucgcaccuuccacccaaugagcggcauccccacacagguguucaaaggggugaguguaacuuaucucggaucugacauggaagucuccggccugaccgaucuuugugagauggaggaauugaaaagcaagaagcuggcgcucgcuccgugcaaucaggccgguaugggggugguuggaaaagugggcgagauacaauguucgucagaagagucugcacggacaaucaagaaggacgguugcauuuggaacgccgaucuggucggcaucgaacuuagaguggacgaugcuguuuguuacaguaaaauuacuuccguggaggccguagcaaaccauagcgcuaucccuaccacaauagggggacugagguuugagcgcucucacgacagccagggcaagauuuccgggucaccauuggauaucaccgccauucgaggaaguuucagcgucaauuaucggggccuccgucugucuuuauccgaaaucacugcgacgugcacaggugaggugaccaacgugucagggugcuacaguuguaugacuggagccaaagucagcauaaagcugcauuccucuaaaaauucgaccgcucacguuagaugcaagggcgacgaaacagcauuuagcgugcuagaggguguacacucauacuccgugagucucucuuucgaucaugccgucguggacgaacagugucagcugaacugcggcgggcacgagagcaagguuacccuuaggggaaauuugaucuuucuggacgugcccaaauucgucgauggcuccuauaugcaaacuuaccauucaacagugccuacgggggcuaacauucccucuccaaccgacuggcucaaugcccuguuuggaaacggcuuaagccgcugguuccuggguguuaucggggugcuuuugggaggccucgcacuguuuuuccuaauuaugagucuguuuaagcucggcacuaaacaggucuuccgguccagaagcaagcuggcguga

SEQ ID NO: 11515 - RNA, 3222 nt, Artificial Sequence
  derived and/or modified CDS sequence (opt3) from SFTSV(NB39/CHN/2014)__KR698342.1__GP
augaugaaggugaucugguucagcucccugauuugccucgucauacaguguucuggcgacaccgggcccaucauuugcgccggaccuauccacucaaacaaaagugcugauauuccacaucuucuggguuacagcgagaagaucugucaaauagacagauugauccacguuuccucuugguuaaggaaucauucgcaguuucagggcuauguggggcggcgcggaggccgaucacagguaagcuacuauccggcagaaaacaguuacucccguuggucuggucugcuaagccccugcgaugccgacuggcucgggaugcugguggucaaaaaggcgaaaggauccgauaugauugugccuggcccaucauauaagggcaagguuuucuuugagagacccacauucgacggguacgugggaugggguuguggcagugggaaaagcaggacugaaucuggagagcuuugcuccucagauagcggcacgaguucuggucuguugccuuccgaccggguccucuggaucggggauguggcuugucaaccaaugacccccauuccugaagagacauuucuggagcuuaagagcuucucgcagucugaauuuccagacaucugcaaaauagauggaauuguauucaaucagugugaguccgaaucacucccgcagcccuuugacguugccuggauggaugugggccacagucauaagaucauuaugcgcgagcacaaaacuaaguggguccaagagagcuccucuaaggacuucgugugcuauaaagaaggcaccgggccuuguagcgagucagaagagaagacaugcaaaaccaguggauccugcagaggugacaugcaguuuuguaagguggcaggcugcgaacacggggaggaggccagcgaagcuaaauguaggugcucuuuaguccauaagccaggagagguugugguaucauacggcgguaugcgggugcgccccaaauguuacggguucagucgaaugauggcaacucuggaagucaacccuccagagcagagaaucggccagugcacaggaugucaccuugaaugcgugaauggcgggguuagguugaucacccugacgagcgagcuaaaguccgccacugugugugcuucucauuuuugcucgagcgccaccuccggaaagaaaucaacagagauucaauuccacagugguucucucgucggcaagacugcgauacacgugaaaggggcacugguagauggaaccgaauuuacauuugagggcagcuguauguuccccgacgguugcgaugccguugacugcaccuuuugucgggaguuccuuaagaacccgcagugcuauccugcuaaaaaguggcuguuuaucauuaucgugauauugcucggguacgccggccugauguuacugacgaauguccucaaggcaauuggaguguggggcuccugggucaucgcucccgugaaacuuauguucgccaucauuaagaaacugaugcguucaguuagcuguuugauggggaagcuaauggaucgcggaagacaggugauccaugaagaaauuggugagaacagggagggcaaucaagacgauguacggauagaaauggcgcgaccacgcagagucaggcacuggauguauucuccugugauccugacuauucucgccguugggcuggcagagggaugcgacgaaauggugcaugcugauuccaaacuugucaguuguaagcagggcagcgguaacaugaaggagugcgugacaaccgggcgggcccuguugcccgcuguaaauccaggccaggaggccugucuccacuuuacugcacccggaucuccugaccugaaaugcuuaaagaucaaagugaagaaaaucaaccugaaguguaagaaauccucaaguuacuucguuccagaugcccgcagcagaugcacaucggucaggcguugucggugggcuggcgacugccaguccgggugcccgucucauuuuaccagcaauucauucagugacgauugggcgggaaagauggaccgagcaggccuagguuuuuccggguguucugauggaugcggcggugccgcuuguggcugcuucaacgccgcacccagcuguauuuucuggagaaaauggguggaaaauccucacgggauaaucuggaagguguccccaugcgccgcuuggguccccucagccguuauugagcucacgaugccuagcggagaagugaggaccuuccacccaaugaguggcauccccacacaaguguucaaagggguaucugucacuuaucugggauccgacauggaggugagcggccuuaccgauuugugugaaauugaggagcugaagucgaaaaagcucgcacuggcgccgugcaaccaggcugguauggggguugugggaaaggucggcgaaauccaguguucaucugaggaaagugcccgcacaauaaagaaggacgguugcaucuggaacgcagaucuugugggcauugagcugcggguugacgaugccguguguuacuccaaaaucacuagcguagaagcugucgccaauuauucugcaauuccuaccacaaucgggggauugagauuugagaggagccaugacucccagggcaagauaucagggaguccacucgauauuaccgcuauccgcggcagcuucucugugaacuaccgaggacugcgguuaucccugucagagauuacugccacgugcacaggugaagugaccaaugucagugggugcuacagcuguaugacuggagcgaaaguuuccaucaagcuacacucuaacaaaaauucgaccgcccaugugcguugcaaaggcgacgagacagcuuuuagcguacucgaaggugugcacucauauaccgucucccugaguuucgaucacgcagugguugacgagcaaugucagcuuaacugcggcgggcaugaaucucaggugacuuugaagggaaaucugauauuucucgacguccccaaauucguggauggcagcuacaugcagacauaucacuccucaguuccuacgggggccaacauccccucuccaaccgacuggcugaaugcuuuauuuggaaacggccugagcagauggauucuuggugugaucggggucuugcucggaggccuggcccuauucuuucugauuaugagucucuucaagcugggcacuaaacaaguauuuaggucccgcacaaagcuggcauga

SEQ ID NO: 11516 - RNA, 3222 nt, Artificial Sequence
  derived and/or modified CDS sequence (opt3) from SFTSV(QD7)__KR706566.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugaggauccggcccaaauguuacggcuuuagucgcaugauggcaaccuuagaagugaaccagccugagcaacgaaucggacagugcacuggcugucaccuggaaugcauuaaugggggagucagacuuauaacauugaccagcgagcugaaguccgccacggugugugcuucucauuucugcucgagcgccacuuccgguaagaaaucaaccgagauccaguuccacaguggcucucuaguugggaagacagcgauucacgugaaaggagcacucgucgauggcacugaauuuaccuucgaggguagcuguauguuuccagacgggugcgaugccguggacugcacauucuguagggaauuucugaagaacccccaaugcuauccggcuaaaaaguggcuuuucaucauaauuguaauccuguugggcuacgccggacucaugcuguuaaccaauguucugaaggcaaucggcauuuggggguccugggugaucgcuccugucaaacucauguuugccauuauaaagaaacuuaugcggacgaugucaugucugaugggaaaguugauggaucguggucgccaggugauccaugaggaaauuggcgagaacagagaggggaaucaggacgaugucaggaucgaaauggcgcggccccgacgcgugagacacuggauguauagcccaguuauccuaacuuuccuggccauuggacucgcagagucuugcgacgaaauggugcaugcugauuccaaacuggccaguuguaggcagggcagcgguaacaugaaggagugcguaacaaccgggcgggcccuucacccugcugucaaucccggccaagaggcaugucugcauuuuacugccccaggaucucccgacuccaagugcuugaaaauaaaggugaaacgcaucaaccucaaguguaaaaagucaaguagcuacuucguuccugaugcuagaucgaggugcacauccgugcgucggugucgaugggcgggcgacugccagucugggugcccaccgcacuuuaccagcaauucauucagugacgauugggcaggaaagauggacagagccggccuggguuuuuccggguguucugauggaugcggcggugcugccuguggcugcuucaacgcagcccccagcuguauuuucuggaggaaaugggucgaaaauccucacgggaucauuuggaagguguccccaugcgcugccuggguacccucagcagugaucgaguuaacgaugccuagcggagaaguucgcaccuuucauccaaugaguggcauacccacacaggucuucaaaggggugucugugacuuaucugggauccgacauggaggucagcggccuaaccgaucucugugaaaucgaggagcugaagucgaaaaaguuggcgcuugcuccgugcaaccaggccgguauggggguugugggaaaagugggcgaaauucaauguucaucugaggaaagugcacggacaaucaagaaggacgguugcauuuggaacgccgaucugguaggcaucgagcucagagucgacgaugcuguguguuacuccaaaauaacuagcguugaagccguggcaaauuauucugcuauuccuaccacaaucgggggacugagguuugagcgcagccacgacucccagggcaagauuucagggaguccacuugauaucaccgccauacgaggcagcuucucugucaacuaccggggacugcguuugucccucucagagaucacugcgacgugcacaggugaagugaccaauguuagugggugcuacagcuguaugacuggagccaaaguguccauuaagcugcauucuucgaaaaacagcaccgcucacguaagaugcaagggcgacgagacagcauuuucagucuuagaaggugugcacuccuauaccgugagucugucuuucgaucaugccgucguugacgagcagugucagcuaaauugcggcgggcacgaaagccaagugacucucaagggaaaccugaucuuucuugacguacccaaauucguggauggcuccuacaugcagacauaucauucaacggucccuaccggggcuaauauucccucuccaacugacugguugaacgcccuguuuggaaauggccucaguagguggauccugggugugauagggguuuuacugggaggccuugcauuguucuuuaugauuaugagccucuucaagcugggcacaaaacagguguuucgcucccggaccaagcuagcguga

SEQ ID NO: 11517 - RNA, 3222 nt, Artificial Sequence
  derived and/or modified CDS sequence (opt3) from SFTSV(Rodent01/NB/CHN/2014)__KR698343.1__GP
augaugaaggugaucugguucagcucccugauuugccucgucauacaguguucuggcgacaccgggcccaucauuugcgccggaccuauccacucaaacaaaagugcugauauuccacaucuucuggguuacagcgagaagaucugucaaauagacagauugauccacguuuccucuugguuaaggaaucauucgcaguuucagggcuauguggggcggcgcggaggccgaucacagguaagcuacuauccggcagaaaacaguuacucccguuggucuggucugcuaagccccugcgaugccgacuggcucgggaugcugguggucaaaaaggcgaaaggauccgauaugauugugccuggcccaucauauaagggcaagguuuucuuugagagacccacauucgacggguacgugggaugggguuguggcagugggaaaagcaggacugaaucuggagagcuuugcuccucagauagcggcacgaguucuggucuguugccuuccgaccggguccucuggaucggggauguggcuugucaaccaaugacccccauuccugaagagacauuucuggagcuuaagagcuucucgcagucugaauuuccagacaucugcaaaauagauggaauuguauucaaucagugugaguccgaaucacucccgcagcccuuugacguugccuggauggaugugggccacagucauaagaucauuaugcgcgagcacaaaacuaaguggguccaagagagcuccucuaaggacuucgugugcuauaaagaaggcaccgggccuuguagcgagucagaagagaagacaugcaaaaccaguggauccugcagaggugacaugcaguuuuguaagguggcaggcugcgaacacggggaggaggccagcgaagcuaaauguaggugcucuuuaguccauaagccaggagagguugugguaucauacggcgguaugcgggugcgccccaaauguuacggguucagucgaaugauggcaacucuggaagucaacccuccagagcagagaaucggccagugcacaggaugucaccuugaaugcgugaauggcgggguuagguugaucacccugacgagcgagcuaaaguccgccacugugugugcuucucauuuuugcucgagcgccaccuccggaaagaaaucaacagagauucaauuccacagugguucucucgucggcaagacugcgauacacgugaaaggggcacugguagauggaaccgaauuuacauuugagggcagcuguauguuccccgacgguugcgaugccguugacugcaccuuuugucgggaguuccuuaagaacccgcagugcuauccugcuaaaaaguggcuguuuaucauuaucgugauauugcucggguacgccggccugauguuacugacgaauguccucaaggcaauuggaguguggggcuccugggucaucgcucccgugaaacuuauguucgccaucauuaagaaacugaugcguucaguuagcuguuugauggggaagcuaauggaucgcggaagacaggugauccaugaagaaauuggugagaacagggagggcaaucaagacgauguacggauagaaauggcgcgaccacgcagagucaggcacuggauguauucuccugugauccugacuauucucgccguugggcuggcagagggaugcgacgaaauggugcaugcugauuccaaacuugucaguuguaagcagggcagcgguaacaugaaggagugcgugacaaccgggcgggcccuguugcccgcuguaaauccaggccaggaggccugucuccacuuuacugcacccggaucuccugaccugaaaugcuuaaagaucaaagugaagaaaaucaaccugaaguguaagaaauccucaaguuacuucguuccagaugcccgcagcagaugcacaucggucaggcguugucggugggcuggcgacugccaguccgggugcccgucucauuuuaccagcaauucauucagugacgauugggcgggaaagauggaccgagcaggccuagguuuuuccggguguucugauggaugcggcggugccgcuuguggcugcuucaacgccgcacccagcuguauuuucuggagaaaauggguggaaaauccucacgggauaaucuggaagguguccccaugcgccgcuuggguccccucagccguuauugagcucacgaugccuagcggagaagugaggaccuuccacccaaugaguggcauccccacacaaguguucaaagggguaucugucacuuaucugggauccgacauggaggugagcggccuuaccgauuugugugaaauugaggagcugaagucgaaaaagcucgcacuggcgccgugcaaccaggcugguauggggguugugggaaaggucggcgaaauccaguguucaucugaggaaagugcccgcacaauaaagaaggacgguugcaucuggaacgcagaucuugugggcauugagcugcggguugacgaugccguguguuacuccaaaaucacuagcguagaagcugucgccaauuauucugcaauuccuaccacaaucgggggauugagauuugagaggagccaugacucccagggcaagauaucagggaguccacucgauauuaccgcuauccgcggcagcuucucugugaacuaccgaggacugcgguuaucccugucagagauuacugccacgugcacaggugaagugaccaaugucagugggugcuacagcuguaugaucggagcgaaaguuuccauaaagcuacacucuaacaaaaauucgacugcccaugugcguugcaaaggcgacgagaccgcuuuuagcguacucgaaggugugcacucauauacagucucccugaguuucgaucacgcagugguugacgagcaaugucagcuuaacugcggcgggcaugaaucucaggugaccuugaagggaaaucugaucuuucucgacguccccaaauucguggauggcagcuacaugcagacuuaucacuccucaguuccuacaggggccaacauucccucuccaacggacuggcugaaugcuuuauuuggaaacggccugagcagauggauccuuggugugauuggggucuugcucggaggccuggcccuauucuuucugaucaugagucucuucaagcugggcaccaaacaaguauuuaggucccgcacuaagcuggcauga

SEQ ID NO: 11518 - RNA, 3222 nt, Artificial Sequence
  derived and/or modified CDS sequence (opt3) from SFTSV(SDLZtick12/2010)__JQ684872.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugaggauccggcccaaauguuacggcuuuagucgcaugauggcaaccuuagaagugaaccagccugagcaacgaaucggacagugcacuggcugucaccuggaaugcauuaaugggggagucagacuuauaacauugaccagcgagcugaaguccgccacggugugugcuucucauuucugcucgagcgccacuuccgguaagaaaucaaccgagauccaguuccacaguggcucucuaguugggaagacagcgauucacgugaaaggagcacucgucgauggcacugaauuuaccuucgaggguagcuguauguuuccagacgggugcgaugccguggacugcacauucuguagggaauuucugaagaacccccaaugcuauccggcuaaaaaguggcuuuucaucauaauuguaauccuguugggcuacgccggacucaugcuguuaaccaauguucugaaggcaaucggcauuuggggguccugggugaucgcuccugucaaacucauguuugccauuauaaagaaacuuaugcggacggugucaugucugaugggaaaguugauggaucguggucgccaggucauccaugaggaaauuggcgagaacagagaggggaaucaggacgaugugaggaucgaaauggcgcggccccgacgcguuagacacuggauguauagcccagugauccuaacuuuccuggccauuggacucgcagagucuugcgacgaaaugguacaugcugauuccaaacuggucaguuguaggcagggcagcgguaacaugaaggagugcgugacaaccgggcgggcccuucugccugcuguuaaucccggccaagaggccuguuugcacuuuacugcaccaggaucucccgacuccaagugccucaaaauaaaggugaaacgcaucaaccugaaguguaaaaagucaaguagcuacuucgucccugaugccagaucgaggugcacauccgugcgucggugucgaugggcuggcgacugccagucugggugcccaccgcauuuuaccagcaauucauucagugacgauugggcgggaaagauggacagagcaggcuuagguuuuuccggguguucugauggaugcggcggugccgcuuguggcugcuucaacgccgcacccagcuguauuuucuggaggaaauggguagaaaauccucacgggaucauuuggaagguguccccaugcgccgcuuggguucccucagccgucaucgagcugacgaugccuagcggagaagugcgcaccuuucacccaaugaguggcauacccacacagguguucaaaggggucucuguuacuuaucuaggauccgacauggaggugagcggccucaccgaucugugugaaaucgaggagcuuaagucgaaaaaguuggcacuggcgccgugcaaccaggcugguaugggggugguaggaaaagucggcgaaauucaauguucaucugaggaaagugcccggacaaucaagaaggacgguugcauuuggaacgcagaucucgugggcaucgagcugagaguugacgaugccguguguuacuccaaaauaacuagcgucgaagcuguggccaauuauucugcaauuccuaccacaaucgggggacuuagguuugagcgcagccaugacucccagggcaagauuucagggaguccacuggauaucaccgcuauacgaggcagcuucucuguuaacuaccggggauugcgucucucccugucagagaucacugccacgugcacaggugaagugaccaauguaagugggugcuacagcuguaugacuggagcgaaagucuccauuaaguuacacucuucgaaaaacagcaccgcccaugugagaugcaagggcgacgagacagcuuuuucagugcuggaagguguccacuccuauaccguuagucuaucuuucgaucacgcagugguagacgagcagugucagcucaauugcggcgggcaugaaagccaagugacucugaagggaaaccuuaucuuuuuggacguccccaaauucguggauggcuccuacaugcagacauaucacucaacgguuccuaccggggccaauauucccucuccaacugacuggcugaacgcucucuuuggaaauggccugaguagguggaucuuaggugugauagggguccugcuuggaggcuuggcccucuucuuuaugauuaugagccuguucaagcuaggcacaaaacagguguuucgcucccggaccaagcuggcauga

SEQ ID NO: 11519 - RNA, 3222 nt, Artificial Sequence
  derived and/or modified CDS sequence (opt3) from SFTSV(Zhao)__KF374684.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaucugcaaaauagacggaauuguauucaaccagugugaguccgaaucacugccgcaacccuuugauguugccuggauggacgugggccacagucauaagaucauuaugcgggagcacaaaacuaaguggguccaggagagcuccucuaaggauuucgugugcuauaaagaaggcaccgggccuuguagcgagucagaagagaagacaugcaaaaccaguggauccugccgcggugacaugcaguuuuguaagguggcaggcugcgaacacggggaggaggccagcgaagcuaaauguagaugcucuuuaguccauaagccaggagagguugugguaucauacggcgguaugagggugcggcccaaauguuacggguucagucgcaugauggcaacucuggaagucaauccuccagagcagcgaaucggccaaugcacaggaugucaccuugaaugcaucaacggcggggugagauugguuacccugacgagcgagcuaaaguccgccacugugugugcuucucauuuuugcucgagcgccaccuccggaaagaaaucaacagagauucaguuccacagugguucucucgucggcaaggcggcaauacacgugaaaggggcccugguagacggaacugaguucaccuuugaaggcagcuguauguuccccgaugguugcgacgcuguugauugcacauuuuguagggaguuccuuaagaauccgcagugcuauccugccaaaaaguggcuguuuaucauuaucgugauauugcucggguacgcaggccugauguuacugaccaacguccucaaggcuauuggaguguggggcuccugggucaucgcccccgugaaacuuauguucgcgaucauuaagaaacugaugcggucaguuagcuguuugauggggaagcuaauggaccguggacgccaagugauccaugaagaaauuggugagaauagagagggcaaccaggaugacguaaggauagaaaugguccggccacgacgcgugagacacuggauguauucuccuguuauccugacgauucucgccaucgggcugacugagggaugcgaugaaauggugcaugcagacuccaaacuugucaguuguaggcagggcagcgguaauaugaaggagugcgugacaaccgggcgggcucuguugcccgccguaaacccaggccaggaggcuugucuccacuuuacugcccccggaucuccugauuccaagugccugaaaaucaaggugaaacgcauuaauuuaaaguguaaaaagucaaguagcuacuucguuccagacgcaagaucgaggugcacauccguccgucggugucgaugggccggcgauugccaaucugggugcccgagccauuuuaccucaaacaguuucuccgacgacugggcuggaaagauggauagagcgggccuggguuuuucuggguguagcgacggaugcggcggugcagccuguggcugcuucaaugcugcccccuccuguauauuuuggaggaaauggguggaaaacccucacgggaucauuuggaaggugucaccaugcgcagccuggguccccagcgcuguuaucgagcuaacgaugccuaguggagaagugcgcaccuuccacccaaugucuggcauucccacacagguguucaaagggguauccgucacuuaucucggaagcgauauggaggugucgggccugaccgaccuuugugaaaucgaggaguugaagucuaaaaagcuggcccucgcaccgugcaaccaggcggguauggggguugugggaaaagucggcgaaauacaguguucaagugaggaauccgcucggacaaucaagaaggaugguugcauuuggaaugccgaccuggugggcaucgagcuuagaguugaugacgcaguguguuacagcaaaauuacuucuguagaagccgucgcuaacuauagcgccaucccuaccacaauagggggacugagguuugagcgcucccaugauucacaaggcaaggugagugggagcccauuggacauuaccgcaauccgaggaucuuucuccgugaauuaccggggccuccgucugucauuaagugagauuacugcuacgugcacaggugaagucaccaacguuagcgggugcuacuccuguaugacuggagccaaagugucuaucaagcugcacucgagcaaaaauucaaccgcgcauguaagaugcaagggcgaugagacagccuuuuccgugcuagaagguguccacaguuauaccgugucucucagcuucgaccacgcuguuguggaugagcagugucagcugaacugcggcgggcaugaaucccaggucacucuuaagggaaauuugauauuucuggacgugcccaaauucguugacggcucauacaugcaaacauaucacucuagcgugccuacgggggcaaacauccccaguccaaccgauuggcucaaugcccuguuuggaaacggcuuauccagguggauucugggugucaucgggguacuuuugggaggccucgcucuguucuuucuaauuaugagccuguucaagcucggcacuaaacagguguuucgcucucggacaaagcuggccuga

SEQ ID NO: 11520 - RNA, 3222 nt, Artificial Sequence
  derived and/or modified CDS sequence (opt3) from SFTSV(Zhejiang/01/2011)__KJ597824.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaucugcaaaauagacggaauuguauucaaccagugugaguccgaaucacugccgcaacccuuugauguugccuggauggacgugggccacagucauaagaucauuaugcgggagcacaaaacuaaguggguccaggagagcuccucuaaggauuucgugugcuauaaagaaggcaccgggccuuguagcgagucagaagagaagacaugcaaaaccaguggauccugccgcggugacaugcaguuuuguaagguggcaggcugcgaacacggggaggaggccagcgaagcuaaauguagaugcucuuuaguccauaagccaggagagguugugguaucauacggcgguaugagggugcggcccaaauguuacggguucagucgcaugauggcaacucuggaagucaauccuccagagcagcgaaucggccaaugcacaggaugucaccuugaaugcaucaacggcggggugagauugguuacccugacgagcgagcuaaaguccgccacugugugugcuucucauuuuugcucgagcgccaccuccggaaagaaaucaacagagauucaguuccacagugguucucucgucggcaaggcggcaauacacgugaaaggggcccugguagacggaacugaguucaccuuugaaggcagcuguauguuccccgaugguugcgacgcuguugauugcacauuuuguagggaguuccuuaagaauccgcagugcuauccugccaaaaaguggcuguuuaucauuaucgugauauugcucggguacgcaggccugauguuacugaccaacguccucaaggcuauuggaguguggggcuccugggucaucgcccccgugaaacuuauguucgcgaucauuaagaaacugaugcggucaguuagcuguuugauggggaagcuaauggaccguggacgccaagugauccaugaagaaauuggugagaauagagagggcaaccaggaugacguaaggauagaaaugguccggccacgacgcgugagacacuggauguauucuccuguuauccugacgauucucgccaucgggcugacugagggaugcgaugaaauggugcaugcagacuccaaacuugucaguuguaggcagggcagcgguaauaugaaggagugcgugacaaccgggcgggcucuguugcccgccguaaacccaggccaggaggcuugucuccacuuuacugcccccggaucuccugauuccaagugccugaaaaucaaggugaaacgcauuaauuuaaaguguaaaaagucaaguagcuacuucguuccagacgcaagaucgaggugcacauccguccgucggugucgaugggccggcgauugccaaucugggugcccgagccauuuuaccucaaacaguuucuccgacgacugggcuggaaagauggauagagcgggccuggguuuuucuggguguagcgacggaugcggcggugcagccuguggcugcuucaaugcugcccccuccuguauauuuuggaggaaauggguggaaaacccucacgggaucauuuggaaggugucaccaugcgcagccuggguccccagcgcuguuaucgagcuaacgaugccuaguggagaagugcgcaccuuccacccaaugucuggcauucccacacagguguucaaagggguauccgucacuuaucucggaagcgauauggaggugucgggccugaccgaccuuugugaaaucgaggaguugaagucuaaaaagcuggcccucgcaccgugcaaccaggcggguauggggguugugggaaaagucggcgaaauacaguguucaagugaggaauccgcucggacaaucaagaaggaugguugcauuuggaaugccgaccuggugggcaucgagcuuagaguugaugacgcaguguguuacagcaaaauuacuucuguagaagccgucgcuaacuauagcgccaucccuaccacaauagggggacugagguuugagcgcucccaugauucacaaggcaagauuagugggagcccauuggacaucaccgcaauucgaggaucuuucuccgugaauuaccggggccuccgucugucauuaagugagaucacugcuacgugcacaggugaagugaccaacgucagcgggugcuacuccuguaugacuggagccaaaguuucuauaaagcugcacucgagcaaaaauucaaccgcgcaugugagaugcaagggcgaugagacagccuuuuccguacuagaaggugugcacaguuauaccgucucucucagcuucgaccacgcugugguugaugagcagugucagcugaacugcggcgggcaugaaucccaggugacucuuaagggaaauuugaucuuucuggacguccccaaauucguggacggcucauacaugcaaacauaucacucuagcguuccuacgggggcaaacauucccaguccaaccgauuggcucaaugcccuguuuggaaacggcuuauccagguggauccugggugugauugggguccuuuugggaggccucgcucuguucuuucuaaucaugagccuguucaagcucggcacuaaacagguauuucgcucucggacaaagcuggccuga

SEQ ID NO: 11521 - RNA, 3222 nt, Artificial Sequence
  derived and/or modified CDS sequence (opt3) from SFTSV(ZJ2013-06)__KP280204.1__GP
augaugaaggugaucugguucagcucccugauuugccucgucauacaguguucuggcgacaccgggcccaucauuugcgccggaccuauccacucaaacaaaagugcugauauuccacaucuucuggguuacagcgagaagaucugucaaauagacagauugauccacguuuccucuugguuaaggaaucauucgcaguuucagggcuauguggggcagcggggaggccgcucacaaguaagcuacuauccggcagaaaacaguuacucccgauggucuggucugcuaagccccugcgaugccgacuggcucgggaugcugguggucaaaaaggcgaaaggauccgauaugauugugccuggcccaucauauaagggcaagguuuucuuugagcgucccacauucgacggguacgugggaugggguuguggcagugggaaaagcagaacugaaucuggagagcuuugcuccucagauagcggcacgaguucuggucuguugccuuccgacaggguccucuggaucggggauguggcuugucagccaaugacccccauuccugaagagacauuucuggagcucaagagcuucucgcagucugaauuuccagacaucugcaaaauagauggaauuguauucaaucagugugaguccgaaucacugccgcaacccuuugacguugccuggauggaugugggccacagucauaagaucauuaugcgggagcacaaaacuaaguggguccaggagagcuccucuaaggacuucgugugcuauaaagaaggcaccgggccuuguagcgagucagaagagaagacaugcaaaaccaguggauccugccgcggugacaugcaguuuuguaagguggcaggcugcgaacacggggaggaggccagcgaagcuaaauguagaugcucuuuaguccauaagccaggagagguugugguaucauacggcgguaugagggugcggcccaaauguuacggguucagucgcaugauggcaacucuggaagucaacccuccagagcagcgaaucggccaaugcacaggaugucaccuugaaugcgugaauggcgggguuagauugaucacccugacgagcgagcuaaaguccgccacugugugugcuucucauuuuugcucgagcgccaccuccggaaagaaaucaacagagauucaguuccacagugguucucucgucggcaagacugcgauacacgugaaaggggcacugguagauggaaccgaguucacauuugaaggcagcuguauguuccccgacgguugcgaugccguugacugcaccuuuuguagggaguuccuuaagaacccgcagugcuauccugcuaaaaaguggcuguuuaucaauauugugaucuugcucggguacgccggccugauguuacugacgaacguccucaaggcaauaggaguguggggcuccugggucauugcucccgugaaacuuauguucgccaucaucaagaaacugaugcggucaguuagcuguuugauggggaagcuaauggaucguggacgccaagugauucaugaagaaaucggugagaauagagagggcaaccaggacgauguaaggauugaaauggcgcggccacgacgcgucagacacuggauguauucuccugugauacugacuauccucgccguugggcuggcagagggaugcgacgaaauggugcaugcugauuccaaacuugucaguuguaagcagggcagcgguaauaugaaggagugcgugacaaccgggagggcccuguugcccgcuguaaacccaggccaggaggccugucuccacuuuacugcacccggaucuccugacuccaaaugccugaagauuaaagugaagaaaaucaauuuaaaguguaagaaaucaaguagcuacuucguuccagaugcccggucgcgcugcacauccgucagaaggugucguugggcuggcgacugccaaucugggugcccgagccauuuuaccucaaacaguuucuccgacgauugggcgggaaagauggaccgggcaggccuggguuuuucuggguguagcgauggaugcggcggugccgcuuguggcugcuucaaugccgcacccuccuguaucuuuuggcgaaaauggguggaaaacccucacgggauuauauggaaggugucaccaugcgccgcuuggguccccagcgccguuaucgagcuaacgaugccuaguggagaagugagaaccuuccacccaaugucuggcauucccacacagguguucaaagggguauccgucacuuaucucggaagcgacauggaggugucgggccugaccgaucuuugugaaaucgaggaguugaagucuaaaaagcuggcacucgcgccgugcaaccaggcugguauggggguugugggaaaggucggcgaaauucaguguucaagugaggaauccgccaggacaaucaaaaaggacgguugcauauggaaugcagaucuggugggcaucgagcuucgcguugacgaugccguguguuacagcaaaauuacuucuguagaagcugucgccaacuauagcgcaaucccuaccacaauugggggacugcgguuugagagaucccaugacucacaaggcaagaucagugggagcccauuggauauaaccgcuauuaggggaucuuucuccgugaauuaccgcggccuccgacugucauuaagugagaucacugccacgugcacaggugaagugaccaacgucagcgggugcuacuccuguaugacuggagcgaaaguuucuauuaagcugcacucgaauaagaacagcaccgcccaugugcggugcaaaggcgacgagacagcuuuuucaguacuagaaggugugcacuccuauaccgucagucucucuuucgaucacgcagugguugacgagcagugucagcugaauugcggcgggcaugaaagccaggugacucuuaagggaaacuugaucuuucuggacguccccaaauucguggauggcuccuacaugcaaacauaucacucaucuguuccuacgggggccaauauacccagcccaaccgacuggcucaacgcucuguuuggaaauggcuuaagucguuggauccugggugugauugggguccuuuugggaggccucgcccuguucuuucuaaucaugucccuguucaagcucggcacuaaacagguauuuagaagcaggacaaagcuggcauga

SEQ ID NO: 11522 - RNA, 3222 nt, Artificial Sequence
  derived and/or modified CDS sequence (opt3) from SFTSV(ZJZHSH-AM/China/05/2012)__KR017846.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaucugcaaaauagacggaauuguauucaaccagugugaguccgaaucacugccgcaacccuuugauguugccuggauggacgugggccacagucauaagaucauuaugcgggagcacaaaacuaaguggguccaggagagcuccucuaaggauuucgugugcuauaaagaaggcaccgggccuuguagcgagucagaagagaagacaugcaaaaccaguggauccugccgcggugacauccaguuuuguaagguggcaggcugcgaacacggggaggaggccagcgaagcuaaauguagaugcucuuuaguccauaagccaggagagguugugguaucauacggcgguaugagggugcggcccaaauguuacggguucagucgcaugauggcaacucuggaagucaauccuccagagcagcgaaucggccaaugcacaggaugucaccuugaaugcauuaacggcggggugagauugauaacccugacgagcgagcuaaaguccgccacuguuugugcuucucauuuuugcucgagcgccaccuccggaaagaaaucaacagagauccaguuccacagugguucucucgugggcaaggcggcaauucacgucaaaggggcccugguggacggaacugaauuuaccuuugagggcagcuguauguuccccgaugguugcgacgcuguagauugcacauuuuguagggaguuccuuaagaauccgcagugcuauccugccaaaaaguggcuguuuaucauaauuguuaucuugcucggguacgcaggccugauguuacugaccaacgugcucaaggcuaucggagucuggggcuccugggugauugcccccgucaaacuuauguucgcgaucauuaagaaacugaugcggucagugagcuguuugauggggaagcuaauggaccguggacgccaaguuauacaugaagaaaucggugagaauagagagggcaaccaggaugacgugaggauugaaaugguacggccacgacgcgucagacacuggauguauucuccugugauccugacgauccucgccauugggcugacugagggaugcgaugaaaugguucaugcagacuccaaacuugugaguuguaggcagggcagcgguaauaugaaggagugcgucacaaccgggcgggcucuguugcccgccgugaacccaggccaggaggcuugucuccacuuuacugcccccggaucuccugauuccaagugccugaaaauaaagguaaaacgcaucaauuuaaaguguaaaaagucaaguagcuacuucgugccagacgcaagaucgaggugcacauccguucgucggugucgaugggccggcgauugccaaucugggugcccgagccauuuuaccucaaacaguuucuccgacgacugggcuggaaagauggauagagcgggccuggguuuuucuggguguagcgacggaugcggcggugcagccuguggcugcuucaaugcugcccccuccuguauuuucuggaggaaaugggucgaaaacccucacgggaucauuuggaaggugucaccaugcgcagccugggugcccagcgcugucaucgagcuaacgaugccuaguggagaaguucgcaccuuccacccaaugucuggcauacccacacagguguucaaagggguguccguaacuuaucucggaagcgauauggaggucucgggccugaccgaccuuugugaaaucgaggaguugaagucuaaaaagcuggcccucgcaccgugcaaccaggcggguaugggggugguuggaaaagugggcgaaauucaguguucaagugaggaauccgcucggacaaucaagaaggaugguugcauuuggaaugccgaccuggucggcaucgagcuuagaguggaugacgcaguuuguuacagcaaaauaacuucuguggaagccguagcuaacuauagcgccauuccuaccacaaucgggggacugagguuugagcgcucccaugauucacaaggcaagauuagugggagcccauuggacaucaccgcaauacgaggaucuuucuccgucaauuaccggggccuccgucugucauuaagugagaucacugcuacgugcacaggugaagugaccaacgugagcgggugcuacuccuguaugacuggagccaaagucucuauuaagcugcacucgagcaaaaauucaaccgcgcauguuagaugcaagggcgaugagacagccuuuuccgugcuagaagguguacacaguuauaccgugucucucagcuucgaccacgcugucguggaugagcagugucagcugaacugcggcgggcaugaaucccagguuacucuuaagggaaauuugaucuuucuggacgugcccaaauucgucgacggcucauacaugcaaacauaucacucuagcgugccuacgggggcaaacauucccaguccaaccgauuggcucaaugcccuguuuggaaacggcuuauccagguggauccuggguguuauaggggugcuuuugggaggccucgcucuguucuuucuaauuaugagccuguucaagcucggcacuaaacaggucuuucgcucucggacaaagcuggccuga

SEQ ID NO: 11523 - RNA, 3222 nt, Artificial Sequence
  derived and/or modified CDS sequence (opt3) from SFTSV(ZJZHSH-CXD/China/05/2012)__KR017858.1__GP
augaugaaggugaucugguucagcucccugauuugccucgucauacaguguggcggggacaccggacccaucauuugcgccgguccuauccacucuaacaaaucagcuggcauuccacaucuucugggguacagugagaagaucugucaaauagauagauugauccacguuagcuccugguuaaggaaucauucucaguuucagggauaugugggccagcggggugggcgcucgcaaguaucauacuauccggcagaaaacagcuacagucgaugguccggacugcuaucucccugcgacgccgauuggcucggcaugcugguggucaaaaaggcgaaaggcagcgacaugauugugccugggccauccuauaagggaaagguuuucuuugagcgucccacauucgaugguuacgugggcuggggguguggaucaggcaaaaguagaacugaaagcggugagcuuugcagcuccgacucagggacgagcaguggacuguugccuucugauaggguccucuggaucggcgacguggcuugucagccaaugacccccauuccugaagagacauuucuggagcugaaguccuucagccagucggaauuuccagauguaugcaaaaucgacggcauaguuuucaaucagugugagggggaaucucucccgcaacccuuugauguggccuggauggacgucggacacucccauaagauuaucaugcgggagcacaaaacuaagugggugcaggagucaaguagcaaggauuucgugugcuauaaagaagguaccggcccuuguuccgagucugaagagaagacaugcaaaaccagcgggucaugccgcggagacaugcaguuuuguaaggucgcaggcugcgaacacggugaggaggccagugaagcuaaauguagaugcuccuuaguucauaagccaggggaggugguagugagcuacggcggaaugaggguccggcccaaauguuacggcuucucucgcaugauggcaacucuggaagugaacccuccagagcagcgaauugggcaaugcacaggaugucaccuugaaugcaucaaugguggcguuagauugaucacccugacgucagagcuaaagagugccacugugugugcuagccauuuuugcuccucugccaccucggggaagaaaagcacagagauucaguuccacuccggaucacucgucggcaagacugcgauacacgugaaaggugcacugguagacgggaccgaguucacauuugaaggcaguuguauguuccccgauggaugcgacgccguugauugcaccuuuuguagggaguuccuuaagaacccgcagugcuauccugcuaaaaaguggcuguuuaucauuaucgugauauugcucggcuacgccgggcugauguuacugacgaauguccucaaggcaauuggagugugggguucuugggucaucgcucccgugaaacuuguuuucgccaucauuaagaaacugaugcgggcggugagcuguuugaugggcaagcuaauggaccgugggcgccaaguaauccaugaagaaauuggagagaacagagagggcaaucagaacgaugucaggauagaaauggcccggccacgacgcgugagacacuggauguauuccccuguuauccugacuauucucgcaaucgguuuugcugaggggugcgacgaaauggugcaugccgauucaaaacuggucagcuguaggcagggcucugagaauaugaaggagugcgugacaaccggacgggcccuucugcccgcuguaaacccaggccaggaagcauguuugcacuucacugcccccggguccccugacaguaagugccucaaaaucaaggugaaacgcauuaaucugaaguguaaaaagucuucuuccuacuuuguuccagaugcuagaucaaggugcacaaguguccgucggugucgaugggcgggagacugccaaagcggcugcccgccccauuucaccucgaacuccuuuucugaugacugggcagguaagauggacagagccggguuaggauucagcggcuguucagaugguugcggcggggcugccuguggaugcuuuaaugcagccccuaguuguauauucuggaggaaauggguggagaacccacacggcaucauuuggaaggugucccccugcgcugccugggucccuucugcaguuaucgaacugacgaugccaagcggggaggugcgcaccuuccaccccauguccggcauuccgacacagguguuuaaaggaguaucagucacuuaucuagguagcgacauggaagugagugggcucaccgaucugugugagaucgaggaacuuaagucuaaaaaguuggcgcuggcuccuugcaaccaggccggaaugggcguuguggguaaagucggcgagauacaguguuccagcgaagagucggcacggacaaucaagaaggacgggugcauuuggaaugccgaucucgugggaaucgaacugagaguugacgaugcuguguguuacucaaaaauuacuucuguagaggccgucgcaaacuauagugcuaucccaaccacaauaggcgggcuuagguucgagcgcucccaugacagccaaggaaagauuucuggcagcccccuggauaucaccgccauucgagguuccuuuucagugaauuaccggggguugcgucucagucugagcgaaaucacugcgacgugcacaggagaggugaccaacgucucuggcugcuacuccuguaugacuggugccaaaguuucaauaaaguuacacaguagcaaaaauuccaccgcucaugugagaugcaagggcgacgaaacagcauucucuguacuggagggggugcacucguauagcgucucacuauccuuugaucacgccgugguugacgaacagugucagcucaacugcggaggccaugagagucaggugacccugagggggaaucuuaucuucuuggaugucccuaaguuuguggacggaucuuacaugcaaacuuaucacagcacaguucccacgggcgcuaacauuccauccccuaccgacuggcugaaugcccucuucgguaacgggcugucacgcuggaucuuaggagugauuggcguccugcuuggcggguuggcacucuuuuuccugaucaugucucuauuuaaacugggaacuaagcagguauuccggagcagaacaaaacucgcguga

SEQ ID NO: 11524 - RNA, 3222 nt, Artificial Sequence
  derived and/or modified CDS sequence (opt3) from SFTSV(ZJZHSH-FDE/China/06/2012)__KR017859.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaucugcaaaauagacggaauuguauucaaccagugugaguccgaaucacugccgcaacccuuugauguugccuggauggacgugggccacagucauaagaucauuaugcgggagcacaaaacuaaguggguccaggagagcuccucuaaggauuucgugugcuauaaagaaggcaccgggccuuguagcgagucagaagagaagacaugcaaaaccaguggauccugccgcggugacaugcaguuuuguaagguggcaggcugcgaacacggggaggaggccagcgaagcuaaauguagaugcucuuuaguccauaagccaggagagguugugguaucauacggcgguaugagggugcggcccaaauguuacggguucagucgcaugauggcaacucuggaagucaauccuccagagcagcgaaucggccaaugcacaggaugucaccuugaaugcaucaacggcggggugagauugauuacccugacgagcgagcuaaaguccgccacuguuugugcuucucauuuuugcucgagcgccaccuccggaaagaaaucaacagagauacaguuccacagugguucucucgugggcaaggcggcaauccacgucaaaggggcccugguggacggaacugaguucaccuuugaaggcagcuguauguuccccgaugguugcgacgcuguagauugcacauuuuguagggaguuccuuaagaauccgcagugcuauccugccaaaaaguggcuguuuauuaucauaguuauuuugcucggguacgcaggccugauguuacugaccaacgugcucaaggcuaucggagucuggggcuccugggugaucgcccccgucaaacuuauguucgcgauuaucaagaaacugaugcggucagugagcuguuugauggggaagcuaauggaccguggacgccaaguuauucaugaagaaauaggugagaauagagagggcaaccaggaugacgugaggaucgaaaugguacggccacgacgcgucagacacuggauguauucuccugugauucugacgauccucgccaucgggcugacugagggaugcgaugaaaugguucaugcagacuccaaacuugugaguuguaggcagggcagcgguaauaugaaggagugcgucacaaccgggcgggcucuguugcccgccgugaacccaggccaggaggcuugucuccacuuuacugcccccggaucuccugauuccaagugccugaaaauuaagguaaaacgcauaaauuuaaaguguaaaaagucaaguagcuacuucgugccagacgcaagaucgaggugcacauccguucgucggugucgaugggccggcgauugccaaucugggugcccgagccauuuuaccucaaacaguuucuccgacgacugggcuggaaagauggauagagcgggccuggguuuuucuggguguagcgacggaugcggcggugcagccuguggcugcuucaaugcugcccccuccuguaucuuuuggaggaaaugggucgaaaacccucacgggauuaucuggaaggugucaccaugcgcagccugggugcccagcgcugucauugagcuaacgaugccuaguggagaaguucgcaccuuccacccaaugucuggcauccccacacagguguucaaagggguguccguaacuuaucucggaagcgauauggaggucucgggccugaccgaccuuugugaaauagaggaguugaagucuaaaaagcuggcccucgcaccgugcaaccaggcggguaugggggugguuggaaaagugggcgaaauccaguguucaagugaggaauccgcucggacaauuaagaaggaugguugcaucuggaaugccgaccuggucggcauugagcuuagaguggaugacgcaguuuguuacagcaaaaucacuucuguggaagccguagcuaacuauagcgccauaccuaccacaauugggggacugagguuugagcgcucccaugauucacaaggcaagaucagugggagcccauuggacauuaccgcaauccgaggaucuuucuccgucaauuaccggggccuccgucugucauuaagugagauaacugcuacgugcacaggugaagugaccaacgugagcgggugcuacuccuguaugacuggagccaaagucucuaucaagcugcacucgagcaaaaauucaaccgcgcauguuagaugcaagggcgaugagacagccuuuuccgugcuagaagguguacacaguuauaccgugucucucagcuucgaccacgcugucguggaugagcagugucagcugaacugcggcgggcaugaaucccagguuacucuuaagggaaauuugauuuuucuggacgugcccaaauucgucgacggcucauacaugcaaacauaucacucuagcgugccuacgggggcaaacauccccaguccaaccgauuggcucaaugcccuguuuggaaacggcuuauccagguggauucuggguguuaucggggugcuuuugggaggccucgcucuguucuuucuaauaaugagccuguucaagcucggcacuaaacaggucuuucgcucucggacaaagcuggccuga

SEQ ID NO: 11525 - RNA, 3222 nt, Artificial Sequence
  derived and/or modified CDS sequence (opt3) from SFTSV(ZJZHSH-FZHR/China/07/2013)__KR017862.1__GP
augaugaaggugaucugguucagcucccugauuugccucgucauacaguguggcggggacaccggacccaucauuugcgccgguccuauccacucuaacaaaagagcuggcauuccacaucuucugggguacucagagaagaucugucaaauagauagguugauccacguuaguagcugguuacggaaucauucccaguuucagggauaugugggccagcgcggugggcgaucucaaguaucguacuauccggcagaaaacucauacagccguuggaguggacugcuaucccccugcgacgccgauuggcucggcaugcugguggucaaaaaggcgaaaggcucugacaugauugugccugggccaagcuauaagggaaagguuuucuuugagagacccacauucgaugguuacgugggcuggggguguggauccggcaaaucaaggacugaaaguggugagcuuugcagcucugacuccgggacgucaagcggacuguugccuagugaucggguccucuggaucggcgacguggcuugucagccaaugacccccauuccugaagagacauuucuggagcugaagucuuucucccagagcgaauuuccagauguaugcaaaaucgacggcauaguuuucaaucagugugagggggaaucgcucccgcaacccuuugauguggccuggauggacgucggacacucucauaagauuaucaugcgcgagcacaaaacuaagugggugcaggaguccucaaguaaggauuucgugugcuauaaagaagguaccggcccuuguagcgaguccgaagagaagacaugcaaaaccucugggagcugcagaggagacaugcaguuuuguaaggucgcaggcugcgaacacggugaggaggccucagaagcuaaauguaggugcaguuuaguucauaagccaggggaggugguaguguccuacggcggaaugcggguccgccccaaauguuacggcuucagccgaaugauggcaacucuggaagugaacccuccagagcagagaauugggcaaugcacaggaugucaccuugaaugcaucaaugguggcguuagguugaucacccugacgucugagcuaaagucagccacugugugugcuagucauuuuugcagcuccgccaccucugggaagaaaucgacagagauucaguuccacagcggaucccucgucggcaagacugcgauacacgugaaaggugcacugguagacgggaccgaguucacauuugaaggcucauguauguuccccgauggaugcgacgccguugauugcaccuuuugucgggaguuccuuaagaacccgcagugcuauccugcuaaaaaguggcuguuuaucauuaucgugauauugcucggcuacgccgggcugauguuacugacgaauguccucaaggcaauuggagugugggguaguugggucaucgcucccgugaaacuuguuuucgccaucauuaagaaacugaugcgugcggugucuuguuugaugggcaagcuaauggaccgcgggagacaaguaauccaugaagaaauuggagagaacagggagggcaaucaggaugacguccggauagaaauggcccgaccacgcagagugaggcacuggauguauagcccuguuauccugacuauucucgcaaucggucuggcugaggggugcgaugaaauggugcaugccgacuccaaacuugucucaugucggcagggcagcggaaacaugaaggagugcgugacaaccggccgcgcucuguugcccgccguaaauccagggcaggaggcaugucuccacuuuacugcccccggaucuccugauuccaagugccugaaaaucaaggugaaaagaauuaacuuaaaguguaaaaagaguagcucuuacuucguuccagacgcuaggucccguugcacaucaguccggcgauguagaugggcgggcgauugccaaagugguugcccgccccauuuuaccagcaauucguucuccgacgacugggcagggaagauggauagggccggacugggcuuuucugguuguagcgacggcugcgggggagcugccuguggcugcuucaacgcagccccuucauguauauuuuggcgcaaauggguggaaaauccacacgggaucauuuggaaggugagucccugcgcugccugggucccuuccgcaguuaucgagcuaacgaugccaucuggagaagugcggaccuuccaccccaugagcggcauuccgacacagguguucaaagguguauccgucacuuaucucgggucagauauggaggugagcggacugaccgaccuuugugaaaucgaggaguugaagaguaaaaagcuggcgcucgcuccuugcaaccaggccggcauggguguugugggcaaagucggggaaauacaguguucuuccgaggaaagcgcaagaacaaucaagaaggauggaugcauuuggaacgccgaccuggugggcaucgagcuuaggguugaugacgcuguguguuacucgaaaauuacuucaguagaagccgucgcaaauuauucugcuaucccaaccacaauagggggacugcgcuuugagcgaagucaugauucccaaggcaagauuagcgguucucccuuggacaucaccgccauucgggggagcuucuccgugaacuaccguggacucagacugucauuaagugagaucacugcgacgugcacaggcgaagugaccaaugucagcgguugcuacucuuguaugacuggcgccaaaguuuccauaaagcugcacucaaguaaaaacagcaccgcucaugugaggugcaagggggaugagacagcauuuuccguacuagaaggagugcacucuuauucggucagccucucauucgaccacgccgugguugaugagcagugucagcugaauugcggcgggcaugaaucccaggugacccuucgcggaaacuugaucuuucuggacgucccuaaguucguggacggcaguuacaugcaaacuuaucacucuacaguucccacgggugcuaauauuccaagcccuaccgauuggcucaacgcccuguuugggaauggauuaucccgguggauccugggcgugauuggcguccuucucgggggauuggcacuguucuuucuaaucaugucacuguucaaacucgguacuaagcagguauuuagaucuaggacaaaacuggcguga

SEQ ID NO: 11526 - RNA, 3222 nt, Artificial Sequence
  derived and/or modified CDS sequence (opt3) from SFTSV(ZJZHSH-HCY/China/06/2012)__KR017855.1__GP
augaugaaggugaucugguuccccagccugauuugccucgucauacaguguuccggcgacaccgggccuaucauuugcgccggaccaauccacucuaacaaaucagcuaauauuccgcaucuucuggguuacagugagaagaucugucaaauagauagauugauccacguuagcuccugguuaaggaaccauucucaguuucagggcuauguggggcagcggggaggccgcucgcaaguaucauacuaucccgcagaaaauagcuacagucgaugguccggucugcuaucuccuugcgacgccgauuggcucgggaugcugguggucaaaaaggcgaaaggaagcgacaugauugugccaggccccuccuauaagggcaagguuuucuuugagcguccuacauucgauggguacgugggaugggguuguggcucagggaaaaguagaacugaaagcggagagcuuugcagcuccgacucaggcacgagcaguggucuguugccaucugauaggguccucuggaucggggacguggcuugucagcccaugaccccuauuccagaagagacauuucuggagcugaaguccuucagccagucggaauuuccggauaucugcaaaauagacggaauuguauucaaccagugugagucugaaucccucccccaaccuuuugauguugccuggauggacgugggccacucacauaagaucauuaugcgggagcacaaaacuaaguggguccaggagaguagcuccaaggauuucgugugcuauaaagaaggcaccgggccauguucugagagcgaagagaagacaugcaaaaccucaggaaguugccgcggugacaugcaguuuuguaagguggcaggcugcgaacacggggaggaggccuccgaagcuaaauguagaugcagcuuaguccauaagcccggagagguugugguaucuuacggcgguaugagggugcggccuaaauguuacggguucucacgcaugauggcaacucuggaagucaauccacccgagcagcgaaucggccaaugcacaggaugucaccuugaaugcaucaacggcggggugagauugguuacccugacgagugagcuaaagagcgccacugugugugcuucccauuuuugcagcucggccaccagcggaaagaaauccacagagauucaguuccacucagguagucucgucggcaaggcggcaauacacgugaaaggggcccugguagacggaacugaguucaccuuugaaggcucuuguauguucccggaugguugcgacgcuguugauugcacauuuuguagggaguuccuuaagaauccucagugcuaucccgccaaaaaguggcuguuuaucauuaucgugauauugcucggguacgcaggccugauguuacugaccaacguccucaaggcuauuggaguguggggcagcugggucaucgccccagugaaacuuauguucgcgaucauuaagaaacugaugcgguccguuucauguuugauggggaagcuaauggaccguggacgccaagugauccaugaagaaauuggugagaauagagagggcaaccaggaugacguaaggauagaaaugguccggccucgacgcgugagacacuggauguauagccccguuauccugacgauucucgccaucgggcugacugagggaugcgaugaaauggugcaugcagacucuaaacuugucuccuguaggcagggcagugguaauaugaaggagugcgugacaaccgggcgggcucuguugccagccguaaaccccggccaggaggcuugucuccacuuuacugccccuggaagcccagauucuaagugccugaaaaucaaggugaaacgcauuaauuuaaaguguaaaaaguccucaaguuacuucguuccggacgcaagaucuaggugcacaucgguccgucggugucgaugggccggcgauugccaauccgggugccccucucauuuuaccagcaacucauucagugacgacugggcuggaaagauggauagagcgggccuggguuuuuccggguguucugacggaugcggcggugcagccuguggcugcuucaaugcugccccuagcuguauauuuuggaggaaauggguggaaaacccacacgggaucauuuggaaggugucccccugcgcagccugggucccuucagcuguuaucgagcuaacgaugccaagcggagaagugcgcaccuuccaccccaugaguggcauuccgacacagguguucaaagggguaucugucacuuaucucggauccgauauggaggugagcggccugaccgaccuuugugaaaucgaggaguugaagucgaaaaagcuggcccucgcaccuugcaaccaggcggguauggggguugugggaaaagucggcgaaauacaguguucaucugaggaaagugcucggacaaucaagaaggaugguugcauuuggaaugccgaccuggugggcaucgagcuuagaguugaugacgcaguguguuacuccaaaauuacuagcguagaagccgucgcuaacuauucugccaucccaaccacaauagggggacugagguuugagcgcagccaugauucccaaggcaagauuucagggagucccuuggacaucaccgcaauucgaggaucuuucucugugaauuaccggggccuccgucuguccuuaucagagaucacugcuacgugcacaggugaagugaccaacgucagugggugcuacagcuguaugacuggagccaaaguuuccauaaagcugcacucuucgaaaaauagcaccgcgcaugugagaugcaagggcgaugagacagccuuuucaguacuagaaggugugcacuccuauaccgucagucucucuuucgaccacgcugugguugaugagcagugucagcugaacugcggcgggcaugaaagccaggugacucuuaagggaaauuugaucuuucuggacgucccuaaauucguggacggcuccuacaugcaaacauaucacucaucuguucccacgggggcaaacauuccaagcccuaccgauuggcucaaugcccuguuuggaaacggcuuaaguagguggauccugggugugauugggguccuuuugggaggccucgcucuguucuuucuauucaugucccuguuuaagcucggcacuaaacagguauuccgcagccggacaaagcuggccuga

SEQ ID NO: 11527 - RNA, 3222 nt, Artificial Sequence
  derived and/or modified CDS sequence (opt3) from SFTSV(ZJZHSH-HYC/China/05/2012)__KR017847.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcuuaagagcuucucgcagucugaauuuccagauaucugcaaaauagacggaauuguauucaaccagugugaguccgaaucacucccgcaacccuuugauguugccuggauggacgugggccacagucauaagaucauuaugcgggagcacaaaacuaaguggguccaggagagcuccucuaaggauuucgugugcuauaaagaaggcaccgggccuuguagcgagucagaagagaagacaugcaaaaccaguggauccugccgcggugacaugcaguuuuguaagguggcaggcugcgaacacggggaggaggccagcgaagcuaaauguagaugcucuuuaguccauaagccaggagagguugugguaucauacggcgguaugagggugcggcccaaauguuacggguucagucgcaugauggcaacucuggaagucaauccuccagagcagcgaaucggccaaugcacaggaugucaccuugaaugcaucaacggcggggugagauugauuacccugacgagcgagcuaaaguccgccacuguuugugcuucucauuuuugcucgagcgccaccuccggaaagaaaucaacagagauacaguuccacagugguucucucgugggcaaggcggcaauccacgucaaaggggcccugguggacggaacugaguucaccuuugaaggcagcuguauguuccccgaugguugcgacgcuguagauugcacauuuuguagggaguuccuuaagaauccgcagugcuauccugccaaaaaguggcuguuuauuaucauaguuauuuugcucggguacgcaggccugauguuacugaccaacgugcucaaggcuaucggagucuggggcuccugggugaucgcccccgucaaacuuauguucgcgauuaucaagaaacugaugcggucagugagcuguuugauggggaagcuaauggaccguggacgccaaguuauucaugaagaaauaggugagaauagaaaaggcaaccaggaugacgugaggaucgagaugguacggccacgacgcgucagacacuggauguauucuccugugauucugacgauccucgccaucgggcugacugaaggaugcgaugagaugguucaugcagacuccaagcuggugaguuguaggcagggcagcgguaauaugaaggaaugcgucacaaccgggcgggcucuguugcccgccgugaacccaggccaggaggcuugucuccacuuuacugcccccggaucuccugauuccaaaugccugaagauuaaaguaaagcgcauaaauuuaaaauguaagaagucaaguagcuacuucgugccagacgcaagaucgaggugcacauccguucgucggugucgaugggccggcgauugccaaucugggugcccgagccauuuuaccucaaacaguuucuccgacgacugggcuggaaaaauggauagagcgggccuggguuuuucuggguguagcgacggaugcggcggugcagccuguggcugcuucaaugcugcccccuccuguaucuuuuggaggaagugggucgagaacccucacgggauuaucuggaaagugucaccaugcgcagccugggugcccagcgcugucauugaacuaacgaugccuaguggagagguucgcaccuuccacccaaugucuggcauccccacacagguguucaaggggguguccguaacuuaucucggaagcgauauggaagucucgggccugaccgaccuuugugagauagaagaguugaaaucaaagaaacuggcccucgcaccgugcaaccaggcggguaugggggugguuggaaaggugggcgagauccaguguucuagugaagaguccgcucggacaauuaagaaagaugguugcaucuggaaugccgaccuggucggcauugaacuuagaguggaugacgcaguuuguuacagcaagaucacuucuguggaggccguagcuaacuauagcgccauaccuaccacaauugggggacugagguuugaacgcucccaugauucacaaggcaaaaucagugggagcccauuggacauuaccgcaauccgaggaucuuucuccgucaauuaccggggccuccgucugucauuaagugagauaacugcuacgugcacaggugaggugaccaacgugagcgggugcuacuccuguaugacuggagccaaggucucuaucaaacugcacucgagcaaaaauucaaccgcgcauguuagaugcaagggcgaugaaacagccuuuuccgugcuagaggguguacacaguuauaccgugucucucagcuucgaccacgcugucguggaugaacagugucagcugaacugcggcgggcaugagucccagguuacucuuaagggaaauuugauuuuucuggacgugcccaaguucgucgacggcucauacaugcaaacauaucacucuagcgugccuacgggggcaaacauccccaguccaaccgauuggcucaaugcccuguuuggaaacggcuuauccagguggauucuggguguuaucggggugcuuuugggaggccucgcucuguucuuucuaauaaugagccuguucaaacucggcacuaagcaggucuuucgcucucggacaaaacuggccuga

SEQ ID NO: 11528 - RNA, 3222 nt, Artificial Sequence
  derived and/or modified CDS sequence (opt3) from SFTSV(ZJZHSH-HYJ/China/07/2012)__KR017852.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaucugcaaaauagacggaauuguauucaaccagugugaguccgaaucacugccgcaacccuuugauguugccuggauggacgugggccacagucauaagaucauuaugcgggagcacaaaacuaaguggguccaggagagcuccucuaaggauuucgugugcuauaaagaaggcaccgggccuuguagcgagucagaagagaagacaugcaaaaccaguggauccugccgcggugacaugcaguuuuguaagguggcaggcugcgaacacggggaggaggccagcgaagcuaaauguagaugcucuuuaguccauaagccaggagagguugugguaucauacggcgguaugagggugcggcccaaauguuacggguucagucgcaugauggcaacucuggaagucaauccuccagagcagcgaaucggccaaugcacaggaugucaccuugaaugcaucaacggcggggugagauugauuacccugacgagcgagcuaaaguccgccacuguuugugcuucucauuuuugcucgagcgccaccuccggaaagaaaucaacagagauacaguuccacagugguucucucgugggcaaggcggcaauccacgucaaaggggcccugguggacggaacugaguucaccuuugaaggcagcuguauguuccccgaugguugcgacgcuguagauugcacauuuuguagggaguuccuuaagaauccgcagugcuauccugccaaaaaguggcuguuuauuaucauaguuauuuugcucggguacgcaggccugauguuacugaccaacgugcucaaggcuaucggagucuggggcuccugggugaucgcccccgucaaacuuauguucgcgauuaucaagaaacugaugcggucagugagcuguuugauggggaagcuaauggaccguggacgccaaguuauucaugaagaaauaggugagaauagagagggcaaccaggaugacgugaggaucgaaaugguacggccacgacgcgucagacacuggauguauucuccugugauucugacgauccucgccaucgggcugacugagggaugcgaugaaaugguucaugcagacuccaaacuugugaguuguaggcagggcagcgguaauaugaaggagugcgucacaaccgggcgggcucuguugcccgccgugaacccaggccaggaggcuugucuccacuuuacugcccccggaucuccugauuccaagugccugaaaguaaaggugaaacgcauuaauuuaaaguguaaaaagucaaguagcuacuucguuccagacgcaagaucgaggugcacauccguccgucggugucgaugggccggcgauugccaaucugggugcccgagccauuuuaccucaaacaguuucuccgacgacugggcuggaaagauggauagagcgggccuggguuuuucuggguguagcgacggaugcggcggugcagccuguggcugcuucaaugcugcccccuccuguauauuuuggaggaaauggguggaaaacccucacgggaucauuuggaaggugucaccaugcgcagccuggguccccagcgcuguuaucgagcuaacgaugccuaguggagaagugcgcaccuuccacccaaugucuggcauucccacacagguguucaaagggguauccgucacuuaucucggaagcgauauggaggugucgggccugaccgaccuuugugaaaucgaggaguugaagucuaaaaagcuggcccucgcaccgugcaaccaggcggguauggggguugugggaaaagucggcgaaauacaguguucaagugaggaauccgcucggacaaucaagaaggaugguugcauuuggaaugccgaccuggugggcaucgagcuuagaguugaugacgcaguguguuacagcaaaauuacuucuguagaagccgucgcuaacuauagcgccaucccuaccacaauagggggacugagguuugagcgcucccaugauucacaaggcaagauuagugggagcccauuggacaucaccgcaauucgaggaucuuucuccgugaauuaccggggccuccgucugucauuaagugagaucacugcuacgugcacaggugaagugaccaacgucagcgggugcuacuccuguaugacuggagccaaaguuucuauaaagcugcacucgagcaaaaauucaaccgcgcaugugagaugcaagggcgaugagacagccuuuuccguacuagaaggugugcacaguuauaccgucucucucagcuucgaccacgcugugguugaugagcagugucagcugaacugcggcgggcaugaaucccaggugacucuuaagggaaauuugaucuuucuggacguccccaaauucguggacggcucauacaugcaaacauaucacucuagcguuccuacgggggcaaacauucccaguccaaccgauuggcucaaugcccuguuuggaaacggcuuauccagguggauccugggugugauugggguccuuuugggaggccucgcucuguucuuucuaaucaugagccuguucaagcucggcacuaaacagguauuucgcucucggacaaagcuggccuga

SEQ ID NO: 11529 - RNA, 3222 nt, Artificial Sequence
  derived and/or modified CDS sequence (opt3) from SFTSV(ZJZHSH-LU/China/10/2011)__KR017850.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaugugcaaaaucgacggaauaguauucaaccagugugaguccgaaucacugccgcaacccuuugauguugccuggauggacgugggccacagucauaagauuaucaugcgggagcacaaaacuaaguggguccaggagagcuccucuaaggauuucgugugcuauaaagaaggcaccgggccuuguagcgagucagaagagaagacaugcaaaaccaguggauccugccgcggugacaugcaguuuuguaagguggcaggcugcgaacacggggaggaggccagcgaagcuaaauguagaugcucuuuaguccauaagccaggagagguugugguaucauacggcgguaugagggugcggcccaaauguuacggguucagucgcaugauggcaacucuggaagucaauccuccagagcagcgaauuggccaaugcacaggaugucaccuugaaugcaucaacggcggggugagauugguuacccugacgagcgagcuaaaguccgccacugugugugcuucucauuuuugcucgagcgccaccuccggaaagaaaucaacagagauccaguuccacagugguucucucgucggcaaggcggcaauucacgugaaaggggcccugguagacggaacugaauuuaccuuugagggcagcuguauguuccccgaugguugcgacgcuguugauugcacauuuuguagggaguuccuuaagaauccgcagugcuauccugccaaaaaguggcuguuuauaaucauugugaucuugcucggguacgcaggccugauguuacugaccaacguccucaaggcuauaggaguguggggcuccugggucauugcccccgugaaacuuauguucgcgaucaucaagaaacugaugcggucaguuagcuguuugauggggaagcuaauggaccguggacgccaagugauucaugaagaaaucggugagaauagagagggcaaccaggaugacguaaggauugaaaugguccggccacgacgcgugagacacuggauguauucuccuguuauacugacgauccucgccauugggcugacugagggaugcgaugaaauggugcaugcagacuccaaacuugucaguuguaggcagggcagcgguaauaugaaggagugcgugacaaccgggcgggcucuguugcccgccguaaacccaggccaggaggcuugucuccacuuuacugcccccggaucuccugauuccaagugccugaaaaucaaggugaaacgcaucaauuuaaaguguaaaaagucaaguagcuacuucguuccagacgcaagaucgaggugcacauccguccgucggugucgaugggccggcgauugccaaucugggugcccgagccauuuuaccucaaacaguuucuccgacgacugggcuggaaagauggauagagcgggccuggguuuuucuggguguagcgacggaugcggcggugcagccuguggcugcuucaaugcugcccccuccuguauuuucuggaggaaauggguggaaaacccucacgggauaaucuggaaggugucaccaugcgcagccuggguccccagcgcuguuauugagcuaacgaugccuaguggagaagugcgcaccuuccacccaaugucuggcauccccacacagguguucaaagggguauccgucacuuaucucggaagcgauauggaggugucgggccugaccgaccuuugugaaauugaggaguugaagucuaaaaagcuggcccucgcaccgugcaaccaggcggguauggggguugugggaaaagucggcgaaauccaguguucaagugaggaauccgcucggacaauaaagaaggaugguugcaucuggaaugccgaccuggugggcauugagcuuagaguugaugacgcaguguguuacagcaaaaucacuucuguagaagccgucgcuaacuauagcgccauuccuaccacaaucgggggacugagguuugagcgcucccaugauucacaaggcaagauaagugggagcccauuggacauuaccgcaauccgaggaucuuucuccgugaauuaccggggccuccgucugucauuaagugagauuacugcuacgugcacaggugaagugaccaacgucagcgggugcuacuccuguaugacuggagccaaaguuucuaucaagcugcacucgagcaaaaauucaaccgcgcaugugagaugcaagggcgaugagacagccuuuuccguacuagaaggugugcacaguuauaccgucucucucagcuucgaccacgcugugguugaugagcagugucagcugaacugcggcgggcaugaaucccaggugacucuuaagggaaauuugauauuucuggacguccccaaauucguggacggcucauacaugcaaacauaucacucuagcguuccuacgggggcaaacauccccaguccaaccgauuggcucaaugcccuguuuggaaacggcuuauccagguggauucugggugugaucgggguccuuuugggaggccucgcucuguucuuucuaauuaugagccuguucaagcucggcacuaaacagguauuucgcucucggacaaagcuggccuga

SEQ ID NO: 11530 - RNA, 3222 nt, Artificial Sequence
  derived and/or modified CDS sequence (opt3) from SFTSV(ZJZHSH-SHZ/China/05/2012)__KR017848.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaucugcaaaauagacggaauuguauucaaccagugugaguccgaaucacugccgcaacccuuugauguugccuggauggacgugggccacagucauaagaucauuaugcgggagcacaaaacuaaguggguccaggagagcuccucuaaggauuucgugugcuauaaagaaggcaccgggccuuguagcgagucagaagagaagacaugcaaaaccaguggauccugccgcggugacaugcaguuuuguaagguggcaggcugcgaacacggggaggaggccagcgaagcuaaauguagaugcucuuuaguccauaagccaggagagguugugguaucauacggcgguaugagggugcggcccaaauguuacggguucagucgcaugauggcaacucuggaagucaauccuccagagcagcgaaucggccaaugcacaggaugucaccuugaaugcaucaacggcggggugagauugguuacccugacgagcgagcuaaaguccgccacugugugugcuucucauuuuugcucgagcgccaccuccggaaagaaaucaacagagauucaguuccacagugguucucucgucggcaaggcggcaauacacgugaaaggggcccugguagacggaacugaguucaccuuugaaggcagcuguauguuccccgaugguugcgacgcuguugauugcacauuuuguagggaguuccuuaagaauccgcagugcuauccugccaaaaaguggcuguuuaucauuaucgugauauugcucggguacgcaggccugauguuacugaccaacguccucaaggcuauuggaguguggggcuccugggucaucgcccccgugaaacuuauguucgcgaucauuaagaaacugaugcggucaguuagcuguuugauggggaagcuaauggaccguggacgccaagugauccaugaagaaauuggugagaauagagagggcaaccaggaugacguaaggauagaaaugguccggccacgacgcgugagacacuggauguauucuccuguuauccugacgauucucgccaucgggcugacugagggaugcgaugaaauggugcaugcagacuccaaacuugucaguuguaggcagggcagcgguaauaugaaggagugcgugacaaccgggcgggcucuguugcccgccguaaacccaggccaggaggcuugucuccacuuuacugcccccggaucuccugauuccaagugccugaaaaucaaggugaaacgcauuaauuuaaaguguaaaaagucaaguagcuacuucguuccagacgcaagaucgaggugcacauccguccgucggugucgaugggccggcgauugccaaucugggugcccgagccauuuuaccucaaacaguuucuccgacgacugggcuggaaagauggauagagcgggccuggguuuuucuggguguagcgacggaugcggcggugcagccuguggcugcuucaaugcugcccccuccuguauauuuuggaggaaauggguggaaaacccucacgggaucauuuggaaggugucaccaugcgcagccuggguccccagcgcuguuaucgagcuaacgaugccuaguggagaagugcgcaccuuccacccaaugucuggcauucccacacagguguucaaagggguauccgucacuuaucucggaagcgauauggaggugucgggccugaccgaccuuugugaaaucgaggaguugaagucuaaaaagcuggcccucgcaccgugcaaccaggcggguauggggguugugggaaaagucggcgaaauacaguguucaagugaggaauccgcucggacaaucaagaaggaugguugcauuuggaaugccgaccuggugggcaucgagcuuagaguugaugacgcaguguguuacagcaaaauuacuucuguagaagccgucgcuaacuauagcgccaucccuaccacaauagggggacugagguuugagcgcucccaugauucacaaggcaagauuagugggagcccauuggacaucaccgcaauucgaggaucuuucuccgugaauuaccggggccuccgucugucauuaagugagaucacugcuacgugcacaggugaagugaccaacgucagcgggugcuacuccuguaugacuggagccaaaguuucuauaaagcugcacucgagcaaaaauucaaccgcgcaugugagaugcaagggcgaugagacagccuuuuccguacuagaaggugugcacggcuauaccgucagucucucuuucgaccacgcugugguugaugagcagugucagcugaacugcgggggacaugaaagccaggugacucuuaagggcaauuugaucuuucuggacguccccaaauucguggacggguccuacaugcaaacauaucacucaucuguuccuacgggagcaaacauucccagcccaaccgauuggcucaaugcccuguuuggcaacgguuuaaguagguggauccugggggugauuggaguccuuuugggcggccucgcucuguucuuucuaaucaugucccuguucaagcucgggacuaaacagguauuucgcagccggacaaagcuggccuga

SEQ ID NO: 11531 - RNA, 3222 nt, Artificial Sequence
  derived and/or modified CDS sequence (opt3) from SFTSV(ZJZHSH-WSH/China/08/2012)__KR017854.1__GP
augaugaaggugaucugguucagcucccugauuugccucgucauacaguguggcggggacaccggacccaucauuugcgccgguccuauccacucuaacaaaucagcuggcauuccacaucuucugggguacagugagaagaucugucaaauagauagauugauccacguuagcuccugguuaaggaaucauucucaguuucagggauaugugggccagcggggugggcgcucgcaaguaucauacuauccggcagaaaacagcuacagucgaugguccggacugcuaucucccugcgacgccgauuggcucggcaugcugguggucaaaaaggcgaaaggcagcgacaugauugugccugggccauccuauaagggaaagguuuucuuugagcgucccacauucgaugguuacgugggcuggggguguggaucaggcaaaaguagaacugaaagcggugagcuuuguucuuccgacucagggacgagcaguggacuguugccuucugauaggguccucuggaucggcgacguggcuugccagccaaugacccccauuccugaagagacauuucuggagcugaaguccuucagccagucggaauuuccagauguaugcaaaaucgacggcauaguuuucaaucagugugagggggaaucucucccgcaacccuuugauguggccuggauggacgucggacacucccauaagauuaucaugcgggagcacaaaacuaagugggugcaggagucaaguagcaaggauuucgugugcuauaaagaagguaccggcccuuguuccgagucugaagagaagacaugcaaaaccagcgggucaugccgcggagacaugcaguuuuguaaggucgcaggcugcgaacacggugaggaggccagugaagcuaaauguagaugcuccuuaguucagaagccaggggaggugguagugagcuacggcggaaugaggguccggcccaaauguuacggcuucucucgcaugauggcaacucuggaagugaacccuccagagcaacgaauugggcagugcacaggaugucaucuugaaugcaucaaugguggcguuagauugaucacccugacgucagagcuaaagagugccacugugugugcuagccacuuuugcuccucugccaccucggggaagaaaagcacagagauucaguuccauuccggaucacucgucggcaagacugcgauacacgugaaaggugcacugguagacgggaccgaauuuacauuugagggcaguuguauguuccccgauggaugcgacgccguugauugcaccuuuuguagggaguuccuuaagaacccgcaaugcuauccugcuaaaaaguggcuguuuaucauuaucgugauauugcucggcuacgccgggcugauguuacugacgaauguccucaaggcaauuggagugugggguucuugggucaucgcucccgugaaacuuauguucgccaucaugaagaaacugaugcggagcguuuccuguuugaugggcaagcuaauggaccgugggcgccaggugauucacgaagaaaucggagagaacagagagggcaaucaggaugacguaaggauugaaaugguccggccacgacgcgugagacauuggauguauucaccuguuauacugacuauccucgcgauuggucugacagaggggugcgaugaaauggugcacgccgacagcaaacuugucucuuguaggcagggcuccggaaacaugaaggagugcgugaccacuggccgggcacuguugcccgcuguaaauccagggcaagaggccugucuccauuuuacagcucccggaaguccugauagcaagugccugaaaaucaaggugaaacgcaucaacuuaaaguguaaaaagucuuccucauacuucguuccagacgccagaaguaggugcaccagcguccgucggugucgaugggcaggcgauugccagucggguugcccgccccacuuuacguccaauucuuucagcgacgacugggccgggaagauggauagagcuggacugggcuuuucagguuguagugacggcugcgggggagcggcauguggcugcuucaacgccgcuccuuccuguauuuucuggaggaaauggguggaaaauccacaugggauaaucuggaaggugucucccugcgccgcaugggucccuagcgccguuauugagcuaaccaugccauccggagaagugcgcacauuccaccccaugucaggcaucccgacucagguguucaaagguguaagcgucaccuaucucgggagugauauggaggugucuggacugacagaccuuugugaaauugaggaguugaaguccaaaaagcuggcucucgccccuugcaaccaggcaggcauggguguugugggcaaagucggggaaauccaauguagcucggaggaaucagcgcggacuauaaagaaggauggaugcaucuggaacgcugaccuggugggcauugagcuuagaguugaugacgccguguguuacucuaaaaucaccaguguagaagcagucgccaauuauuccgcuauuccaacaaccaucgggggacugagguuugagcgcagccacgauucucagggcaagauaagcgguucccccuuggacauuacugccauccgagggucauucagugugaacuaccggggacuccgucugagcuuaucugagauuacggcaacaugcaccggcgaagugacuaaugucuccgguugcuacucauguaugaccggcgcuaaaguuaguaucaagcugcauagcuccaaaaacucuacagcccacgugagaugcaagggggaugagaccgcguuuucgguacuagaaggagugcauagcuauucagucucccucaguuucgaccacgccgugguugaugagcagugucagcugaauugcggcgggcacgaaucucaagugacucuuaggggaaacuugauauuucuggacgucccuaaguucguggacggcagcuacaugcagacauaucauuccacgguucccaccggugcuaauaucccaucaccuacugauuggcucaacgcacuguuugggaauggauuaucucgcuggauucugggcgugaucggcguccuucucgggggauuggcccuguucuuucuaauuaugagccuguucaaacucgguacaaagcagguauuucggaguagaaccaaacuggcuuga

SEQ ID NO: 11532 - RNA, 3222 nt, Artificial Sequence
  derived and/or modified CDS sequence (opt3) from SFTSV(ZJZHSH-XAM/China/06/2012)__KR017853.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaucugcaaaauagacggaauuguauucaaccagugugaguccgaaucacugccgcaacccuuugauguugccuggauggacgugggccacagucauaagaucauuaugcgggagcacaaaacuaaguggguccaggagagcuccucuaaggauuucgugugcuauaaagaaggcaccgggccuuguagcgagucagaagagaagacaugcaaaaccaguggauccugccgcggugacaugcaguuuuguaagguggcaggcugcgaacacggggaggaggccagcgaagcuaaauguagaugcucuuuaguccauaagccaggagagguugugguaucauacggcgguaugagggugcggcccaaauguuacggguucagucgcaugauggcaacucuggaagucaauccuccagagcagcgaaucggccaaugcacaggaugucaccuugaaugcaucaacggcggggugagauugguuacccugacgagcgagcuaaaguccgccacugugugugcuucucauuuuugcucgagcgccaccuccggaaagaaaucaacagagauucaguuccacagugguucucucgucggcaaggcggcaauacacgugaaaggggcccugguagacggaacugaguucaccuuugaaggcagcuguauguuccccgaugguugcgacgcuguugauugcacauuuuguagggaguuccuuaagaauccgcagugcuauccugccaaaaaguggcuguuuaucauuaucgugauauugcucggguacgcaggccugauguuacugaccaacguccucaaggcuauuggaguguggggcuccugggucaucgcccccgugaaacuuguuuucgcgaucauuaagaaacugaugcgggccgugucauguuugauggggaagcuaauggaccguggacgccaaguaauccaugaagaaauuggugagaauagagagggcaaccaggaugacgucaggauagaaauggcacggccacgacgcgugagacacuggauguauagcccuguuauccugacgauucucgcuaucgggcuggccgagggaugcgaugaaauggugcaugcugacucuaaacuugucuccuguaggcagggcagugguaauaugaaggagugcgugacuacagggcgggcccuguugcccgcaguaaacccaggccaggaggccugucuccacuuuaccgcucccggaagcccugauucuaagugccugaaaaucaaggugaaacgcauuaauuuaaaguguaaaaaguccucaaguuacuucguuccagacgcgagaucgaggugcacuagcguccgucggugucgaugggcaggcgauugccaauccgggugcccgucucauuuuacaagcaacucauucagugacgacugggccggaaagauggauagagcuggccuggguuuuuccggguguucugacggaugcggcggugccgcauguggcugcuucaaugccgcucccagcuguauauuuuggaggaaauggguggaaaacccucacgggaucauuuggaagguguccccaugcgccgcauggguccccucagcgguuaucgagcuaaccaugccuagcggagaagugcgcacguuccacccaaugaguggcauucccacccagguguucaaagggguaucugucacauaucucggauccgauauggaggugagcggccugacugaccuuugugaaaucgaggaguugaagucgaaaaagcuggcucucgccccgugcaaccaggcagguauggggguugugggaaaagucggcgaaauacaguguucaucugaggaaagugcccggaccaucaagaaggaugguugcauuuggaaugcugaccuggugggcaucgagcuuagaguugaugacgccguguguuacuccaaaauuacaagcguagaagcagucgcuaacuauucugccaucccuacuaccauagggggacugagguuugagcgcagccaugauucccaaggcaagauuucagggaguccauuggacaucacagcgauucgaggcagcuucucugugaauuaccggggacuccgucuguccuuaucagagaucaccgccacuugcacgggugaagugacaaacgucagugggugcuacagcuguaugaccggagcuaaaguuuccauaaagcugcacucuucgaaaaauagcacugcacaugugagaugcaagggcgaugagaccgccuuuucaguacuagaaggugugcacuccuauacagucagucucucuuucgaccacgcugugguugaugagcagugucagcugaacugcggcgggcaugaaagccaggugacccuuaagggaaauuugaucuuucuggacguccccaaauucguggacggcuccuacaugcaaacuuaucacucaucuguuccuacaggggccaacauucccagcccaacggauuggcucaaugcacuguuuggaaacggcuuaaguagguggauccugggugugauugggguccuuuugggaggccucgcgcuguucuuucuaaucaugucccuguucaagcucggcaccaaacagguauuucgcagccggacuaagcuggccuga

SEQ ID NO: 11533 - RNA, 3222 nt, Artificial Sequence
  derived and/or modified CDS sequence (opt3) from SFTSV(ZJZHSH-YJX/China/06/2012)__KR017860.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcuuaagagcuucucgcagucugaauuuccagauaucugcaaaauagacggaauuguauucaaccagugugaguccgaaucacucccgcaacccuuugauguugccuggauggacgugggccacagucauaagaucauuaugcgggagcacaaaacuaaguggguccaggagagcuccucuaaggauuucgugugcuauaaagaaggcaccgggccuuguagcgagucagaagagaagacaugcaaaaccaguggauccugccgcggugacaugcaguuuuguaagguggcaggcugcgaacacggggaggaggccagcgacgcuaaauguagaugcucuuuaguccauaagccaggagaaguugugguaucauacggcgguaugagggugcggcccaaauguuacggguucagucgcaugauggcaacucuggaggucaauccuccagaacagcgaaucggccaaugcacaggaugucaccuugagugcaucaacggcggggugagauugauuacccugacgagcgaacuaagguccgccacuguuugugcuucucauuuuugcucgagcgccaccuccggaaagaagucaacagagauacaguuccacagugguucucucgugggcaaaacuaccauccacgucaagggggcgcugguggauggaacagaguucaccuuugaaggcagcuguauguuccccgacgguugcgaugcaguagacugcacguuuugucgggaguuccuuaaaaauccgcagugcuauccugccaagaaauggcuguuuauuaucauaguuauuuugcucggguacgcuggccugauguuacugacuaacgugcucaaggccaucggagucuggggcuccugggugaucgcacccgucaagcugauguucgcuauuaucaaaaagcugaugcguucagugagcuguuugauggggaaacuaauggaucgcggaagacaaguuauucaugaagagauaggugaaaauagggagggcaaccaggacgaugugcggaucgagauggcccgaccacgcagaguaaggcacuggauguauucuccugucauucugacaauccucgcgaucgggcuggccgaaggaugcgacgagauggugcaugcagauuccaaacuuguuaguuguaaacaggcuagcggcaauaugaaggaaugcgugaccacuggucgggcccuguugcccgcugucaacccagggcaggaggccugucuccacuuuacagcacccggcucuccugacuccaagugccugaaaauuaaggugaaacgcauaaauuuaaaguguaaaaagucaaguagcuacuucguacuggaugccagaucgaggugcaccuccgugcgucggugucgaugggcuggagacugccaaucuggcugcccaagccauuuuacgucaaacaguuucuccgacgauugggcggggaagauggacagagcaggacuaggcuuuucugguuguagcgaugggugcggaggcgccgcuugugguugcuucaaugccgcaccguccuguaucuuuuggaggaaauggguugagaacccccacggcauuaucuggaaggucucaccuugcgccgcuugggugccaagcgccgugauugaacucaccaugcccaguggggagguccgcacauuccacccuaugucuggaaucccaacucagguuuucaaaggcguguccgugaccuaucuggggagcgacauggaaguaucgggacuuacagauuugugugagauagaggaacugaagucaaagaagcucgcacuggcgcccugcaaccaggcuggcaugggugucguggggaaaguuggagagauccaguguucuagugaagaguccgcccggacuauuaagaaggacggcugcaucuggaaugcagaucuuguggguauugaacugagagucgacgaugccguguguuacagcaaaaucaccucuguugaggcuguggccaacuauagcgcaauaccgacaaccauuggcggguugagguuugaacgcucccaugacucacaaggaaagaucaguggcagcccucucgauauuacugcuauccgagggucuuucuccguaaauuaccggggacugcguuuaucacugagugaggucacggccacaugcaccggcgaggugacuaacgugagcgguugcuacuccuguaugaccggggcgaaagucucuauaaagcuacacucgagcaaaaauucaacagcccauguuagaugcaagggagacgaaaccgcuuuuuccgugcucgagggcguacacaguuauacugugucucugagcuucgaucacgcagucguggacgaacagugucagcuuaacugcgguggccaugagucccagguuacauugaaggggaaucugaucuuucucgacgugccaaaauucgucgauggaucauacaugcaaacguaucacucuagcgugcugaccggcgccaacauucccaguccuacugacugguuaaaugcucuguuugggaacggacuuuccaaguggaucuugggcguuauuggugugcuccuagggggacuggcccuguucuuucucaucaugagccuguucaaacuuggcacaaagcagauauuuaggucucgcaccaaauuggcauga

SEQ ID NO: 11534 - RNA, 3222 nt, Artificial Sequence
  derived and/or modified CDS sequence (opt3) from SFTSV(SPL003A)__AB817988.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuccuggagcucaagagcuuuucgcagucugaauuuccagauaucugcaaaauagacggaauuguauuuaaccagugugaguccgaaucacugccgcaacccuucgauguugccuggauggacgugggccacagucauaagaucauuaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucuuuaguccauaagccaggagagguugugguaucauauggcgguaugagggugcggcccaaauguuacggguuuagucgcaugauggcaacucuggaagucaauagcccugagcagcgaaucggccaaugcacaggaugucaccuugaaugcaucaacggcggggugagauugauuacccugacguccgagcuaaagucugccacuguuugugcuucgcauuucugcagcuccgccaccucaggaaagaaaaguacagagauacaguuccacucugguagccucgugggcaagacugcgauccacgucaaaggggcacugguggacggaaccgaauuuacauucgagggcuccuguauguuuccagaugguugcgacgccguagauugcaccuucuguagggaauuucuuaagaauccccagugcuacccggcuaaaaaguggcuguucauuaucauaguuauuuugcucggguaugccggccugauguuacugacgaacgugcucaaggcaaucggagucuggggcucaugggugaucgcuccugucaaacuuauguuugccauuaucaagaaacugaugcggagcgugucuuguuugauggggaagcuaauggaccguggacgccaaguuauucaugaggaaauaggugagaauagagagggcaaccaggaugacgugaggaucgaaauggcgcggccccgacgcguaagacacuggauguacuccccagucauucugacuauccucgccaucgggcuggcagagggaugcgaugaaauggugcaugcugacaguaaacuuguuagcuguaagcagggcucugguaauaugaaggagugcgugacaaccgggagggcccuguugccugcugucaaccccggccaggaggccugucuccacuucacugcaccaggaucccccgauucaaaaugccugaagauuaaagugaagcggauaaauuuaaaauguaagaagaguagcucguauuuuguaccugacgcccgcuccagaugcacaucugugaggcguugucggugggcuggcgauugccaaagcgggugcccaucacauuucaccaguaacuccuuuucugacgacugggcgggaaaaauggaucgagcaggccuggguuucagcggguguuccgacggaugcggcggugccgcuuguggcugcuuuaaugccgcaccgucauguaucuucuggagaaaguggguugaaaacccccacgggauuaucuggaaagucagcccuugcgccgcuugggugccaagugccgugauugagcuaacgaugcccucuggagaagucaggaccuuccacccuauguccggcaucccaacacagguuuuuaagggggugagcgugacuuaccucggaucggauauggagguaucaggccugaccgaccuuugugaaauagaggaguugaaaucuaagaaacuggcacucgcgcccugcaaccaggcugguaugggggucgugggaaagguuggcgaaauccaguguaguuccgaggaaagcgcccgcacaauuaagaaagaugguugcaucuggaaugcagaccuggugggcauugagcuucgggucgaugacgccguguguuauucuaagaucacuagcguugaagcuguggccaacuacuccgcaauaccgaccacaauugggggacugagauucgagaggucacaugauagucaaggcaaaaucagcgggucuccuuuggacauuaccgcuauccgcggauccuuuucaguaaauuaucgaggccuccggcugaguuuaagcgagauaacugccacgugcacaggugaagucaccaacguguccgggugcuacucuuguaugacuggagcgcgugugucgaucaagcugcacagcagcaaaaauuccaccgcccaugucagaugcaagggcgaugagacagcuuucaguguucuagaaggugugcacucuuacaccguaagccucuccuuugaccacgcaguggucgaugagcagugucagcugaacugcggcgggcaugaaucacaggugacucuuaagggaaauuugauuuuccuggacguuccaaaauuuguggacggcucuuauaugcaaacauaccacagcaguguccccacgggggccaacaucccuucccccaccgauuggcucaaugcucuguucggaaacggcuuaucaagguggauucugggugugaucgggguucuuuugggaggccucgcccuguuuuuccuaauaaugucucuguuuaagcucggcacuaaacagguguuccgcucacggacaaagcuggcauga

SEQ ID NO: 11535 - RNA, 3222 nt, Artificial Sequence
  derived and/or modified CDS sequence (opt3) from SFTSV(SPL004A)__AB817989.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcucaagagcuucucgcagucugaauuuccagauaucugcaaaauagacggaauuguauucaaccagugugaguccgaaucacugccgcaacccuuugauguugccuggauggacgugggccacagucauaagaucauuaugcgggagcacaaaacuaaguggguccaggagagcuccucuaaggauuucgugugcuauaaagaaggcaccgggccuuguagcgagucagaagagaagacaugcaaaaccaguggauccugccgcggugacaugcaguuuuguaagguggcaggcugcgaacacggggaggaggccagcgaagcuaaauguagaugcucuuuaguccauaagccaggagagguugugguaucauacggcgguaugagggugcggcccaaauguuacggguucagucgcaugauggcaacucuggaagucaauccuccagagcagcgaaucggccaaugcacaggaugucaccuugaaugcaucagcggcggggugagauugauuacccugacguccgagcuaaagucugccacuguuugugcuucgcauuuuugcagcuccgccaccucaggaaagaaaaguacagagauacaguuccacucugguagccucgugggcaaggcggcaauccacgucaaaggggcccugguggacggaacugaguucaccuuugaaggcuccuguauguuccccgaugguugcgacgcuguagauugcacauuuuguagggaguuccuuaagaacccgcagugcuauccugccaaaaaguggcuguuuauuaucauaguuauuuugcucggguacgcaggccugauguuacugaccaaugugcucaaggcuaucggagucuggggcucaugggugaucgcccccgucaaacuuauguucgcgauuaugaagaaacugaugcggagcgugucuuguuugauggggaagcuaauggaccguggacgccaaguuauccaugaagaaauuggugagaacagagagggcaaucaggaugacgugaggauagaaauggcccggccacgacgcguaagacacuggauguauuccccugucauccugacgauucucgcaaucgggcuggcugagggaugcgaugaaauggugcaugccgacaguaaacuuguuagcuguaggcagggcucugguaacaugaaggagugcgugacuacagggcgggcucuguugcccgccgucaauccaggccaggaggcaugucuccacuuuaccgcccccggauccccugauucaaagugccugaaaaucaaggugaaacgcauuaacuuaaaguguaaaaagaguagcucguacuucguaccagacgcuagauccaggugcacuucugugcgucggugucgaugggcgggcgauugccaaagcgggugcccgucacauuuuacaaguaauuccuucucugacgacugggcaggaaagauggauagagccggccuggguuuuagcggguguuccgacggaugcggcggugcugccuguggcugcuucaacgcagcccccucauguauauuuuggaggaaauggguugaaaauccucacgggaucauuuggaaggucagcccaugcgcugccugggugcccagugcagugaucgagcuaaccaugccuucuggagaaguccgcacguuccacccaauguccggcauucccacccagguuuucaaaggggugagcgugacauaucucggaucggauauggagguaucaggccugacugaccuuugugaaaucgaggaguugaagucuaaaaagcuggcgcucgcuccgugcaaccaggccgguaugggggucgugggaaaaguuggcgaaauacaguguaguuccgaggaaagcgcacggaccaucaagaaggaugguugcauuuggaacgccgaccuggugggcaucgagcuuagagucgaugacgcuguguguuacucuaaaauuacaagcguugaagccguggcaaauuauuccgcuaucccuacuaccauagggggacugagguuugagcgcucacaugauagucaaggcaagauuagcgggucuccauuggacaucacagccauucgaggauccuucucaguaaacuaccggggccuccgucugaguuuaagcgagaucaccgcgacuugcacgggugaagucacaaauguguccgggugcuacucuuguaugaccggagccaaagugucgauaaagcugcacagcagcaaaaacuccacugcucaugucagaugcaaggaggaugaaaccgcauuuaguguucuagagggcgugcacucuuauacaguaagccucuccuucgaccacgccguggucgaugaacagugucagcugaauugcgguggccaugagucacacgugacccuuaaggggaacuugaucuuucuggacguucccaaauucguggacggaucuuacaugcagacuuaucauagcagugucccuacaggcgcuaauauucccuccccaacggauuggcucaacgcccuguuugggaauggauuaucaagguggauccugggcgugauggguguucuuuugggagggcucgcacuguucuuucuaauuaugucucuguucaagcucggcaccaaacaaguguuucgcucacggacuaagcuggcguga

SEQ ID NO: 11536 - RNA, 3222 nt, Artificial Sequence
  derived and/or modified CDS sequence (opt3) from SFTSV(SPL005A)__AB817990.1__GP
augaugaaggugaucugguucagcucccugauuugccucgucauacaguguucuggcgacgccucacccaucauuugcgcugggccuauccacaguaacaaaagcgcaaauauuccacaucuucugggauacuccgagaagaucugucaaauagauagauugauccacguuucuucgugguuaaggaaccauucacaguuucaggguuaugugggccagcgcgggggacggagccaaguaaguuacuucccggccgaaaauuccuauucucgauggagcggccugcuaucccccugcgacgcggauuggcucgguaugcugguggucaaaaaggcuaaagggucagacaugauugugccuggaccaaguuacaagggcaagguuuucuucgagcgucccaccuuugauggcuaugugggguggggaugugguagcggcaaaucuagaacagaauccggggagcuuugcucaagcgacaguggaacuucuuccggccuguugccuagcgauaggguccucuggaucggugacguggccugucagccaaugacgcccauuccugaagagaccuuccuggagcugaagucguuuucucaguccgaauuuccagauaucugcaaaauagacgggauuguauuuaaccagugugagucagaaagucucccgcaacccuuagauguugcauggauggacgugggacacagccauaagaucauuaugcgggagcacaaaacaaaguggguccaggaguccucuagcaaggauuucgugugcuacaaagaaggcacuggcccuuguucagagagugaagagaagaccugcaaaacauccgggagcugccgcggagacaugcaguuuuguaagguggccgguugcgaacacggcgaggaggcuucugaagcaaaauguagaugcucacugguccauaagccaggggagguugugguaaguuauggaggcaugagggugcggcccaaauguuacgguuucagccgcaugauggccacccuugaagucaauccuuuggagcagcgaaucgggcaaugcacuggcugucaccuggaaugcaucaacggaggcgugagacuaauuacacucaccuccgagcugaagucugcuacgguuugugccucgcauuuuugcagcuccgcgacuucagggaagaaaaguaccgagauacaguuccacucuggaagccuuguggguaagacagcaauccacgucaaaggcgcccugguggacgggacugaguucaccuuugaaggauccuguauguucccagauggcugcgacgcuguagauugcacauuuuguagggaguucuugaagaauccccagugcuacccggccaaaaaguggcucuuuauuaucauaguuauucuguuagguuaugcagggcugaugcuccuuaccaacgugcugaaggcuaucggcgucuggggaucaugggugaucgccccugucaaauugauguucgcgauuaucaagaaacuaaugcggagcgugucuugucugaugggcaagcucauggaccgugggcgccaaguuauucaugaagaaauaggagagaauagagaggguaaccaggaugacgugaggaucgaaauggcccggccccgacgcguaagacacuggauguacuccccagucauucugacgauccuugcaaucggccuggcugaggggugcgaugaaauggugcaugccgacaguaaauugguuagcuguaagcagggaggcgguaauaugaaggagugcgugacuacagggagggcucuccugccugccgucaaccccggccaggaggcauguuuacacuuuaccgccccaggaucucccgauuccaaaugccugaagauuaaagugaagcggauaaaucuaaaauguaagaagucaaguagcuauuucguaccugacgcucgcucgagaugcacuuccgugaggcguugucggugggcgggcgauugccaaucugggugcccaagccauuuuacaucaaacaguuucuccgacgacugggcaggaaaaauggaucgagccggccucgguuuuucuggguguagcgacggaugcggcggugcugccuguggcugcuucaaugcagccccguccuguaucuuuuggagaaaguggguugaaaacccccacgggauuaucuggaaagucucaccuugcgcugccugggugccaagcgcagugauugagcugaccaugcccaguggagaagucaggacguuccacccuaugucuggcaucccaacccagguuuucaaggggguguccgugacauaccuuggaagcgauauggagguaucgggcuugacugaccugugugaaauagaggagcucaaaucaaagaaacuggcgcuugcucccugcaaccaggccgguaugggggucgugggaaagguuggcgaaauccaguguucuagugaggaauccgcacgcaccauuaagaaagaugguugcaucuggaaugccgaccuggugggcauugaguugcgggucgaugacgcuguguguuauagcaagaucacaucuguugaagccguggcaaacuacagcgcuauaccgacuaccauugggggacucagauuugagaggucccaugauucacaaggcaaaaucagugggagcccucuggacauuacagccauccgcggaucuuucuccguaaauuaucgaggcuuacggcugucacuaagugagauaaccgcgacuugcacgggugaagucacaaacgugagcgggugcuacuccuguaugaccggagccaaggugucuaucaaacuccacucgagcaaaaauucaacugcucauguccguugcaagggcgaugagaccgcauuuuccguucuggaaggugugcacaguuacacaguaucucuuagcuucgaccacgccguggucgaugagcagugucaguugaacugcggcgggcaugaaucccaggugacccugaagggaaaucucauuuuucuggacguuccaaaguucguggacggcucauauaugcaaacuuaccacucuagcguccccacaggggcuaacaucccuagucccacggauugguuaaaugcccuguuuggaaacggccuuuccagauggauuuugggugugaucgggguucuccugggaggccuagcacuguucuuucucauaaugagccuguucaaacuuggcaccaaacagguguuuaggucucgcacuaaguuggcguga

SEQ ID NO: 11537 - RNA, 3222 nt, Artificial Sequence
  derived and/or modified CDS sequence (opt3) from SFTSV(SPL010A)__AB817991.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuccuggagcucaagagcuuuucgcagucugaauuuccagauaucugcaaaauagacggaauuguauuuaaccagugugaguccgaaucacugccgcaacccuucgauguugccuggauggacgugggccacagucauaagaucauuaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucuuuaguccauaagccaggagagguugugguaucauauggcgguaugagggugcggcccaaauguuacggguuuagucgcaugauggcaacucuggaagucaauagcccugagcagcgaaucggccaaugcacaggaugucaccuugaaugcaucaacggcggggugagauugauuacccugacguccgagcuaaagucugccacuguuugugcuucgcauuucugcagcuccgccaccucaggaaagaaaaguacagagauacaguuccacucugguagccucgugggcaagacugcgauccacgucaaaggggcacugguggacggaaccgaauuuacauucgagggcuccuguauguuuccagaugguugcgacgccguagauugcaccuucuguagggaauuucuuaagaauccccagugcuacccggcuaaaaaguggcuguucauuaucauaguuauuuugcucggguaugccggccugauguuacugacgaacgugcucaaggcaaucggagucuggggcucaugggugaucgcuccugucaaacuuauguuugccauuaucaagaaacugaugcggagcgugucuuguuugauggggaagcuaauggaccguggacgccaaguuauucaugaggaaauaggugagaauagagagggcaaccaggaugacgugaggaucgaaauggcgcggccccgacgcguaagacacuggauguacuccccagucauucugacuauccucgccaucgggcuggcagagggaugcgaugaaauggugcaugcugacaguaaacuuguuagcuguaagcagggcucugguaauaugaaggagugcgugacaaccgggagggcccuguugccugcugucaaccccggccaggaggccugucuccacuucacugcaccaggaucccccgauucaaaaugccugaagauuaaagugaagcggauaaauuuaaaauguaagaagaguagcucguauuuuguaccugacgcccgcuccagaugcacaucugugaggcguugucggugggcuggcgauugccaaagcgggugcccaucacauuucaccaguaacuccuuuucugacgacugggcgggaaaaauggaucgagcaggccuggguuucagcggguguuccgacggaugcggcggugccgcuuguggcugcuuuaaugccgcaccgucauguaucuucuggagaaaguggguugaaaacccccacgggauuaucuggaaagucagcccuugcgccgcuugggugccaagugccgugauugagcuaacgaugcccucuggagaagucaggaccuuccacccuauguccggcaucccaacacagguuuuuaagggggugagcgugacuuaccucggaucggauauggagguaucaggccugaccgaccuuugugaaauagaggaguugaaaucuaagaaacuggcacucgcgcccugcaaccaggcugguaugggggucgugggaaagguuggcgaaauccaguguaguuccgaggaaagcgcccgcacaauuaagaaagaugguugcaucuggaaugcagaccuggugggcauugagcuucgggucgaugacgccguguguuauucuaagaucacuagcguugaagcuguggccaacuacuccgcaauaccgaccacaauugggggacugagauucgagaggucacaugauagucaaggcaaaaucagcgggucuccuuuggacauuaccacuauccgcggauccuuuucaguaaauuaucgaggccuccggcugaguuuaagcgagauaacggcuacaugcaccggugaagucacuaacguguccgggugcuacucuuguaugaccggagcccgugugucgaucaagcugcacagcagcaaaaauuccacagcgcaugucagaugcaagggcgaugagaccgccuucaguguucuagaaggugugcacucuuacacuguaagccucuccuuugaccacgcuguggucgaugagcagugucagcugaacugcggcgggcaugaaucacaggugacacuuaagggaaauuugauuuuccuggacguuccaaaauuuguggacggcucuuauaugcaaacguaccacagcaguguccccaccggggcaaacaucccuucccccacugauuggcucaaugcccuguucggaaacggcuuaucaagguggauucugggugugaucgggguucuuuugggaggccucgcucuguuuuuccuaauaaugucucuguuuaagcucggcacaaaacagguguuccgcucacggaccaagcuggccuga

SEQ ID NO: 11538 - RNA, 3222 nt, Artificial Sequence
  derived and/or modified CDS sequence (opt3) from SFTSV(SPL030A)__AB817992.1__GP
augaugaaggugaucugguucagcucccugauuugccucgucauacaguguucuggcgacaccucacccaucauuugcgccgggccuauccacaguaacaaaagcgcuuccauuccacaucuucugggauacucugagaagaucugucaaauagauagauugauccacguuucgucaugguuaaggaaucauagccaguuucaggguuaugugggccagcgcgggggacggagucaaguauccuacuucccggcagaaaacucuuauagccgaugguccggccugcuaucacccugcgacgccgauuggcucgguaugcugguggucaaaaaggcgaaagggagugacaugauugugccuggaccaagcuacaagggcaagguuuucuucgagcgucccacauuugauggcuaugugggguggggaugugguucuggcaaauccagaacugaaucaggggagcuuugcagcagugacucuggaacguccagcggccuguugccuucggauaggguccucuggaucggugacguggcuugucagccaaugacccccauuccugaagagacauuccuggagcugaagucuuuuucccagucagaauuuccagauaucugcaaaauagacgggauuguauuuaaucagugugagagugaaagccucccgcaacccuuagauguugccuggauggacgugggacacucccauaagaucauuaugcgggagcacaaaacuaaguggguccaggagucuagcucaaaggauuucgugugcuacaaagaaggcaccggcccuuguagugaguccgaagagaagacaugcaaaaccagcgggucuugccgcggagacaugcaguuuuguaagguggcagguugcgaacacggcgaggaggccucagaagcuaaauguagaugcagucugguccauaagccaggggagguugugguaagcuauggaggcaugagggugcggcccaaauguuacgguuucucccgcaugauggcaacucuugaagucaacccuccagaguugcgaaucgggcagugcacaggcugucaccuggaaugcaucaauggaggcgugagacuaauuacccucacgucugagcugaagucggccacuguuugugcuagccauuuuugcuccucagccaccagugggaagaaaucuacagagauacaauuccacagcggaucccuuguggguaagacugcgauccacgucaaaggcgcacugguggacgggaccgaguucacauuugaaggaucauguauguuccccgauggcugcgacgccguagauugcaccuuuuguagggaguucuugaagaacccgcagugcuacccugcuaaaaaguggcucuuuauuaucauaguuauucuguuagguuaugccgggcugaugcuccuuacgaaugugcugaaggcaaucggcgucuggggaagcugggugaucgcucccgucaaauugauguucgccauuaucaagaaacuaaugcggucuguguccugucugaugggcaagcucauggaccgugggcgccagguuauucaugaagaaauaggagagaacagagaggguaaucaagaugacgugaggaucgaaauggcgcggccacgacgcguaagacacuggauguacaguccugucauucugacuauccuugccaucggccuggcagaggggugcgaugaaauggugcaugcugacagcaaauugguuucuuguaagcagggaggcgguaacaugaaggagugcgugacaaccgggagggcccuccugcccgcugucaauccaggccaggaggccuguuuacacuuuacugcacccggauccccugauucaaaaugccugaagauucgggugaaacgcauaaaccuaaaguguaaaaagaguagcucguauuucguaccagacgccagauccaggugcacaucugugcgucggugucgaugggcuggcgauugccagagcgggugcccgucacauuuuaccaguaauuccuucucugacgacugggcgggaaagauggauagagcaggccucgguuuuagcggguguuccgacggaugcggcggugccgcuuguggcugcuucaacgccgcacccucauguaucuuuuggaggaaauggguugaaaauccucacgggauuaucuggaaggucagcccaugcgccgcuugggugcccagugccgugauugagcugacgaugccuucuggagaaguccgcaccuuccacccaauguccggcauccccacacaaguuuucaaaggggugagcgugacuuaccuuggaucggauauggagguaucaggcuugaccgaccugugugaaauagaggagcucaagucuaaaaagcuggcacuugcgccgugcaaccaggcugguaugggggucgugggaaaaguuggcgaaauccaguguaacagugaggaauccgcccggacaauuaagaaggaugguugcaucuggaaugcagaccuggugggcauugaguugagagucgaugacgccguguguuauagcaaaaucacuucuguugaagcuguggccaacuacagcgcaauaccuaccacaauugggggacucagguuugagcgcucccaugauucacagggcaagaucagugggagcccacuggacauuaccgcuauccgaggaucuuucuccguaaauuaucggggcuuacgucugucacuaagugagauaacugccacgugcacaggugaagucaccaacgugagcgggugcuacuccuguaugacuggagcgaaagugucuaucaagcuccacucgagcaaaaauucaaccgcccaugucagaugcaagggcgaugagacagcuuuuuccguucuggaaggugugcacaguuacaccguaucucuuagcuucgaccacgcaguggucgaugagcaaugucaguugaacugcggcgggcaugaaucccaggugacucugaagggaaaucucauuuuucuggacguucccaaauucguggacggcucauauaugcagacauaccacucuagcgucccuacgggggccaacauccccaguccaaccgauugguuaaaugcucuguuuggaaacggccuuuccagguggauuuugggugugaucgggguucuccugggaggccuagcccuguucuuucucauaaugagccuguucaaacuuggcacuaagcaaguguuucgcucucggacaaaguuggcauga

SEQ ID NO: 11539 - RNA, 3222 nt, Artificial Sequence
  derived and/or modified CDS sequence (opt3) from SFTSV(SPL053A)__AB985292.1__GP
augaugaaggugaucugguucagcucccugauuugccucgucauacaguguucuggcgacaccgggcccaucauuugcgccggaccuauccacucaaacaaaggugcuaauauuccacaucuucugggcuacagugagaagaucugucaaauagauagauugauccacguuagcuccugguuaaggaaccauucucaguuucagggguaugugggacagcggggcggucgcucgcaaguaucauacuucccggcagaaaauagcuauagucgaugguccgggcugcuaucucccugcgacgccgauuggcucggaaugcugguggucaaaaaggcgaaaggcagcgacaugauugugccuggcccauccuacaaggggaagguuuucuucgagcgucccacauuugauggauauguggguuggggcugugggucaggaaaaaguagaacugaaagcggcgagcuuugcaucucugacuccgguacgucaagcgggcuguugccuagugauaggguccucuggauuggagacguggcuugucagccaaugacccccaucccugaagagacauuccuggagcugaagucuuuuucccagagcgaauuuccagauauaugcaaaauugacggcaucguauuuaaccagugugagucggaaucucucccgcaacccuucgauguugccuggauggacgugggccacucccauaagauuaucaugcgggagcacaaaacuaaguggguccaggagucaaguagcaaggauuuugugugcuacaaagaagggaccggaccuuguuccgagucugaagagaagacaugcaaaaccagcgguucaugccgcggcgacaugcaguucuguaagguggcagggugcgaacacggagaggaggccagugaagcuaaauguagaugcuccuuaguccauaagccaggcgagguugugguaagcuauggugggaugagggugcggcccaaauguuacggcuuuucucgcaugauggcaacucuggaagucaauucaccugagcagcgaaucggacaaugcacaggcugucaccuugaaugcauuaacgggggagugagauugauaacccugacgagugagcuaaagagcgccacuguuugugcuucccauuucuguucuucggccaccagcgguaagaaauccacagagauccaguuccacucaggcagucucguggggaagacugcgauucacgucaaaggagcacugguggacggcaccgaauuuacauucgaggguucuugcauguuuccagaugggugcgacgccguagauugcaccuucuguagggaauuucuuaagaauccccagugcuacccggcuaaaaaguggcuguucaucauaauuguuaucuugcucggcuaugccggacugauguuacugacgaacgugcucaaggcaaucggcgucugggggagcugggugauugcuccugucaaacuuauguuugccaucauuaagaaacugaugcgguccgugucauguuugaugggaaagcuaauggaccguggucgccaaguuauacaugaggaaaucggcgagaauagagaggggaaccaggaugacgugaggauugaaauggcgcggccccgacgcguaagacacuggauguacagcccagucauccugacuauccucgccauuggacuggcagagggcugcgaugaaauggugcaugcugacucuaaacuuguuuccuguaagcaggguagugggaauaugaaggagugcgugacaaccggcagggcccuguugccugcugucaaccccggacaggaggccugucuccacuucacugcaccaggcagccccgauucuaaaugccugaagauaaaagugaagcggaucaauuuaaaauguaagaaguccucaaguuauuuuguaccugacgcccgcagcagaugcacaucggugaggcguugucggugggcuggggauugccaauccggaugcccaucucauuucaccagcaacucauuuagugacgacugggcgggcaaaauggaucgagcaggucugggguucuccggauguucugacggcugcgguggcgccgcuugugggugcuuuaaugccgcaccgagcuguauuuucuggagaaaguggguugaaaacccccacggaaucauuuggaaagucuccccuugcgccgcuugggugccaucagccgugaucgagcuaacgaugcccagcggcgaagucaggaccuuccacccuaugagugggauaccaacacagguuuuuaagggagugucugugacuuaccucggcuccgauauggagguaagcggucugaccgaccuuugugaaaucgaggaguugaaaucgaagaaacuggcacucgcgcccugcaaccaggcugggaugggagucgugggcaagguuggugaaauucaguguucaucugaggaaagugcccgcacaaucaagaaagauggcugcauuuggaaugcagaccugguggggaucgagcuucgggucgaugacgccguguguuauuccaagauaacuagcguugaagcuguggccaacuacucugcaauuccgaccacaaucggaggccugagauucgagaggagccaugauucccaagggaaaauuucaggaaguccuuuggacaucaccgcuauacgcggcagcuuuucuguaaauuaucgaggucuccggcuguccuuaucagagaucacugccacgugcacaggggaagucaccaacgugaguggaugcuacagcuguaugacuggcgcgcguguguccauuaagcugcacucuucgaaaaauagcaccgcccaugucagaugcaagggugaugagacagcuuucucaguucuagaaggcgugcacuccuacaccguaagucucucuuuugaccacgcaguggucgaugagcagugucagcugaacugcgggggacaugaaagccaggugacucuuaagggcaauuugaucuuccuggacguuccaaaauuuguggacggguccuauaugcaaacauaccacucaucuguccccacgggagccaacauuccuagccccaccgauuggcucaaugcucuguucggcaacgguuuaaguagguggauccugggggugauaggaguucuuuugggcggccucgcccuguuuuuccuaauuaugucccuguuuaagcucgggacuaaacagguguuccgcagccggacaaagcuggcauga

SEQ ID NO: 11540 - RNA, 3222 nt, Artificial Sequence
  derived and/or modified CDS sequence (opt3) from SFTSV(SPL054A)__AB985293.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauucauggagcuaaagagcuuuucgcagucugaauuuccagauaucugcaaaauagacggaauuguauuuaaccagugugaguccgaaucacugccgcaacccuucgauguugccuggauggacgugggccacagucauaagaucauuaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucucucguccauaagccaggagagguugugguaucauauggcgguaugagggugcggcccaaauguuacggguuuagucgcaugauggcaacuuuagaagucaauccuccagagcagcgaaucggccaaugcacaggaugucaccuggaaugcaucaacggcggggugagacuuauuaccuugacgagcgagcugaaguccgccacuguuugugcuucucauuucugcucgagcgccaccuccggaaagaaaucaacagagauacaguuccacagugguucucuagugggcaagacugcgauccacgucaaaggggcacucguggacggaaccgaauuuacauucgagggcagcuguauguuucccgaugguugcgacgccguagauugcaccuucuguagggaauuucugaagaauccgcagugcuacccugcuaaaaaguggcuuuucauuaucauaguuauucuguugggguaugccggccucaugcuguuaacgaacgugcugaaggcaaucggagucuggggcuccugggugaucgcucccgucaaacucauguuugccauuaucaagaaacuuaugcggucagugagcugucugauggggaaguugauggaccguggacgccaaguuauucaugaggaaauaggugagaauggcgaggggaaccaggaugacgugagaaucgaaauugcgaggccacggcgaguacgccacuggauguacucuccugucauccuaacuauccuggccauuggacucgcagagggcugcgaugaaauggugcaugcugacuccaaacugguuaguuguaagcaggguagcgggaauaugaaggagugcgugacaaccggcagagcccuucugcccgcugucaacccaggacaggaggccuguuugcacuucacugcacccggcucuccugauuccaaaugccucaagauaaaagugaagaggaucaaucugaaauguaagaagucaaguagcuauuuuguaccagacgcccggucgcgcugcacauccgugagaaggugucguugggcuggggauugccaaucuggaugcccgagccauuucaccucaaacaguuuuuccgacgacugggcgggcaaaauggaucgggcagguuuaggguucucuggauguagcgacggcugcgguggcgccgcuugugggugcuuuaaugccgcacccuccuguauuuucuggcgaaaguggguugaaaacccucacggaaucauuuggaaagucucaccaugcgccgcuugggugcccagcgccgugaucgagcugacgaugccuaguggcgaagucagaaccuuccacccaaugucugggauacccacacagguuuuuaagggaguguccgugacuuaccuaggcagcgauauggagguaucgggucucaccgaccugugugaaaucgaggagcuuaaaucaaagaaauuggcacuggcgccgugcaaccaggcugggaugggagucgugggcaagguuggugaaauucaguguucuagugaggaauccgccaggacaaucaagaaagauggcugcauuuggaaugcagaccucguggggaucgagcugcgcgucgaugacgccguguguuauagcaagauaacuucuguugaagcuguggccaacuacagcgcaauuccuaccacaaucggaggccuucgguucgagagaucccaugauucacaagggaaaauuaguggaagcccacuggacaucaccgcuauaaggggcucuuuuuccguaaauuaucgcgguuugcgacucucacugagugagaucacugccacgugcacaggggaagucaccaacgugagcggaugcuacuccuguaugacuggcgcgaaggugucuauuaaauuacacucgagcaaaaauucaaccgcccauguccggugcaagggugaugagacagcuuucuccguucuggaaggcgugcacaguuacaccguaucucugagcuuugaccacgcaguggucgaugagcagugucagcucaacugcgggggacaugaaucccaggugacucugaagggcaaucuuaucuucuuggacguuccccguuuuguggacgggucauauaugcaaacauaccacucuagcgucccuacgggagccaacauucccaguccaaccgauuggcugaaugcucucuucggcaacggucuguccagauggaucuuaggggugauaggaguucugcuuggcggcuuggcccucuuuuuccugauuaugagccuauuuaagcuggggacuaaacagguguucaggucucgcacaaagcucgcauga

SEQ ID NO: 11541 - RNA, 3222 nt, Artificial Sequence
  derived and/or modified CDS sequence (opt3) from SFTSV(SPL055A)__AB985294.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuccuggagcucaagagcuuuucgcagucugaauuuccagauaucugcaaaauagacggaauuguauuuaaccagugugaguccgaaucacugccgcaacccuucgauguugccuggauggacgugggccacagucauaagaucauuaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucuuuaguccauaagccaggagagguugugguaucauauggcgguaugagggugcggcccaaauguuacggguuuagucgcaugauggcaacucuggaagucaauagcccugagcagcgaaucggccaaugcacaggaugucaccuugaaugcaucaacggcggggugagauugauuacccugacguccgagcuaaagucugccacuguuugugcuucgcauuucugcagcuccgccaccucaggaaagaaaaguacagagauacaguuccacucugguagccucgugggcaagacugcgauccacgucaaaggggcacugguggacggaaccgaauuuacauucgagggcuccuguauguuuccagaugguugcgacgccguagauugcaccuucuguagggaauuucuuaagaauccccagugcuacccggcuaaaaaguggcuguucauuaucauaguuauuuugcucggguaugccggccugauguuacugacgaacgugcucaaggcaaucggagucuggggcucaugggugaucgcuccugucaaacuuauguuugccauuaucaagaaacugaugcggagcgugucuuguuugauggggaagcuaauggaccguggacgccaaguuauucaugaggaaauaggugagaauagagagggcaaccaggaugacgugaggaucgaaguagcgcggccccgacgcgucagacacuggauguacuccccagugauucugacuauccucgccaucgggcuggcagagggaugcgaugaaaugguucaugcugacaguaaacuugugagcuguaagcagggcucugguaauaugaaggagugcgucacaaccgggagggcccuguugccugcugugaaccccggccaggaggccugucuccacuucacugcaccaggaucccccgauucaaaaugccugaagauuaaaguaaagcggauaaauuuaaaauguaagaagaguagcucguauuuugugccugacgcccgcuccagaugcacaucuguuaggcguugucggugggcuggcgauugccaaagcgggugcccaucacauuucaccaguaacuccuuuucugacgacugggcgggaaaaauggaucgagcaggccuggguuucagcggguguuccgacggaugcggcggugccgcuuguggcugcuuuaaugccgcaccgucauguaucuucuggagaaagugggucgaaaacccccacgggauuaucuggaaagugagcccuugcgccgcuugggugccaagugccgucauugagcuaacgaugcccucuggagaaguuaggaccuuccacccuauguccggcaucccaacacagguguuuaagggggugagcguaacuuaccucggaucggauauggaggucucaggccugaccgaccuuugugaaauagaggaguugaaaucuaagaaacuggcacucgcgcccugcaaccaggcugguaugggggugguuggaaaggugggcgaaauccaguguaguuccgaggaaagcgcccgcacaauuaagaaagaugguugcaucuggaaugcagaccuggucggcauugagcuucggguggaugacgccguuuguuauucuaagaucacuagcguggaagcuguagccaacuacuccgcaauaccgaccacaauugggggacugagauucgagaggucacaugauagucaaggcaaaaucagcgggucuccuuuggacauuaccgcuauccgcggauccuuuucagucaauuaucgaggccuccggcugaguuuaagcgagauaacugccacgugcacaggugaagugaccaacguguccgggugcuacucuuguaugacuggagcgcgugucucgaucaagcugcacagcagcaaaaauuccaccgcccauguuagaugcaagggcgaugagacagcuuucagugugcuagaagguguacacucuuacaccgugagccucuccuuugaccacgcagucguggaugagcagugucagcugaacugcggcgggcaugaaucacagguuacucuuaagggaaauuugauuuuccuggacgugccaaaauuugucgacggcucuuauaugcaaacauaccacagcagugugcccacgggggccaacaucccuucccccaccgauuggcucaaugcucuguucggaaacggcuuaucaagguggauucuggguguuaucggggugcuuuugggaggccucgcccuguuuuuccuaauaaugucucuguuuaagcucggcacuaaacaggucuuccgcucacggacaaagcuggcauga

SEQ ID NO: 11542 - RNA, 3222 nt, Artificial Sequence
  derived and/or modified CDS sequence (opt3) from SFTSV(SPL057A)__AB985295.1__GP
augaugaaggugaucugguucagcucccugauuugccucgucauacaguguucuggcgacaccgggcccaucauuugcgccggaccuauccacucaaacaaaagugcugauauuccacaucuucuggguuacagcgagaagaucugucaaauagacagauugauccacguuuccucuugguuaaggaaucauucgcaguuucagggcuauguggggcagcggggaggccgcucacaaguaagcuacuauccggcagaaaacaguuacucccgauggucuggucugcuaagccccugcgaugccgacuggcucgggaugcugguggucaaaaaggcgaaaggauccgauaugauugugccuggcccaucauauaagggcaagguuuucuuugagcgucccacauucgacggguacgugggaugggguuguggcagugggaaaagcagaacugaaucuggagagcuuugcuccucagauagcggcacgaguucuggucuguugccuuccgacaggguccucuggaucggggauguggcuugucagccaaugacccccauuccugaagagacauuucuggagcuuaagagcuucucgcagucugaauuuccagacaucugccggauagauggaauuguauucaaucagugugaguccgaaucacucccgcaacccuuugacguugccuggauggaugugggccacagucauaaaaucauuaugcgcgagcacaagacuaaauggguccaggagagcuccucuaaggacuucgugugcuauaaggaaggcaccgggccuuguagcgagucagaagagaaaacaugcaagaccaguggauccugcagaggugacaugcaguuuuguaaaguggcaggcugcgaacacggggaggaggccagcgaagcuaaguguaggugcucuuuaguccauaaaccaggagagguugugguaucauacggcgguaugcgggugcgccccaaguguuacggguucagucgaaugauggcaacucuggaagucaacccuccagagcagagaaucggccaaugcacaggaugucaccuugaaugcgugaauggcgggguuagguugaucacccugacgagcgagcuaaaauccgccacugugugugcuucucauuuuugcucgagcgccauuuccggaaagaagucaaccgagauacaguuccacagugguucucucgucggcaaaacagcgauccacgugaagggggcacugguagauggaacugaauuuaccuuugagggcagcuguauguuccccgacgguugcgaugccguugacugcacauuuugucgggaguuccuuaaaaacccgcagugcuauccugcuaagaaauggcuguuuauuaucauagugauuuugcucggguacgccggccugauguuacugaccaauguccucaaggcaaucggaguguggggcuccugggucaucgcucccgugaagcugauguucgccauuaugaaaaagcugaugcguucaguuagcuguuugauggggaaacuaauggaucgcggaagacaagugauccaugaagaaauuggugagaacagggagggcaaucaggacgauguacggauagaaauggcgcgaccacgcagagucaggcacuggauguauucuccugugauccugacgauucucgccguugggcuggcagagggaugcgacgaaauggugcaugcugauuccaaacuugucaguuguaagcagggcagcgguaacaugaaggagugcgugacuacagggcgggcccuguugcccgcuguaaauccaggccaggaggccugucuccacuuuaccgcacccggaucuccugacuccaagugccugaaaaucaaggugaaaaagaucaacuuaaaauguaagaagucaaguagcuacuucguuccagaugcccgcucgagaugcacuuccgucaggcguugucggugggcuggcgacugccaaucugggugcccgagccauuuuacaucaaauaguuucuccgacgauugggcgggaaaaauggaccgagcaggccuggguuuuucuggguguagcgauggaugcggcggugccgcuuguggcugcuucaacgccgcacccuccuguauuuucuggagaaaguggguggaaaauccucacgggauaaucuggaaagugucaccaugcgccgcuuggguccccagcgccguuauugagcuaaccaugccuaguggagaagugaggacguuccacccaaugucuggcauccccacccagguguucaaggggguauccgucacauaucucggaagcgacauggaggugucgggccugacugaucuuugugaaauugaggaguugaaaucaaagaaacuggcacucgcgccgugcaaccaggcugguauggggguugugggaaaggucggcgaaauccaguguucuagugaggaauccgcccgcaccauaaagaaagacgguugcaucuggaacgcagaucuggugggcauugagcuucggguugacgaugccguguguuacagcaagaucacaucuguagaagcugucgccaauuauagcgcaauuccuacuaccaucgggggacugagauuugagaggucccaugacucacaaggcaaaauaagugggagcccauuggauauuacagcuauccgcggaucuuucuccgugaacuaccgaggccuccggcugucauuaagugagauuaccgccacuugcacgggugaagugacaaaugucagcgggugcuacuccuguaugaccggagcgaagguuucuaucaaacugcacucgaacaagaauagcacugcccaugugcguugcaagggcgacgagaccgcuuuuucaguacuagaaggugugcacuccuauacagucagucucucuuucgaucacgcagugguugacgagcagugucagcugaacugcggcgggcaugaaagccaggugacccuuaaaggaaauuugauauuucuggacguccccaaguucguggauggcuccuacaugcaaacuuaucacucaucuguuccuacaggggccaacauccccagcccaacggacuggcucaaugcucuguuuggaaacggcuuaaguagauggauucugggugugaucgggguccuuuugggaggccucgcccuguucuuucuaauuaugucccuguucaaacucggcaccaagcagguauuuaggagccgcacuaaacuggcauga

SEQ ID NO: 11543 - RNA, 3222 nt, Artificial Sequence
  derived and/or modified CDS sequence (opt3) from SFTSV(SPL062A)__AB985297.1__GP
augaugaaggugaucugguucagcucccugauuugccucgucauaagauguucuggcgggaccggacccaucauuugcgccgguccuauccacucaaacaaaagugcuaauauuccacaucuucugggcuacagcgagaagaucugucagauagacagguugauccacguuuccucuugguuacggaaccauucgcaauuucagggguaugugggacagcgcggcggucgaucacagguaagcuacuucccggcagaaaauaguuauucccguuggucugggcugcuaagccccugcgaugccgacuggcucggaaugcugguggucaaaaaggcgagaggcuccgauaugauugugccuggcccaucauacaaagggaagguuuucuucgagaggcccacauuugacggauauguggguuggggcugugggaguggaaagagccggacugaaucuggcgagcuuugcuccucagauagcgguacgaguucugggcuguugccuuccgaccgcguccucuggaucggagauguggcuugucaaccaaugacccccauuccugaagagacauuccuggagcugaaaucguuuagccagucugaauuuccagacaucugcaagauagauggcauuguauuuaaccagugugaguccgaaucacucccgcagcccuucgacguugccuggauggaugugggccacagucauaaaaucauuaugagagagcacaagacuaaauggguccaagagagcuccucuaaggacuuugugugcuacaaggaagggaccggaccuuguagcgagucagaagagaaaacaugcaagaccagugguuccugcaggggcgauaugcaguucuguaaaguggcagggugcgaacacggagaggaggccagcgaagcuaagugucggugcucuuuaguccauaaaccaggcgagguugugguaucauauggugggaugcgcgugcgacccaaguguuacggcuuuaguagaaugauggcaacucuggaagucaauccuccagagcagaggaucggacagugcacaggcugucaccuugaaugcaucaacgggggagugcgguugauuacccugacgagcgagcuaaaauccgccacuguuugugcuucucauuucugcucgagcgccaccuccgguaagaagucaacagagauacaauuccacaguggcucucucguggggaaaacugcgauccacgucaagggagcacugguggacggcaccgaauuuacauucgaggguagcuguauguuucccgacgggugcgaugccguagacugcaccuucugucgugaauuucuuaaaaauccgcagugcuacccugcuaagaaauggcuguucauuaucauagccauuuugcucggcuaugcaggacugauguuacugacgaacguucucaaggcuaucggcguguggggguccugggucaucgcccccgugaaacuuauguuugcgauuaucaaaaagcugaugcgcucagucagcuguuugaugggaaaacuaauggauagagguaggcaagugauucaugaggaaauaggcgagaaucgggaggggaaccaggacgauguucgaaucgaaauggcccgcccaagaagggugcggcacuggauguacucuccuguaauucugacuauccucgcaaucggacuggcugagggcugcgacgaaaugguccaugccgauuccaaacuugugaguuguaagcaggguagcgggaauaugaaggagugcguuacaaccggccgcgcucuguugcccgccgugaacccaggacaggaggcaugucuccacuucacugcccccggcucuccugacuccaagugccugaaaauuaaggucaaaagaauaaauuuaaaguguaaaaagucaaguagcuauuuugugccagaugcuaggucgcguugcacauccguacggcgauguagaugggcgggggacugccagucuggaugcccgagccauuucaccucaaacaguuuuuccgaugacugggcaggcaagauggacagggccggucugggguucucuggauguagcgauggcugcgguggcgcugccugugggugcuuuaaugcagcccccuccuguaucuucuggcgcaaauggguggaaaacccucacggaauuaucuggaagguuucaccaugcgcugccuggguccccagcgcagugauugagcuaacgaugccuaguggcgaagugcggaccuuccacccaaugucugggauccccacacaagucuuuaaaggaguuuccgugacuuaccucggcagcgacauggaggugucgggucugaccgaucuuugugaaauagaggaguugaagucaaagaagcuggcgcucgcuccgugcaaccaggccgggaugggaguagucggcaaagugggugaaauccaguguucuagugaggaauccgcaagaacaauuaagaaggacggcugcaucuggaaugccgaucugguugggauugagcuuaggguggacgaugcugucuguuauagcaaaaucacuucuguggaagccguugcaaacuacagcgcuauaccuaccacaauuggaggccugcgcuucgagcgaucccaugacucacaggggaagaucaguggaagcccauuggauauuaccgccauccggggcucuuuuuccgugaauuaucguggucucagacugucauuaagugagauaacugcgacgugcacaggggaaguaaccaacgucagcggaugcuacuccuguaugacuggcgccaaagugucuaucaagcugcacucgagcaaaaauucaaccgcucaugugaggugcaagggugacgagacagcauucuccguccuagaaggcguucacaguuacaccgugucucucagcuuugaucacgccguaguggacgagcaaugucagcugaacugcgggggacaugaaucccaggucacucuuaagggcaauuugauuuuccuggaugugcccaaauuuguugacgggucauauaugcagacauaccacucuagcgugccuacgggagcuaacauccccaguccaaccgacuggcucaaugcccuguucggcaacgguuuaucccgcuggauucugggggucaucggagugcuuuugggcggccucgcacuguuuuuccuaauaaugagccuguuuaagcucgggacuaaacaaguuuuccggucuagaacaaagcuggcguga

SEQ ID NO: 11544 - RNA, 3222 nt, Artificial Sequence
  derived and/or modified CDS sequence (opt3) from SFTSV(SPL066A)__AB985298.1__GP
augaugaaggugaucugguucagcucccugauuugccucgucauacaguguucuggcgacgccucacccaucauuugcgcugggccuauccacaguaacaaaagcgcaaauauuccacaucuucugggauacuccgagaagaucugucaaauagauagauugauccacguuucuucgugguuaaggaaccauucacaguuucaggguuaugugggccagcgcgggggacggagccaaguaaguuacuucccggccgaaaauuccuauucucgauggagcggccugcuaucccccugcgacgcggauuggcucgguaugcugguggucaaaaaggcuaaagggucagacaugauugugccuggaccaaguuacaagggcaagguuuucuucgagcgucccaccuuugauggcuaugugggguggggaugugguagcggcaaaucuagaacagaauccggggagcuuugcucaagcgacaguggaacuucuuccggccuguugccuagcgauaggguccucuggaucggugacguggccugucagccaaugacgcccauuccugaagagaccuuccuggagcugaagucguuuucucaguccgaauuuccagauaucugcaaaauagacgggauuguauuuaaccagugugagucagaaagucucccgcaacccuucgauguugcauggauggacgugggacacagccauaagaucauuaugcgggagcacaaaacaaaguggguccaggaguccucuagcaaggauuuugugugcuacaaagaaggcacuggcccuuguucagagagugaagagaagaccugcaaaacauccgggagcugccgcggagacaugcaguucuguaagguggccgguugcgaacacggcgaggaggcuucugaagcaaaauguagaugcucauuaguccauaagccaggggagguugugguaaguuauggaggcaugagggugcggcccaaauguuacgguuuuagccgcaugauggccacccuggaagucaauccuccagagcagcgaaucgggcaaugcacuggcugucaccuugaaugcaucaacggaggcgugagauugauuacacugaccuccgagcuaaagucugcuacgguuugugccucgcauuucugcagcuccgcgacuucagggaagaaaaguaccgagauacaguuccacucuggaagccucguggguaaggcagccauccacgucaaaggcgcucugguggacgggacagaauuuacuuucgagggauccuguauguuucccgauggcugcgacgccguagauugcaccuucuguagggaauuucuuaagaauccgcagugcuacccugccaaaaaguggcuguucauuaucauaguuauuuugcucgguuaugcugggcugauguuacugacaaacgugcucaaggccaucggcgucuggggaucaugggugaucgcgcccgucaaacuuauguuugccauuaucaagaaacugauucggagcgugucuuguuugaugggcaagcuaauggaccgugggcgccaaguuauacaugaggaaaucggagagaauggugagggcaaccaggaugacgugagaauugaaauggcaaggccacggcgaguacgccacuggauguacuccccugucauccugaccauccucgcuauugggcuggccgagggaugcgaugaaauggugcaugcugacaguaaacuuguuagcuguaagcagggcucugguaauaugaaggagugcgugacgacugggagagcccuguugcccgcagucaacccaggccaggaggccugucuccacuucacagcucccggauccccugauucaaaaugccugaagauaaaagugaagaggaucaauuuaaaauguaagaagaguagcucguauuuuguaccagacgcgcggucccgcugcaccucugugagaaggugucguugggcaggcgauugccaaagcgggugcccgucacauuucacuucaaacuccuuuucugacgacugggccggaaaaauggaucgggcuggccuggguuucagcggguguuccgacggaugcggcggugccgcauguggcugcuuuaaugccgcucccucauguauuuucuggcgaaaguggguugaaaacccucacgggaucauuuggaaagucagcccaugcgccgcaugggugcccagugcggugaucgagcuaacaaugccuucuggagaagucagaaccuuccacccaauguccggcauacccacgcagaucuuuaaggggguuagcgugaccuaccucggaucggauauggaggugucaggccugacagaccuuugugaaauugaggaguugaggucuaaaaagcuggcucucgccccgugcaaccaggcagguauggggguagucggaaaagugggcgaaauccaguguaguuccgaggaaagcgcccgcacuauuaagaaggaugguugcaucuggaaugcugaccugguuggcauagagcuucggguggaugacgccgucuguuauucuaaaauuaccagcguggaagcaguugcuaacuacuccgccaucccuacaacuauugggggacugagauucgagaggucacaugauagucaaggcaagaucagcgggucuccauuggacauaaccgcgauccgcggauccuuuucagugaauuaucgaggccuccggcugaguuuaagcgagauuacagcaaccugcacuggugaaguaacgaacgucuccgggugcuacucuuguaugacaggagcuaaagugucgaucaagcugcacagcaguaaaaauuccaccgcacaugugcguugcaagggcgaugagacugccuucaguguccuagaagguguucacucuuacaccgugagccucuccuuugaccacgcuguaguggaugagcagugucagcugaacugcggcgggcaugaaucacaggucacacuuaagggaaauuugauuuuccuggacgugcccaaauuuguugacggcucuuauaugcaaaccuaccacagcagugugccuacuggggccaacauccccuccccaacagauuggcucaaugcacuguucggaaacggcuuaagcagauggauacugggugucauuggggugcuuuugggaggccucgcgcuguuuuuccuaaucaugucucuguuuaagcucggcacgaaacagguuuucaggucacgcaccaagcuggccuga

SEQ ID NO: 11545 - RNA, 3222 nt, Artificial Sequence
  derived and/or modified CDS sequence (opt3) from SFTSV(SPL070A)__AB985301.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauucauggagcuaaagagcuuuucgcagucugaauuuccagauaucugcaaaauagacggaauuguauuuaaccagugugaguccgaaucacugccgcaacccuucgauguugccuggauggacgugggccacagucauaagaucauuaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucucucguccauaagccaggagagguugugguaucauauggcgguaugagggugcggcccaaauguuacggguuuagucgcaugauggcaacuuuagaagucagcccuccagagcagcgaaucggccaaugcacaggaugucaccuggaaugcaucaauggcggggugagacuuauuaccuugacguccgagcugaagucugccacuguuugugcuucgcauuucugcagcuccgccaccucaggaaagaaaaguacagagauacaguuccacucugguagccuagugggcaagacugcgauccacgucaaaggggcacucauggacggaaccgaauuuacauucgagggcuccuguauguuucccgaugguugcgacgccguggauugcaccuucuguagggaauuucugaagaacccgcagugcuacccugcuaaaaaguggcuuuucauuaucauaguaauucuguugggguaugccggccucaugcuguuaacgaauguucugaaggcaaucggaguguggggcucaugggucaucgcucccgugaaacucauguuugccauuaucaagaaacuuaugcggagcgucucuugucugauggggaaguugauggaccguggacgccaagugauucaugaggaaauaggugagaacggcgaggggaaucaggaugacguuagaaucgaaauggcgaggccacggcgagugcgccacuggauguacuccccuguaauucuaacuauccuggccaucggacucgcagagggcugcgaugaaaugguccaugcugacaguaaacuggugagcuguaagcaggguucugggaacaugaaggagugcguuacaaccggcagagcccuucugcccgcugugaauccaggacaggaggccuguuugcacuucacugcacccggcuccccugauucaaaaugccucaagauuaaagucaagaggauaaaccugaaauguaagaagaguagcucguauuuugugccagacgcccggucccgcugcacaucuguaagaaggugucguugggcuggggauugccaaagcggaugcccgucacauuucaccaguaauuccuuuucugacgacugggcgggcaaaauggaucgggcagguuuaggguucagcggauguuccgacggcugcgguggcgccgcuugugggugcuuuaacgccgcacccucauguaucuucuggcgaaaguggguggaaaauccucacggaauuaucuggaaaguuagcccaugcgccgcuuggguccccagugccgugauugagcugacgaugccuucuggcgaagugagaaccuuccacccaauguccgggauccccacacaggucuuuaagggaguuagcgugacuuaccuaggcucggauauggaggugaccggucucacagaccugugugaaauagaggagcuuaaaucaaagaaauuggcacuggcgccgugcaaccaggcugggaugggaguagucggcaaggugggugaaauccaguguucuagugaggaauccgccaggacuauuaagaaagauggcugcaucuggaacgcagaccucguugggauugagcugcgcguggaugacgccgucuguuauagcaagaucaccucuguggaagcuguugccaauuacagcgcaauaccuacaaccauuggaggccuucgguucgagagaucccaugauucacaagggaaaaucaguggaagcccacuggacauuacugcuaucaggggcucuuuuuccgugaacuaucgcgguuugcgacucucacugagugagauaacggccacaugcaccggggaaguaacuaaugucagcggaugcuacuccuguaugaccggcgcgaaggugucuaucaaauuacacucgagcaagaacucaacagcccaugugcggugcaagggugaugagaccgcuuucuccguccuggaaggcguucacaguuacacugugucucugagcuuugaccacgcaguaguggaugagcagugucagcucaauugcgggggacaugaaucccaggucacacugaaaggcaaccuuauuuucuuggacgugcccaaguuuguugacgggucauauaugcaaacguaccacucuagcgugccuaccggagccaauauccccaguccaacugauuggcugaacgcucucuucggcaauggucugucccguuggauuuuaggggucaucggagugcugcuuggcggcuuggcccucuuuuuccugauaaugagccuauuuaaacuggggacaaagcagguuuucagaccuaggaccaaacucgcauga

SEQ ID NO: 11546 - RNA, 3222 nt, Artificial Sequence
  derived and/or modified CDS sequence (opt3) from SFTSV(SPL071A)__AB985302.1__GP
augaugaaggugaucugguucagcucccugauuugccucauaauccaguguucuggcgacaccgggcccauuaucugcgccggaccuauucacucaaacaaaagugcuaauaucccacaucuucuggguuacagcgagaagauaugucaaaucgauagauugauucacgucuccucuugguuaaggaaccauucgcaguuucagggcuauguugggcagcggggaggccgcucacaagugagcuacuucccggcagaaaauaguuauucccgauggucuggucugcuaagccccugcgacgccgauuggcucgggaugcugguagugaaaaaggcgaaaggauccgacaugaucgucccuggcccaucauacaagggcaagguguuuuucgagcgucccacauuugauggguauguuggaugggguuguggcagugggaaaagcagaacugaaucuggagagcuuugcuccucagacagcggcacgaguucuggucuguugccuuccgauagggugcucuggauuggggacgucgcuugucagccaaugacccccaucccugaagagacauuccuggagcugaagucauuuucgcagucugaguucccagauauaugcaaaauugacggaaucguguuuaaccagugugaauccgaaucacucccgcaacccuucgauguagccuggauggacguuggccacagucauaagauuaucaugcgggagcacaaaacuaagugggugcaggagagcuccucuaaggauuuugucugcuacaaagaaggcaccgggccuuguagcgagucagaagagaagacaugcaaaaccaguggauccugccgcggugacaugcaguucuguaagguggcaggcugcgaacacggggaggagacuagcgaagccaaauguagaugcucuuuagugcauaagccaggagaggucguugugucauauggcgguaugaggguacggcccaaauguuacggguuuagucgcaugauggcuacacuggaagugaauccuccagagcagcgaaucggccaaugcaccggaugucaccuugaaugcauuaacggcggggucagauugauaacgcugacuagcgagcuaaaguccgcaaccgugugugccucucauuucugcucgagcgcuacauccggaaagaaaucaacugagauccaguuccacagugguucucucguuggcaagaccgccauucacgugaaaggggcgcuggucgacggaacagaauuuaccuucgagggcagcuguauguuucccgaugguugcgacgcaguggauugcacguucuguagggaauuucuuaagaauccgcagugcuacccugccaaaaaguggcuguucaucauaauuguaaucuugcucggguaugcuggccugauguuacugacuaacguucucaaggccaucggaguguggggcuccugggucauugcacccgugaaacuuauguuugcuaucauuaagaaacugaugcggucagucagcuguuugauggggaagcuaauggaccguggacgccaagugauacaugaggaaaucggugagaauagagagggcaaccaggaugacguuaggauugaaauggcccggccacgacgcgugagacacuggauguacucuccuguaauccuggcgauccucgccauugggcuggcagagggaugcgaugaaaugguccaugcugacuccaaacuugugaguuguaagcagggcagcgguaauaugaaggagugcguuacaaccgggagggcccuguugcccgcugugaacccaggccaggaggccugucuccacuucacugcacccggaucuccugauuccaaaugccugaagauaaaagucaagcggaucaauuuaaaauguaagaagucaaguagcuauuuugugccagacgcccgcucgagaugcacauccguaaggcguugucggugggcuggcgauugccaaucugggugcccgagccauuucaccucaaacaguuuuuccgacgacugggcgggaaaaauggaucgagcaggccuggguuucucuggguguagcgacggaugcggcggugccgcuuguggcugcuuuaaugccgcacccuccuguauuuucuggagaaaguggguggaaaacccucacgggaucauuuggaaaguuucaccaugcgccgcuuggguccccagcgccgugaucgagcuaacgaugccuaguggagaagugaggaccuuccacccaaugucuggcauacccacacaggucuuuaaggggguuuccgugacuuaccucggaagcgauauggaggugucgggccugaccgaccuuugugaaaucgaggaguugaaaucaaagaaacuggcacucgcgccgugcaaccaggcugguauggggguagucggaaaggugggcgaaauucaguguucuagugaggaauccgcccgcacaaucaagaaagaugguugcauuuggaaugcagaccugguuggcaucgagcuucggguggaugacgccgucuguuauagcaagauaacuucuguggaagcuguugccaacuacagcgcaauuccuaccacaaucgggggacugagauucgagaggucccaugauucacaaggcaaaauuagugggagcccauuggacaucaccgcuauacgcggaucuuuuuccgugaauuaucgaggccuccggcugucauuaagugagaucacugccacgugcacaggugaaguaaccaacgucagcgggugcuacuccuguaugacuggagcgaaggugucuauuaaacugcacucgagcaagaauagcaccgcccaugugcguugcaagggcgaugagacagcuuucuccguccuagaagguguucacaguuacaccgugucucucagcuuugaccacgcaguaguggaugagcagugucagcugaacugcggcgggcaugaaucccaggucacucuuaaaggaaauuugaucuuccuggacgugcccaaguuuguugacggcucauauaugcaaacauaccacucuagcgugccuacgggggccaacauucccaguccaaccgauuggcucaaugcucuguucggaaacggcuuauccagauggauccugggugucauaggggugcuuuugggaggccucgcccuguuuuuccuaauuaugagccuguuuaaacucggcacuaagcagguuuucaggucucgcacaaaacuggcauga

SEQ ID NO: 11547 - RNA, 3222 nt, Artificial Sequence
  derived and/or modified CDS sequence (opt3) from SFTSV(SPL077A)__AB985304.1__GP
augaugaaggugaucugguucagcucccugauuugccucgucacccaguguucuggcgacacagggcccauaaucugcgccggaccuauucacucaaacaaaagugcuaauaucccacaucuucuggguuacagcgagaagauuugucaaaucgauagauugauacacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugaucgugccuggcccaucauacaagggcaagguuuucuucgagcgucccacuuuugauggguaugugggaugggguuguggcagugggaaaagcagaacggaaucuggagagcuuugcuccucagacagcggcaccaguucuggucuguugccuuccgauaggguccucuggauuggggacguggcuugucagccaaugacacccaucccugaagagacuuuccuggagcucaagagcuuuucgcagucugaauuuccagauauuugcaaaaucgacggaauaguauuuaaccagugugaguccgaaucacugccgcaacccuucgauguugccuggauggacgugggccacagucauaagauuaucaugcgggagcacaaaaccaaguggguccaggagagcuccucuaaggauuuugugugcuacaaagaaggcacagggccuuguagcgagucagaagagaagaccugcaaaacuuccggauccugccgcggugacaugcaguucuguaagguggcaggcugcgaacacggggaggaggccagcgaagcuaaauguagaugcucuuuaguccauaagccaggagagguugugguaucauauggcgguaugagggugcggcccaaauguuacggguuuagucgcaugauggcaacacuggaagucaauccuccagagcagcgaauuggccaaugcaccggaugucaccuugaaugcaucaacggcggggugagauugaucacgcugacuagcgagcuaaaguccgccaccguuugugcuucucauuucugcucgagcgccacauccggaaagaaaucaacugagauucaguuccacagugguucucucgugggcaagaccgcgauacacgucaaaggggcacugguggacggaacagaauuuaccuucgagggcagcuguauguuucccgaugguugcgacgccguagauugcacguucuguagggaauuucuuaagaauccgcagugcuacccugcuaaaaaguggcuguucaucauuaucguuauauugcucggguaugccggccugauguuacugacuaacgugcucaaggcaauuggagucuggggcuccugggugaucgcucccgucaaacuuauguuugccauccugaagaaauugaugcggucagugagcugucuaauggggaagcugauggaccguggacgccaaguuauucaugaggaaaucggugagaauagagagggcaaccaggaugacgugaggauugaaauggcgcggccacgacgcguaagacacuggauguacucuccugucauacucacaauccuggccauugggcuugcagagggaugcgaugaaauggugcaugcugacuccaaacugguuaguuguaagcagggcagcgguaauaugaaggagugcgugaccacugggagggccuugcuccccgcugucaacccaggccaggaggccugucugcacuucacagcacccggaucuccugauuccaaaugcuuaaagaucaaagugaagcggaucaaucugaaauguaagaagucaaguagcuauuuuguaccagacgcccgcucgagaugcaccuccgugaggcguugucggugggcuggcgauugccaaucugggugcccgagccauuucacgucaaacaguuuuuccgacgacugggcgggaaaaauggaucgagcaggccuagguuucucuggguguagcgacggaugcggcggugccgcuuguggcugcuuuaaugccgcacccuccuguauuuucuggagaaaguggguugaaaacccucacgggauaaucuggaaagucucaccaugcgccgcuugggugcccagcgccgugauugagcucaccaugccuaguggagaagucaggacauuccacccaaugucuuccauccccacucagguuuuuaagggcgugagcgugaccuaccuggggucggauauggagguaucaggacuuacagacuugugugaaauugaggagcugaaaucuaagaaacucgcacuggcgccgugcaaccaggcuggcaugggugucguggggaagguuggagaaauccaguguaguuccgaggaaagcgcccgcacuauaaagaaagauggcugcaucuggaaugcagaccuuguggguauugagcugcgggucgaugacgccguguguuauucuaagaucaccagcguugaagcuguggccaacuacuccgcaauuccuacaaccaucggcggguugagauucgagaggucacaugauagucaaggaaaaauaagcggcucuccacucgacauuacugcuauccgcggguccuuuucaguaaauuaucgaggacugcgguuaagucugagcgagauuacggccacaugcaccggcgaagucacuaacguguccgguugcuacucuuguaugaccggggcgaaggugucgaucaaacuacacagcucaaagaauaguacagcccauguccguugcaagggagaugagaccgcuuucaguguucucgaaggcgugcacucuuacacuguaagccuguccuuugaccacgcaguggucgaugagcagugucagcuuaacugcgguggccaugaaucacaggugacauugaaagggaaucugauauuccucgacguucccaaguuuguggacggaucuuauaugcaaacguaccacagcagugucccuaccggcgccaacauccccuccccaacugauuggcugaaugcuuuauucgggaacggacugagcagauggauucuuggcgugaucgguguuuugcucgggggacuggcccuauuuuuccugauuaugucucucuuuaaacagggcacaaaacagguguucaggucacgcaccaagcuggcauga

SEQ ID NO: 11548 - RNA, 3222 nt, Artificial Sequence
  derived and/or modified CDS sequence (opt3) from SFTSV(SPL084A)__AB985307.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuccuggagcugaagucauuuucgcagucugaauuuccagauaucugcaaaauagacggaauuguauuuaaccagugugaguccgaaucacucccgcaacccuucgauguugccuggauggacgugggccacagucauaagaucauuaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucuuuaguccauaagccaggagagguugugguaucauauggcgguaugagggugcggcccaaauguuacggguuuagucgcaugauggcaacucuggaagucaauccuccagagcagcgaaucggccaaugcacaggaugucaccuugaaugcaucaacggcggggugagauugauuacccugacgagcgagcuaaaguccgccacuguuugugcuucucauuucugcucgagcgccaccuccggaaagaaaucaacagagauacaguuccacagugguucucucgugggcaagacugcgauccacgucaaaggggcacugguggacggaaccgaauuuacauucgagggcagcuguauguuucccgaugguugcgacgccguagauugcaccuucuguagggaauuucuuaagaauccgcagugcuacccugcuaaaaaguggcuguucauuaucauaguuauuuugcucggguauacgggccugauguuacugacuaacgugcucaaggccaucggagucuggggcuccugggugaucgcacccgucaaacuuauguuugcuauucugaagaaauugaugcggucagugagcugucuaauggggaagcugauggaccguggacgccaaguuauccaugaggaaauuggugagaauagagagggcaaccaggaugacgugaggauagaaauggcccggccacgacgcguaagacacuggauguacucuccugucauccucacaauucuggcgaucgggcuugccgagggaugcgaugaaauggugcaugcagacuccaaacugguuaguuguaagcagggcagcgguaauaugaaggagugcgugaccacugggagggcuuugcuccccgccgucaacccaggccaggaggcuugucugcacuucacagcccccggaucuccugauuccaaaugcuuaaagaucaaagugaagcggauuaaucugaaauguaagaagucaaguagcuauuuuguaccagacgcacgcucgagaugcaccuccgugaggcguugucggugggccggcgauugccaaucugggugcccgagccauuucacgucaaacaguuuuuccgacgacugggcuggaaaaauggaucgagcgggccuagguuucucuggguguagcgacggaugcggcggugcagccuguggcugcuuuaaugcugcccccuccuguauauucuggagaaaguggguugaaaacccucacgggaucauuuggaaagucucaccaugcgcagccugggugcccagcgcugugaucgagcucaccaugccuaguggagaagucaggacauuccacccaaugucuggcauucccacucagguuuuuaaggggguguccgugaccuaccugggaagcgauauggagguaucgggccuuacagacuugugugaaaucgaggagcugaaaucaaagaaacucgcccuggcaccgugcaaccaggcggguaugggggucgugggaaagguuggcgaaauacaguguucuagugaggaauccgcucgcacuaucaagaaagaugguugcauuuggaaugccgaccuugugggcaucgagcugcgggucgaugacgcaguguguuauagcaagauuaccucuguugaagccguggcuaacuacagcgccaucccuacaaccauagggggauugagauucgagaggucccaugauucacaaggcaaaauuagugggagcccacucgacaucacugcaauucgcggaucuuuuuccguaaauuaucgaggccugcgguuaucacugagugagaucacggcuacaugcaccggugaagucacuaacgugagcgggugcuacuccuguaugaccggagccaaggugucuauaaaacuacacucgagcaagaauagcacagcgcauguccguugcaagggcgaugagaccgccuucuccguucaggaaggugugcacaguuacacuguaucucucagcuuugaccacgcuguggucgaugagcagugucagcugaacugcggcgggcaugaaucccaagugacacuuaaaggaaauuugaucuuccuggacguucccaaguuuguggacggcucauauaugcagacguaccacucuagcgucccuaccggggcaaacauucccaguccaacugauuggcucaaugcccuguucggaaacggcuuauccagauggauccugggugugauugggguucuuuugggaggccucgcucuguuuuuccuaaucaugagccuguuuaaacucggcacaaaacagguguucaggucucgcaccaagcuggccuga

SEQ ID NO: 11549 - RNA, 3222 nt, Artificial Sequence
  derived and/or modified CDS sequence (opt3) from SFTSV(SPL086A)__AB985308.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuccuggagcucaagagcuuuucgcagucugaauuuccagauaucugcaaaauagacggaauuguauuuaaccagugugaguccgaaucacugccgcaacccuucgauguugccuggauggacgugggccacagucauaagaucauuaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucuuuaguccauaagccaggagagguugugguaucauauggcgguaugagggugcggcccaaauguuacggguuuagucgcaugauggcaacucuggaagucaauccuccagagcagcgaaucggccaaugcacaggaugucaccuugaaugcaucaacggcggggugagauugauuacccugacgagcgagcuaaaguccgccacuguuugugcuucucauuucugcucgagcgccaccuccggaaagaaaucaacagagauacaguuccacagugguucucucgugggcaagacugcgauccacgucaaaggggcacugguggacggaaccgaauuuacauucgagggcagcuguauguuucccgaugguugcgacgccguagauugcaccuucuguagggaauuucuuaagaauccgcagugcuacccugcuaaaaaguggcuguucauuaucauaguuauuuugcucggguaugccggccugauguuacugacgaacgugcucaaggcaaucggagucuggggcuccugggugaucgcucccgucaaacuuauguuugccauuaucaagaaacugaugcggucagugagcuguuugauggggaagcuaauggaccguggacgccaaguuauucaugaggaaauaggugagaauagagagggcaaccaggaugacgugaggaucgaaauggcgcggccacgacgcguaagacacuggauguacucuccugucauucugacuauccucgccaucgggcuggcagagggaugcgaugaaauggugcaugcugacuccaaacuuguuaguuguaagcagggcagcgguaauaugaaggagugcgugacaaccgggagggcccuguugcccgcugucaacccaggccaggaggccugucuccacuucacugcacccggaucuccugauuccaaaugccugaagauuaaagugaagcggauaaauuuaaaauguaagaagucaaguagcuauuuuguaccagacgcccgcucgagaugcacauccgugaggcguugucggugggcuggcgauugccaaucugggugcccgagccauuucaccucaaacaguuuuuccgacgacugggcgggaaaaauggaucgagcaggccuggguuucucuggguguagcgacggaugcggcggugccgcuuguggcugcuuuaaugccgcacccuccuguaucuucuggagaaaguggguugaaaacccucacgggauuaucuggaaagucucaccaugcgccgcuugggugcccagcgccgugauugagcuaacgaugccuaguggagaagucaggaccuuccacccaaugucuggcauccccacacagguuuuuaaggggguguccgugacuuaccucggaagcgauauggagguaucgggccugaccgaccuuugugaaauagaggaguugaaaucaaagaaacuggcacucgcgccgugcaaccaggcugguaugggggucgugggaaagguuggcgaaauccaguguucuagugaggaauccgcccgcacaauuaagaaagaugguugcaucuggaaugcagaccuggugggcauugagcuucgggucgaugacgccguguguuauagcaagaucacuucuguugaagcuguggccaacuacagcgcaauaccuaccacaauugggggacugagauucgagaggucccaugauucacaaggcaaaaucagugggagcccauuggacauuaccgcuauccgcggaucuuuuuccguaaauuaucgaggccuccggcugucauuaagugagauaacugccacgugcacaggugaagucaccaacgugagcgggugcuacuccuguaugacuggagcgcgugugucuaucaagcugcacucgagcaaaaauucaaccgcccaugucagaugcaagggcgaugagacagcuuucuccguucuagaaggugugcacaguuacaccguaucucucagcuuugaccacgcaguggucgaugagcagugucagcugaacugcggcgggcaugaaucccaggugacucuuaagggaaauuugauuuuccuggacguucccaaauuuguggacggcucauauaugcaaacauaccacucuagcgucccuacgggggccaacauccccaguccaaccgauuggcucaaugcucuguucggaaacggcuuauccagguggauucugggugugaucgggguucuuuugggaggccucgcccuguuuuuccuaauaaugagccuguuuaagcucggcacuaaacagguguuccgcucucggacaaagcuggcauga

SEQ ID NO: 11550 - RNA, 3222 nt, Artificial Sequence
  derived and/or modified CDS sequence (opt3) from SFTSV(SPL087A)__AB985309.1__GP
augaugaaggugaucugguucagcucccugauuugccucgucauacaguguucuggcgacucagggcccaucauuugcgccggaccuauccacaguaacaaaagcgcugauauuccacaucuucuggguuacuccgagaagaucugucaaauagacagauugauccacguuucuucgugguuaaggaaucauucacaguuucagggcuauguggggcagcggggaggccgcagccaaguaaguuacuauccggcagaaaacuccuacucucgauggagcggucugcuaucccccugcgaugccgacuggcucgggaugcugguggucaaaaaggcgaaaggaucagauaugauugugccuggcccaaguuauaagggcaagguuuucuuugagcgucccaccuucgacggguacgugggaugggguuguggcagcgggaaaucuagauccgaaucaggagagcuuugcagcagugauucuggcacauccagcggucuguugccuucggacaggguccucuggaucggggauguggcuugucagccaaugacucccauuccugaagagacguuucuggagcugaagucuuucucccagucagaauuuccagacaucugcaaaauagauggaauuguauucaaucagugugagggcgaaagucucccgcaacccuuugacguugccuggauggaugugggccacagccauaagaucauuaugcgggagcacaaaaccaaguggguccaggaguccucuagcaaggacuucgugugcuauaaagaagggacaggaccuuguucagagagugaagagaagacuugcaaaaccuccgguagcugccgcggcgacacacaguuuuguaagguggcagggugcgaacacggagaggaggccucugaagcuaaauguagaugcucauuaguccauaagccaggcgagguugugguaaguuacggugggaugagggugcggcccaaauguuacggcuucagccgcaugauggcaacccuggaagucuccccuccagagcagcgaaucggacaaugcacuggcugucaccuugaaugcaucaacgggggagugagauugauuacacugaccucugagcuaaagucggccacgguuugugcuagccauuuuugcuccucagccacuucagguaagaaaucuaccgagauacaguuccacagcggcucccucguggggaagacagcgauccacgucaaaggagcacugguggauggcacugaauuuaccuuugaggguucauguauguuccccgacgggugcgaugccguagacugcacauuuuguagggaguuccuuaagaauccgcagugcuauccugcuaaaaaguggcuguuuauuaucauaguuauuuugcucggcuacgccggacugauguuacugaccaacgugcucaaggcaaucggcgucugggggagcugggugaucgcucccgucaaacuuauguucgccauuaucaagaaacugaugcggacggugucuuguuugaugggaaagcuaauggaucguggucgccaaguuauucaugaagaaauaggcgagaauagagaggggaacagggacgauauccggauugaaauggcgcgaccacgcagagugaggcacuggauguauuccccuguaauccugacuauccucgccauuggacuggcagagggcugcgacgaaaugguccaugcugauaguaaacuugugagcugucggcaggguucugggaauaugaaggagugcguuacaaccggccgcgcccuguugcccgcugugaacccaggacaggaggccugucuccacuuuacugcacccggcuccccugacucaaagugccugaaaauaaaggucaaaagaaucaauuuaaaguguaaaaagaguagcucguacuucgugccagaugccaggucccguugcacaucuguacggcgauguagaugggcuggggacugccagagcggaugcccgccccauuuuaccucaaacaguuucuccgacgauugggcgggcaagauggacagggcaggucugggguuuucuggauguagcgauggcugcgguggcgccgcuugugggugcuucaaugccgcaccuuccuguauuuucuggcgcaaauggguggaaaacccacacggaaucauuuggaagguuucacccugcgccgcuugggucccuagcgccgugaucgagcuaacgaugccaaguggcgaagugcggaccuuccaccccaugucugggauaccgacacaagucuucaaaggaguuuccgugacuuaucucggcagcgacauggaggugucgggucugaccgaucuuugugaaaucgaggaguugaagaguaaaaagcuggcacucgcgccuugcaaucaggcugggaugggaguagucggcaaagugggugaaauucaguguucuagugaggaauccgccagaacaaucaagaaggacggcugcauuuggaacgcagaucugguugggaucgagcuuaggguggacgaugccgucuguuacagcaaaauaacuucuguggaagcuguugccaacuauagcgcaauuccaaccacaaucggaggccugcgcuuugagcgaucccaugacucacaggggaagauuaguggaagccccuuggauaucaccgcuauacggggcucuuucuccgugaauuaccguggucucagacugucauuaagugagaucacugccacgugcacaggggaaguaaccaacgucagcggaugcuacuccuguaugacuggcgcgaaagugucuauuaagcugcacucgagcaaaaauucaaccgcccaugugaggugcaagggugacgagacagcuuuuuccguccuagaaggcguucacaguuauaccgugucucucagcuucgaucacgcaguaguggacgagcgcugucaacugaacugcgggggacaugaaucccaggucacucuuaagggcaauuugaucuuucuggacgugccuaaauucguugaugggucauacaugcagacauaucacucuacggugcccaccggagccaacauuccaagcccuacugacuggcucaaugcucuguuuggcaacgguuuaagucgguggauccugggggucauaggagugcuuuugggcggccucgcccuguucuuucuaauuaugucccuguucaagcucgggacaaaacagguuuuuagaagcaggaccaagcuggcauga

SEQ ID NO: 11551 - RNA, 3222 nt, Artificial Sequence
  derived and/or modified CDS sequence (opt3) from SFTSV(SPL090A)__AB985311.1__GP
augaugaaggugaucugguuccccagccugauuugccucgucauaagauguuccggcgggaccggaccuaucauuugcgccgguccaauccacucuaacaaaucagcuaauauuccgcaucuucugggcuacagugagaagaucugucagauagacagguugauccacguuagcuccugguuacggaaccauucucaauuucagggguaugugggacagcgcggcggucgaucgcagguaucauacuuccccgcagaaaauagcuauagucguugguccgggcugcuaucuccuugcgaugccgacuggcucggaaugcugguggucaaaaaggcgagaggcagcgauaugauugugccaggccccuccuacaaagggaagguuuucuucgagaggccuacauuugacggauauguggguuggggcugugggucaggaaagagucggacugaaagcggcgagcuuuguucuuccgauucagguacgagcagugggcuguugccaucugaccgcguccucuggaucggagauguggcuugccaacccaugaccccuauuccagaagagacauuccuggagcugaaauccuuuagccagucggaauuuccggacaucugcaagauagauggcauuguauuuaaccagugugagucugaaucccucccccagccuuucgacguugccuggauggaugugggccacucacauaaaaucauuaugagagagcacaagacuaaauggguccaagagaguagcuccaaggacuuugugugcuacaaggaagggaccggaccauguucugagagcgaagagaaaacaugcaagaccucagguaguugcaggggcgauaugcaguucuguaaaguggcagggugcgaacacggagaggaggccuccgaagcuaagugucggugcagcuuaguccauaaacccggcgagguugugguaucuuauggugggaugcgcgugcgaccuaaguguuacggcuuuucaagaaugauggcaacucuggaagucaauccacccgagcagaggaucggacagugcacaggcugucaccuugaaugcaucaacgggggagugcgguugauuacccugacgagugagcuaaaaagcgccacuguuugugcuucccauuucuguucuucggccaccagcgguaagaaguccacagagauacaauuccacucaggcagucucguggggaaaacugcgauccacgucaagggagcacugguggacggcaccgaauuuacauucgaggguucuugcauguuuccggacgggugcgaugccguagacugcaccuucugucgugaauuucuuaaaaauccucagugcuaccccgcuaagaaauggcuguucauuaucauagccauuuugcucggcuaugcaggacugauguuacugacgaacguucucaaggcuaucggcgugugggggagcugggucaucgccccagugaaacuuauguuugcgauuaucaagaagcugaugcgcuccgucucauguuugaugggaaaacuaauggauagagguaggcaagugauucaugaggaaauaggcgagaaucgggaggggaaccaggacgauguucgaaucgaaauggcccgcccuagaagggugcggcacuggauguacagccccguaauucugacuauccucgcaaucggacuggcugagggcugcgacgaaaugguccaugccgauucuaaacuuguguccuguaagcaggguagugggaauaugaaggagugcguuacaaccggccgcgcucuguugccagccgugaaccccggacaggaggcaugucuccacuucacugccccuggcagcccagacucuaagugccugaaaauuaaggucaaaagaauaaauuuaaaguguaaaaaguccucaaguuauuuugugccggaugcuaggagccguugcacaucgguacggcgauguagaugggcgggggacugccaguccggaugccccucucauuucaccagcaacucauuuagugaugacugggcaggcaagauggacagggccggucugggguucuccggauguucugauggcugcgguggcgcugccugugggugcuuuaaugcagccccuagcuguaucuucuggcgcaaauggguggaaaacccacacggaauuaucuggaagguuucccccugcgcugccugggucccuucagcagugauugagcuaacgaugccaagcggcgaagugcggaccuuccaccccaugagugggaucccgacacaagucuuuaaaggaguuucugugacuuaccucggcuccgacauggaggugagcggucugaccgaucuuugugaaauagaggaguugaagucgaaaaagcuggcgcucgcuccuugcaaccaggccgggaugggaguagucggcaaagugggugaaauccaguguucaucugaggaaagugcaagaacaauuaagaaggacggcugcaucuggaaugccgaucugguugggauugagcuuaggguggacgaugcugucuguuauuccaaaaucacuagcguggaagccguugcaaacuacucugcuauaccaaccacaauuggaggccugcgcuucgagcgaagccaugacucccaggggaagaucucaggaagucccuuggauauuaccgccauccggggcagcuuuucugugaauuaucguggucucagacuguccuuaucagagauaacugcgacgugcacaggggaaguaaccaacgucaguggaugcuacagcuguaugacuggcgccaaaguguccaucaagcugcacucuucgaaaaauagcaccgcucaugugaggugcaagggugacgagacagcauucucaguccuagaaggcguucacuccuacaccgugagucucucuuuugaucacgccguaguggacgagcaaugucagcugaacugcgggggacaugaaagccaggucacucuuaagggcaauuugauuuuccuggaugugccuaaauuuguugacggguccuauaugcagacauaccacucaucugugcccacgggagcuaacaucccaagcccuaccgacuggcucaaugcccuguucggcaacgguuuaagucgcuggauucugggggucaucggagugcuuuugggcggccucgcacuguuuuuccuaauaaugucccuguuuaagcucgggacuaaacaaguuuuccggagcagaacaaagcuggcguga

SEQ ID NO: 11552 - RNA, 3222 nt, Artificial Sequence
  derived and/or modified CDS sequence (opt3) from SFTSV(SPL097A)__AB985312.1__GP
augaugaaggugaucugguucagcucccugauuugccucgucauacaguguucuggcgacaccgggcccaucauuugcgccggaccuauccacucaaacaaaagugcugauauuccacaucuucuggguuacagcgagaagaucugucaaauagacagauugauccacguuuccucuugguuaaggaaucauucgcaguuucagggcuauguggggcagcggggaggccgcucacaaguaagcuacuauccggcagaaaacaguuacucccgauggucuggucugcuaagccccugcgaugccgacuggcucgggaugcugguggucaaaaaggcgaaaggauccgauaugauugugccuggcccaucauauaagggcaagguuuucuuugagcgucccacauucgacggguacgugggaugggguuguggcagugggaaaagcagaacugaaucuggagagcuuugcuccucagauagcggcacgaguucuggucuguugccuuccgacaggguccucuggaucggggauguggcuugucagccaaugacccccauuccugaagagacauuucuggagcugaagucuuucucgcagucugaauuuccagacaucugcaaaauagauggaauuguauucaaucagugugaguccgaaucacucccgcaacccuuugacguugccuggauggaugugggccacagucauaagaucauuaugcgggagcacaaaacuaaguggguccaggagagcuccucuaaggacuucgugugcuauaaacagggcaccgggccuuguccagaaagcgaggaaaagacaugcaaaaccucaggaaguugccgcggugacaugcaguuuuguaagguggcaggcugcgagcacggggaagaggccuccgaggcuaaauguagaugcagcuuaguccauaagcccggagaaguugugguaucuuacggcgguaugagggugcggccuaaauguuacggguucucacgcaugauggcaacucuggaggucaacccacccgaacaacgaaucggccagugcacaggaugucaccuugagugcgugaauggcgggguuagauugaucacccugacgagugaacuaaagagcgccacugugugugcuucccauuuuugcagcucggccaccagcggaaagaaaaacacagagauucaguuccacuccgguucacucgucggcaagacugcgauacacgugaaaggggcacugcuugauggaaccgaguucacauuugaaggcaguuguauguucccggacgguugcgaugccguagacugcaccuuuuguagggaguuccugaagaauccucaaugcuaucccgcuaaaaagugguuguuuaucauuaucguuauacuccugggguacgccggcuuaaugcugcucacgaacgugcuuaaggcaauuggagucuggggcucuugggugaucgcuccagucaaacugauguucgccaucauuaagaaauugaugcggagcguguccugucuaauggggaagcugauggaucguggacgccagguuauccaugaagagauuggugaaaauagagagggcaaccaggacgaugugaggauagagauggcgcggccucgacgcguaagacacuggauguauucacccgucauccucacuauucuggccguggggcuugcagaaggaugcgacgagaugguucaugcugauagcaaacuggugucuuguaagcagggcuccgguaauaugaaggaaugcgucacaaccgggagggccuugcucccagcugugaaccccggccaagaggccugucugcacuuuacugcaccuggaaguccagacagcaaaugcuuaaagaucaaaguaaagaaaaucaaucugaaguguaagaaaucuuccucauacuucgugccggaugcccggagucgcugcacaagcguuagaaggugucguugggcuggcgacugccagucggggugccccucccauuuuaccucuaacagcuucucagacgauugggcgggaaagauggaccgggcaggccuagguuuuaguggguguuccgauggaugcggcggugccgcuuguggcugcuucaaugccgcaccuucuuguauauuuuggcgaaaaugggucgagaacccacacgggauaaucuggaaggugagccccugcgccgcuugggugccuuccgccgucauugaacucacgaugccaucaggagagguuagaaccuuccaccccaugagcggcaucccgacacagguguucaaaggggugaguguaacuuaucugggaucugacauggaagucuccggccuuaccgauuugugugagauugaggaacuuaagagcaaaaagcucgcacuggcgccuugcaaccaggcugguaugggggugguuggaaaggugggcgagauccaauguucgucagaagagucugccaggacaauuaaaaaggacgguugcaucuggaaugcagaucuugucggcauugaacugcgcguggacgaugccguuuguuacaguaaaaucacuuccguggaggcuguagccaacuauagcgcaauuccaaccacaaucgggggauugcgguuugaaagaucucaugacagccagggcaagauauccgggucaccccucgauauuaccgcuaucaggggaaguuucagcgucaauuaccgcggccugcgauuaucucuguccgagauuacugccacgugcacaggugaggugaccaacgugucagggugcuacaguuguaugacuggagcgaaagucagcaucaagcuacacuccaauaagaacucuaccgcccauguucggugcaaaggcgacgaaacagcuuuuucggugcucgaggguguacacagcuauaccgugucacuguccuucgaucacgcagucguggacgaacagugucagcuuaauugcggcgggcaugagagucaaguuacuuugaagggaaaccugauauuucucgacgugccuaaauucgucgauggcucuuacaugcagacauaucacagcuccgugcccacgggggccaauaucccaucaccuaccgacuggcugaacgcuuuauuuggaaauggccugucucguuggauucuugguguuaucgggguguugcucggaggccuggcccuauucuuucugauuaugagccucuucaagcugggcacuaaacaggucuuuagaaguaggacaaagcuggcauga

SEQ ID NO: 11553 - RNA, 3222 nt, Artificial Sequence
  derived and/or modified CDS sequence (opt3) from SFTSV(SPL100A)__AB985313.1__GP
augaugaaggugaucugguucagcucccugauuugccucgucauacaguguucuggcgacaccgggcccaucauuugcgccggaccuauccacucaaacaaaagugcugauauuccacaucuucuggguuacagcgagaagaucugucaaauagacagauugauccacguuuccucuugguuaaggaaucauucgcaguuucagggcuauguggggcagcggggaggccgcucacaaguaagcuacuauccggcagaaaacaguuacucccgauggucuggucugcuaagccccugcgaugccgacuggcucgggaugcugguggucaaaaaggcgaaaggauccgauaugauugugccuggcccaucauauaagggcaagguuuucuuugagcgucccacauucgacggguacgugggaugggguuguggcagugggaaaagcagaacugaaucuggagagcuuugcuccucagauagcggcacgaguucuggucuguugccuuccgacaggguccucuggaucggggauguggcuugucagccaaugacccccauuccugaagagacauuucuggagcucaagagcuucucgcagucugaauuuccagacaucugcaaaauagauggaauuguauucaaucagugugaguccgaaucacugccgcaacccuuugacguugccuggauggaugugggccacagucauaagaucauuaugcgggagcacaaaacuaaguggguccaggagagcuccucuaaggacuucgugugcuauaaacagggcaccgggccuuguagcgaaucagaggaaaagacaugcaaaaccaguggauccugccgcggugacaugcaguuuuguaagguggcaggcugcgagcacggggaagaggccagcgaggcuaaauguagaugcucuuuaguccauaagccaggagaaguugugguaucauacggcgguaugagggugcggcccaaauguuacggguucagucgcaugauggcaacucuggaggucaacccuccagaacaacgaaucggccagugcacaggaugucaccuugagugcgugaauggcgggguuagauugaucacccugacgagcgaacuaaaguccgccacugugugugcuucucauuuuugcucgagcgccaccuccggaaagaaaucaacagagauucaguuccacagugguucucucgucggcaagacugcgauacacgugaaaggggcacugcuugauggaaccgaguucacauuugaaggcagcuguauguuccccgacgguugcgaugccguagacugcaccuuuuguagggaguuccugaagaacccgcaaugcuauccugcuaaaaagugguuguuuaucauuaucguuauacuccugggguacgccggcuuaaugcugcucacgaaugugcuuaaggcaauugcugucuggggauccugggugaucgcccccgucaaacugauguucgcgaucauuaagaaauugaugcggucagugagcugucuaaugggcaagcugauggaucgugggcgccagguuauccaugaagagauuggagaaaacagagaggguaaucaggacgaugugaggauagagauggcccggccacgacgcguaagacacuggauguauucuccugucauccucacugugcuggcaguuggccuugcugaagggugcgacgagauggugcaugccgauuccaaacuggucaguuguaagcagggaagcggcaacaugaaggaaugcgugacaaccgguagggcuuugcuccccgccguaaauccagggcaagaggcaugucugcacuuuacugcccccggcucuccugacuccaaaugcuuaaagauuaaagugaagaaaaucaaccugaaguguaagaaaucaaguagcuacuucguuccagaugcucggucgcgcugcacauccgucagaaggugucguugggcgggagacugccagucuggcugcccgagccauuuuaccucaaauaguuucuccgacgauugggcagggaagauggaccgggccggacuaggcuuuucugguuguagcgaugggugcggaggcgcugccugugguugcuucaacgcagcccccuccuguaucuuuuggcgaaaauggguggagaauccucacggcauuauauggaaggugucaccaugcgcugccuggguccccagcgcaguuaucgaacucacgaugccuaguggggaggugagaaccuuccacccaaugucuggcauucccacacagguguucaaaggaguauccgucacuuaucuggggagcgacauggaagugucgggacuuaccgauuugugugagaucgaggaacugaagucaaagaagcucgcgcuggcuccgugcaaccaggccggcauggguguuguggggaaggucggagagauucaauguucuagugaagaguccgcaaggacaaucaaaaaggacggcugcauauggaacgccgaucuuguggguaucgaacugcgcguugacgaugcuguguguuacagcaaaauuacuucuguagaggccgucgcaaauuauagcgcuaucccuaccacaauuggcggguugcgguuugaaagaucccaugacucacagggaaagaucaguggcagcccacucgauauaaccgccauuagggggucuuucuccgugaacuaccgcggacugcgauuaucacugagugagaucacugcgacgugcacaggcgaggugaccaaugucagcgguugcuacuccuguaugacuggggccaaaguuucuauuaagcuacacucgaacaagaauagcaccgcucaugugcggugcaaaggagacgaaacagcauuuucaguacucgagggcgugcacuccuauaccgucagucugucuuucgaucacgccgugguugacgaacagugucagcuuaacugcgguggccaugagagccaagugacuuugaaggggaaucugaucuuucucgacguccccaaauucguggauggauccuacaugcagacauaucacucaucuguuccuacgggcgcuaacauacccagcccaaccgacuggcugaaugccuuauuugggaacggacugagucguuggauccuuggcgugauuggugucuugcucgggggacuggcacuauucuuucugaucaugucccucuucaagcugggcacuaaacagguauuuagaagcaggacaaaacuugcguga

SEQ ID NO: 11554 - RNA, 3222 nt, Artificial Sequence
  derived and/or modified CDS sequence (opt3) from SFTSV(SPL106A)__AB985316.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuccuggagcugaagucauuuucgcagucugaauuuccagauaucugcaaaauagacggaauuguauuuaaccagugugaguccgaaucacucccgcaacccuucgauguugccuggauggacgugggccacagucauaagaucauuaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucuuuaguccauaagccaggagagguugugguaucauauggcgguaugagggugcggcccaaauguuacggguuuagucgcaugauggcaacucuggaagucaauccuccagagcagcgaaucggccaaugcacaggaugucaccuugaaugcaucaacggcggggugagauugauuacccugacgagcgagcuaaaguccgccacuguuugugcuucucauuucugcucgagcgccaccuccggaaagaaaucaacagagauacaguuccacagugguucucucgugggcaagacugcgauccacgucaaaggggcacugguggacggaaccgaauuuacauucgagggcagcuguauguuucccgaugguugcgacgccguagauugcaccuucuguagggaauuucuuaagaauccgcagugcuacccugcuaaaaaguggcuguucauuaucauaguuauuuugcucggguaugccggccugauguuacugacgaacgugcucaaggcaaucggagucuggggcuccugggugaucgcucccgucaaacuuauguuugccauucugaagaaauugaugcggucagugagcugucuaauggggaagcugauggaccguggacgccaaguuauccaugaggaaauuggugagaauagagagggcaaccaggaugacgugaggauagaaauggcgcggccacgacgcguaagacacuggauguacucuccugucauccucacuauucuggccaucgggcuugcagagggaugcgaugaagugguucaugcugacuccaaacuggugaguuguaagcagggcagcgguaauaugaaggagugcgucacaaccgggagggccuugcuccccgcugugaacccaggccaggaggccugucugcacuucacugcacccggaucuccugauuccaaaugcuuaaagaucaaaguaaagcggauuaaucugaaauguaagaagucaaguagcuauuuugugccagacgcccgcucgagaugcacauccguuaggcguugucggugggcuggcgauugccaaucugggugcccgagccauuucaccucaaacaguuuuuccgacgacugggcgggaaaaauggaucgagcaggccuagguuucucuggguguagcgacggaugcggcggugccgcuuguggcugcuuuaaugccgcacccuccuguauauucuggagaaagugggucgaaaacccucacgggaucauuuggaaagugucaccaugcgccgcuugggugcccagcgccgucaucgagcucacgaugccuaguggagaaguuaggaccuuccacccaaugucuggcauucccacacagguguuuaaggggguguccguaacuuaccugggaagcgauauggaggucucgggccuuaccgacuugugugaaaucgaggagcugaaaucaaagaaacucgcacuggcgccgugcaaccaggcugguaugggggugguuggaaaggugggcgaaauacaguguucuagugaggaauccgcccgcacaaucaagaaagaugguugcauuuggaaugcagaccuugucggcaucgagcugcggguggaugacgccguuuguuauagcaagauuacuucuguggaagcuguagccaacuacagcgcaaucccuaccacaauagggggauugagauucgagaggucccaugauucacaaggcaaaauuagugggagcccacucgacaucaccgcuauucgcggaucuuuuuccgucaauuaucgaggccugcgguuaucacugagugagaucacugccacgugcacaggugaagugaccaacgugagcgggugcuacuccuguaugauaggagcgaaggucucuaucaaacuacacucgagcaagaauagcacugcccauguucguugcaagggcgaugagaccgcuuucuccgugcucgaagguguacacaguuacacagugucucugagcuuugaccacgcagucguggaugagcagugucagcuuaacugcggcgggcaugaaucccagguuaccuugaaaggaaaucugauuuuccucgacgugcccaaguuugucgacggcucauauaugcaaacuuaccacucuagcgugccuacaggggccaacauccccaguccaacggauuggcugaaugcuuuauucggaaacggccuguccagauggauucuugguguuaucgggguguugcucggaggccuggcccuauuuagccugauaaugucucucuucaaacugggcaccaagcagguccuuaggucacgcacuaaauuggcauga

SEQ ID NO: 11555 - RNA, 3222 nt, Artificial Sequence
  derived and/or modified CDS sequence (opt3) from SFTSV(SPL117A)__AB985321.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauaccguggcaagguuuucuucgagagacccacauuugauggguaugugggaugggguuguggcaguggaaagagcaggacugaaucuggggagcuuugcuccucagacagcggcacgaguucuggucuguugccuuccgaucggguccucuggaucggggacguggcuugucagccaaugacccccauuccugaagagacauuccuggagcugaaaucguuuagccagucugaauuuccagauaucugcaagauagacggaauuguauuuaaccagugugaguccgaaucacucccgcaacccuucgauguugccuggauggacgugggccacagucauaaaaucauuaugcgcgagcacaagacuaaauggguccaggagagcuccucuaaggauuuugugugcuacaaggaaggcaccgggccuuguagcgagucagaagagaaaacaugcaagaccaguggauccugcagaggugacaugcaguucuguaaaguggcaggcugcgaacacggggaggaggccagcgaagcuaaguguaggugcucuuuaguccauaaaccaggagagguugugguaucauauggcgguaugcgggugcgccccaaguguuacggguuuagucgaaugauggcaacucuggaagucaauccuccagagcagagaaucggccaaugcacaggaugucaccuugaaugcaucaacggcggggugagguugauuacccugacgagcgagcuaaaauccgccacuguuugugcuucucauuucugcucgagcgccaccuccggaaagaagucaacagagauacaguuccacagugguucucucgugggcaaaacugcgauccacgucaagggggcacugguggacggaaccgaauuuacauucgagggcagcuguauguuucccgaugguugcgacgccguagauugcaccuucugucgggaauuucuuaaaaauccgcagugcuacccugcuaagaaauggcuguucauuaucauaguuauuuugcucggguaugccggccugauguuacugacgaacgugcucaaggcaaucggagucuggggcuccugggugaucgcucccgucaaacuuauguuugccauuaucaaaaagcugaugcguucagugagcuguuugauggggaaacuaauggaccgcggaagacaaguuauucaugaggaaauaggugagaauagggagggcaaccaggaugacgugcggaucgaaauggcgcgaccacgcagaguaaggcacuggauguacucuccugucauucugacuauccucgccaucgggcuggcagagggaugcgaugaaauggugcaugcugacuccaaacuuguuaguuguaagcagggcagcgguaauaugaaggagugcgugacaaccgggcgggcccuguugcccgcugucaacccaggccaggaggccugucuccacuucacugcacccggaucuccugauuccaagugccugaaaauuaaggugaaacgcauaaauuuaaaguguaaaaagucaaguagcuauuuuguaccagacgccagaucgaggugcacauccgugcgucggugucgaugggcuggcgauugccaaucugggugcccgagccauuucaccucaaacaguuuuuccgacgacugggcgggaaagauggauagagcaggccuggguuucucuggguguagcgacggaugcggcggugccgcuuguggcugcuuuaaugccgcacccuccuguaucuucuggaggaaauggguugaaaacccucacgggauuaucuggaaggucucaccaugcgccgcuugggugcccagcgccgugauugagcuaacgaugccuaguggagaaguccgcaccuuccacccaaugucuggcauccccacacagguuuuuaaagggguguccgugacuuaccucggaagcgauauggagguaucgggccugaccgaccuuugugaaauagaggaguugaagucaaagaagcuggcacucgcgccgugcaaccaggcugguaugggggucgugggaaaaguuggcgaaauccaguguucuagugaggaauccgcccggacaauuaagaaggaugguugcaucuggaaugcagaccuggugggcauugagcuuagagucgaugacgccguguguuauagcaaaaucacuucuguugaagcuguggccaacuacagcgcaauaccuaccacaauugggggacugagguucgagcgcucccaugauucacaaggcaagaucagugggagcccauuggacauuaccgcuauccgaggaucuuuuuccguaaauuaucggggccuccgucugucauuaagugagauaacugccacgugcacaggugaagucaccaacgugagcgggugcuacuccuguaugacuggagcgaaagugucuaucaagcugcacucgagcaaaaauucaaccgcccaugucagaugcaagggcgaugagacagcuuucuccguucuagaaggugugcacaguuacaccguaucucucagcuuugaccacgcaguggucgaugagcagugucagcugaacugcggcgggcaugaaucccaggugacucuuaagggaaauuugauuuuccuggacguucccaaauuuguggacggcucauauaugcaaacauaccacucuagcgucccuacgggggccaacauccccaguccaaccgauuggcucaaugcucuguucggaaacggcuuauccagguggauucugggugugaucgggguucuuuugggaggccucgcccuguuuuuccuaauaaugagccuguuuaagcucggcacuaaacagguguuccgcucucggacaaagcuggcauga

SEQ ID NO: 11556 - RNA, 3222 nt, Artificial Sequence
  derived and/or modified CDS sequence (opt3) from SFTSV(SPL120A)__AB985322.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuccuggagcugaagucauuuucgcagucugaauuuccagauaucugcaaaauagacggaauuguauuuaaccagugugaguccgaaucacucccgcaacccuucgauguugccuggauggacgugggccacagucauaagaucauuaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucuuuaguccauaagccaggagagguugugguaucauauggcgguaugagggugcggcccaaauguuacggguuuagucgcaugauggcaacucuggaagucaauccuccagagcagcgaaucggccaaugcacaggaugucaccuugaaugcaucaacggcggggugagauugauuacccugacgagcgagcuaaaguccgccacuguuugugcuucucauuucugcucgagcgccaccuccggaaagaaaucaacagagauacaguuccacagugguucucucgugggcaagacugcgauccacgucaaaggggcacugguggacggaaccgaauuuacauucgagggcagcuguauguuucccgaugguugcgacgccguagauugcaccuucuguagggaauuucuuaagaauccgcagugcuacccugcuaaaaaguggcuguucauuaucauaguuauuuugcucggguaugccggccugauguuacugacgaacgugcucaaggcaaucggagucuggggcuccugggugaucgcucccgucaaacuuauguuugccauucugaagaaauugaugcggucagugagcugucuaauggggaagcugauggaccguggacgccaaguuauccaugaggaaauuggugagaauagagagggcaaccaggaugacgugaggauagaaauggcgcggccacgacgcguaagacacuggauguacucuccugucauccucacuauucuggccaucgggcuugcagagggaugcgaugaagugguucaugcugacuccaaacuggugaguuguaagcagggcagcgguaauaugaaggagugcgucacaaccgggagggccuugcuccccgcugugaacccaggccaggaggccugucugcacuucacugcacccggaucuccugauuccaaaugcuuaaagaucaaaguaaagcggauuaaucugaaauguaagaagucaaguagcuauuuugugccagacgcccgcucgagaugcacauccguuaggcguugucggugggcuggcgauugccaaucugggugcccgagccauuucaccucaaacaguuuuuccgacgacugggcgggaaaaauggaucgagcaggccuagguuucucuggguguagcgacggaugcggcggugccgcuuguggcugcuuuaaugccgcacccuccuguauauucuggagaaagugggucgaaaacccucacgggaucauuuggaaagugucaccaugcgccgcuugggugcccagcgccgucaucgagcucacgaugccuaguggagaaguuaggaccuuccacccaaugucuggcauucccacacagguguuuaaggggguguccguaacuuaccugggaagcgauauggaggucucgggccuuaccgacuugugugaaaucgaggagcugaaaucaaagaaacucgcacuggcgccgugcaaccaggcugguaugggggugguuggaaaggugggcgaaauacaguguucuagugaggaauccgcccgcacaaucaagaaagaugguugcauuuggaaugcagaccuugucggcaucgagcugcggguggaugacgccguuuguuauagcaagauuacuucuguggaagcuguagccaacuacagcgcaaucccuaccacaauagggggauugagauucgagaggucccaugauucacaaggcaaaauuagugggagcccacucgacaucaccgcuauucgcggaucuuuuuccgucaauuaucgaggccugcgguuaucacugagugagaucacugccacgugcacaggugaagugaccaacgugagcgggugcuacuccuguaugacuggagcgaaggucucuauaaaacuacacucgagcaagaauagcaccgcccauguucguugcaagggcgaugagacagcuuucuccgugcucgaagguguacacaguuacaccgugucucugagcuuugaccacgcagucguggaugagcagugucagcuuaacugcggcgggcaugaaucccagguuacuuugaaaggaaaucugaucuuccucgacgugcccaaguuugucgacggcucauauaugcaaacauaccacucuagcgugccuacgggggccaacauucccaguccaaccgauuggcugaaugcuuuauucggaaacggccuguccagauggauccuugguguuauugggguguugcucggaggccuggcccuauuuagccugaucaugucucucuucaaacugggcacuaagcaggucuuuaggucacgcacaaaacuugcauga

SEQ ID NO: 11557 - RNA, 3222 nt, Artificial Sequence
  derived and/or modified CDS sequence (opt3) from SFTSV(SPL121A)__AB985323.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuccuggagcucaagagcuuuucgcagucugaauuuccagauaucugcaaaauagacggaauuguauuuaaccagugugaguccgaaucacugccgcaacccuucgauguugccuggauggacgugggccacagucauaagaucauuaugcgggagcacaaaacuaaguggguccaggagagcuccccuaaggauuuugugugcuacaaagaaggcaccgggccauguucugagagcgaagagaagacaugcaaaaccucaggaaguugccgcggugacaugcaguucuguaagguggcaggcugcgaacacggggaggaggccuccgaagcuaaauguagaugcagcuuaguccauaagcccggagagguugugguaucuuauggcgguaugagggugcggccuaaauguuacggguuuucacgcaugauggcaacucuggaagucaauaguccagagcagcgaaucggccaaugcacaggaugucaccuugaaugcaucaacggcggggugagauugauuacccugacgagcgagcuaaaguccgccacuguuugugcuucucauuucugcucgagcgccaccuccggaaagaaaucaacagagauacaguuccacagugguucucucgugggcaagacugcgauccacgucaaaggggcacugguggacggaaccgaauuuacauucgagggcagcuguauguuucccgaugguugcgacgccguagauugcaccuucuguagggaauuucuuaagaauccgcagugcuacccugcuaaaaaguggcuguucauuaucauaguuauuuugcucggguaugccggccugauguuacugacgaacgugcucaaggcaaucggagucuggggcuccugggugaucgcucccgucaaacuuauguuugccauuaucaagaaacugaugcggucagugagcuguuugauggggaagcuaauggaccguggacgccaaguuauucaugaggaaauaggugagaauagagagggcaaccaggaugacgugaggaucgaaauggcgcggccacgacgcguaagacacuggauguacucuccugucauucugacuauccucgccaucgggcuggcagagggaugcgaugaaauggugcaugcugacuccaaacuuguuaguuguaagcagggcagcgguaauaugaaggagugcgugacaaccgggagggcccuguugcccgcugucaacccaggccaggaggccugucuccacuucacugcacccggaucuccugauuccaaaugccugaaggugaaaguaaagcggauuaauuuaaaauguaagaagucaaguagcuauuuugugccagacgcccgcucgagaugcacauccguuaggcguugucggugggcuggcgauugccaaucugggugcccgagccauuucaccucaaacaguuuuuccgacgacugggcgggaaaaauggaucgagcaggccuggguuucucuggguguagcgacggaugcggcggugccgcuuguggcugcuuuaaugccgcacccuccuguauauucuggagaaagugggucgaaaacccucacgggaucauuuggaaagugucaccaugcgccgcuugggugcccagcgccgucaucgagcuaacgaugccuaguggagaaguuaggaccuuccacccaaugucuggcauucccacacagguguuuaaggggguguccguaacuuaccucggaagcgauauggaggucucgggccugaccgaccuuugugaaauggaggaguugaaaucaaagaaacuggcacucgcgccgugcaaccaggcugguaugggggugguuggaaaggugggcgaaauccaguguucuagugaggaauccgcccgcacaauaaagaaagaugguugcaucuggaaugcagaccuggucggcauugagcuucggguggaugacgccguuuguuauagcaagaucacuucuguggaagcuguagccaacuacagcgcaauuccuaccacaaucgggggacugagauucgagaggucccaugauucacaaggcaaaauaagugggagcccauuggacauuaccgcuauccgcggaucuuuuuccgucaauuaucgaggccuccggcugucauuaagugagauuacugccacgugcacaggugaagugaccaacgugagcgggugcuacuccuguaugacuggagcgcgugucucuaucaagcugcacucgagcaaaaauucaaccgcccauguuagaugcaagggcgaugagacagcuuucuccgugcuagaagguguacacaguuacaccgugucucucagcuuugaccacgcagucguggaugagcagugucagcugaacugcggcgggcaugaaucccagguuacucuuaagggaaauuugauauuccuggacgugcccaaauuugucgacggcucauauaugcaaacauaccacucuagcgugccuacgggggccaacauccccaguccaaccgauuggcucaaugcucuguucggaaacggcuuauccagguggauucuggguguuaucggggugcuuuugggaggccucgcccuguuuuuccuaauuaugagccuguuuaagcucggcacuaaacaggucuuccgcucucggacaaagcuggcauga

SEQ ID NO: 11558 - RNA, 3222 nt, Artificial Sequence
  derived and/or modified CDS sequence (opt3) from SFTSV(SPL124A)__AB985324.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuccuggagcugaaguccuuuucgcagucugaauuuccagauaucugcaaaauagacggaauuguauuuaaccagugugaguccgaaucacucccgcaacccuucgauguugccuggauggacgugggccacagucauaagaucauuaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucuuuaguccauaagccaggagagguugugguaucauauggcgguaugagggugcggcccaaauguuacggguuuagucgcaugauggcaacucuggaagucaauagcccugagcagcgaaucggccaaugcacaggaugucaccuugaaugcaucaacggcggggugagauugauuacccugacguccgagcuaaagucugccacuguuugugcuucgcauuucugcagcuccgccaccucaggaaagaaaaguacagagauacaguuccacucugguagccucgugggcaagacugcgauccacgucaaaggggcacugguggacggaaccgaauuuacauucgagggcuccuguauguuuccagaugguugcgacgccguagauugcaccuucuguagggaauuucuuaagaauccccagugcuacccggcuaaaaaguggcuguucauuaucauaguuauuuugcucggguaugccggccugauguuacugacgaacgugcucaaggcaaucggagucuggggcucaugggugaucgcuccugucaaacuuauguuugccauuaucaagaaacugaugcggagcgugucuuguuugauggggaagcuaauggaccguggacgccaaguuauucaugaggaaauaggugagaauagagagggcaaccaggaugacgugaggaucgaaauggcgcggccccgacgcguaagacacuggauguacuccccagucauucugacuauccucgccaucgggcuggcagagggaugcgaugaaauggugcaugcugacaguaaacuuguuagcuguaagcagggcucugguaauaugaaggagugcgugacaaccgggagggcccuguugccugcugucaaccccggccaggaggccugucuccacuucacugcaccaggaucccccgauucaaaaugccugaagauucgggugaaacgcauaaauuuaaaguguaaaaagaguagcucguauuuuguaccugacgccagauccaggugcacaucugugcgucggugucgaugggcuggcgauugccaaagcgggugcccaucacauuucaccaguaacuccuuuucugacgacugggcgggaaagauggauagagcaggccuggguuucagcggguguuccgacggaugcggcggugccgcuuguggcugcuuuaaugccgcaccgucauguaucuucuggaggaaauggguugaaaacccccacgggauuaucuggaaggucagcccuugcgccgcuugggugccaagugccgugauugagcuaacgaugcccucuggagaaguccgcaccuuccacccuauguccggcaucccaacacagguuuuuaaaggggugagcgugacuuaccucggaucggauauggagguaucaggccugaccgaccuuugugaaauagaggaguugaagucuaaaaagcuggcacucgcgcccugcaaccaggcugguaugggggucgugggaaaaguuggcgaaauccaguguaguuccgaggaaagcgcccggacaauuaagaaggaugguugcaucuggaaugcagaccuggugggcauugagcuuagagucgaugacgccguguguuauucuaaaaucacuagcguugaagcuguggccaacuacuccgcaauaccgaccacaauugggggacugagguucgagcgcucacaugauagucaaggcaagaucagcgggucuccuuuggacauuaccgcuauccgaggauccuuuucaguaaauuaucggggccuccgucugaguuuaagcgagauaacugccacgugcacaggugaagucaccaacguguccgggugcuacucuuguaugacuggagcgagagugucgaucaaacugcacagcucaaagaauagcaccgcccaugucaggugcaaaggcgaugagacagcuuucaguguucuagaaggugugcacucuuacaccguaagccucuccuuugaccacgcaguggucgaugagcagugucagcugaacugcggcgggcaugaaucacaggugacucuuaagggaaauuugauuuuccuggacguuccaaaguuuguggacggcucuuauaugcaaacauaccacagcaguguccccacgggggccaacaucccuucccccaccgauuggcucaaugcucuguucggaaacggcuuaagccgcuggauucugggugugaucgggguucuuuugggaggccucgcccuguuuuuccuaauaauuucucuguuuaaacucggcacuaaacagguguuccggucaagaacaaagcuggcauga

SEQ ID NO: 11559 - RNA, 3222 nt, Artificial Sequence
  derived and/or modified CDS sequence (opt3) from SFTSV(SPL128A)__AB985325.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuccuggagcugaaguccuuuucgcagucugaauuuccagauaucugcaaaauagacggaauuguauuuaaccagugugaguccgaaucacucccgcaacccuucgauguugccuggauggacgugggccacagucauaagaucauuaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggaggccagcgaagcuaaauguagaugcucuuuaguccauaagccaggagagguugugguaucauauggcgguaugagggugcggcccaaauguuacggguuuagucgcaugauggcaacucuggaagucaauagcccugagcagcgaaucggccaaugcacaggaugucaccuugaaugcaucaacggcggggugagauugauuacccugacguccgagcuaaagucugccacuguuugugcuucgcauuucugcagcuccgccaccucaggaaagaaaaguacagagauacaguuccacucugguagccucgugggcaagacugcgauccacgucaaaggggcacugguggacggaaccgaauuuacauucgagggcuccuguauguuuccagaugguugcgacgccguagauugcaccuucuguagggaauuucuuaagaauccccagugcuacccggcuaaaaaguggcuguucauuaucauaguuauuuugcucggguaugccggccugauguuacugacgaacgugcucaaggcaaucggagucuggggcucaugggugaucgcuccugucaaacuuauguuugccauuaucaagaaacugaugcggagcgugucuuguuugauggggaagcuaauggaccguggacgccaaguuauucaugaggaaauaggugagaauagagagggcaaccaggaugacgugaggaucgaaauggcgcggccccgacgcguaagacacuggauguacuccccagucauucugacuauccucgccaucgggcuggcagagggaugcgaugaaauggugcaugcugacaguaaacuuguuagcuguaagcagggcucugguaauaugaaggagugcgugacaaccgggagggcccuguugccugcugucaaccccggccaggaggccugucuccacuucacugcaccaggaucccccgauucaaaaugccugaagauucgggugaaacgcauaaauuuaaaguguaaaaagaguagcucguauuuuguaccugacgccagauccaggugcacaucugugcgucggugucgaugggcuggcgauugccaaagcgggugcccaucacauuucaccaguaacuccuuuucugacgacugggcgggaaagauggauagagcaggccuggguuucagcggguguuccgacggaugcggcggugccgcuuguggcugcuuuaaugccgcaccgucauguaucuucuggaggaaauggguugaaaacccccacgggauuaucuggaaggucagcccuugcgccgcuugggugccaagugccgugauugagcuaacgaugcccucuggagaaguccgcaccuuccacccuauguccggcaucccaacacagguuuuuaaaggggugagcgugacuuaccucggaucggauauggagguaucaggccugaccgaccuuugugaaauagaggaguugaagucuaaaaagcuggcacucgcgcccugcaaccaggcugguaugggggucgugggaaaaguuggcgaaauccaguguaguuccgaggaaagcgcccggacaauuaagaaggaugguugcaucuggaaugcagaccuggugggcauugagcuuagagucgaugacgccguguguuauucuaaaaucacuagcguugaagcuguggccaacuacuccgcaauaccgaccacaauugggggacugagguucgagcgcucacaugauagucaaggcaagaucagcgggucuccuuuggacauuaccgcuauccgaggauccuuuucaguaaauuaucggggccuccgucugaguuuaagcgagauaacugccacgugcacaggugaagucaccaacguguccgggugcuacucuuguaugacuggagcgagagugucgaucaaacugcacagcucaaagaauagcaccgcccaugucaggugcaaaggcgaugagacagcuuucaguguucuagaaggugugcacucuuacaccguaagccucuccuuugaccacgcaguggucgaugagcagugucagcugaacugcggcgggcaugaaucacaggugacucuuaagggaaauuugauuuuccuggacguuccaaaguuuguggacggcucuuauaugcaaacauaccacagcaguguccccacgggggccaacaucccuucccccaccgauuggcucaaugcucuguucggaaacggcuuaagccgcuggauucugggugccaucggggugcuuuugggaggccucgcacuguuuuuccuaauaauuucucuguuuaaacucggcacuaagcagguuuuccggucaagaacaaaacuggcguga

SEQ ID NO: 11560 - RNA, 3222 nt, Artificial Sequence
  derived and/or modified CDS sequence (opt3) from SFTSV(SPL129A)__AB985326.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuauccggcagaaaauaguuacucccgauggucuggucugcuaagccccugcgacgccgauuggcucgggaugcugguggucaaaaaggcgaaaggauccgacaugauugugccuggcccaucauauaagggcaagguuuucuuugagcgucccacauucgauggguacgugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuucuggagcugaagucauucucgcagucugaauuuccagauaucugcaaaauagacggaauuguauucaaccagugugaguccgaaucacucccgcaacccuuugauguugccuggauggacgugggccacagucauaagaucauuaugcgggagcacaaaacuaaguggguccaggagagcuccucuaaggauuucgugugcuauaaagaaggcaccgggccuuguagcgagucagaagagaagacaugcaaaaccaguggauccugccgcggugacaugcaguuuuguaagguggcaggcugcgaacacggggaggaggccagcgaagcuaaauguagaugcucuuuaguccauaagccaggagagguugugguaucauacggcgguaugagggugcggcccaaauguuacggguucagucgcaugauggcaacucuggaagucaauccuccagagcagcgaaucggccaaugcacaggaugucaccuugaaugcaucagcggcggggugagauugauuacccugacguccgagcuaaagucugccacuguuugugcuucgcauuuuugcagcuccgccaccucaggaaagaaaaguacagagauacaguuccacucugguagccucgugggcaaggcggcaauccacgucaaaggggcccugguggacggaacugaguucaccuuugaaggcuccuguauguuccccgaugguugcgacgcuguagauugcacauuuuguagggaguuccuuaagaacccgcagugcuauccugccaaaaaguggcuguuuauuaucauaguuauuuugcucggguacgcaggccugauguuacugaccaaugugcucaaggcuaucggagucuggggcucaugggugaucgcccccgucaaacuuauguucgcgauuaugaagaaacugaugcggagcgugucuuguuugauggggaagcuaauggaccguggacgccaaguuauccaugaagaaauuggugagaacagagagggcaauagggaugacgugcggauagaaauggcccgaccacgcagaguaaggcacuggauguauuccccugucauccugacgauucucgcaaucgggcuggcugagggaugcgaugaaauggugcaugccgacaguaaacuuguuagcugucggcagggcucugguaacaugaaggagugcgugacuacagggcgcgcucuguugcccgccgucaauccaggccaggaggcaugucuccacuuuaccgcccccggauccccugauucaaagugccugaaaaucaaggugaaaagaauuaacuuaaaguguaaaaagaguagcucguacuucguaccagacgcuaggucccguugcacuucugugcggcgauguagaugggcgggcgauugccagagcgggugcccgucacauuuuacaaguaauuccuucucugacgacugggcaggaaagauggauagggccggccuggguuuuagcggguguuccgacggaugcggcggugcugccuguggcugcuucaacgcagcccccucauguauauuuuggcgcaaauggguugaaaauccucacgggaucauuuggaaggucagcccaugcgcugccugggugcccagugcagugaucgagcuaaccaugccuucuggagaaguccggacguuccacccaauguccggcauucccacccaaguuuucaaaggggugagcgugacauaucucggaucggauauggagguaucaggccugacugaccuuugugaaaucgaggaguugaagucuaaaaagcuggcgcucgcuccgugcaaccaggccgguaugggggucgugggaaaaguuggcgaaauacaguguaguuccgaggaaagcgcaagaaccaucaagaaggaugguugcauuuggaacgccgaccuggugggcaucgagcuuagggucgaugacgcuguguguuacucuaaaauuacaagcguugaaacuguggccaauuauuccgcaaucccuaccacaauagggggacugcgcuuugagcgaucacaugauagucagggcaagauuagcgggucuccauuggacaucaccgcuauucggggauccuucucaguaaacuaccguggccucagacugaguuuaagcgagaucacugccacgugcacaggugaagucaccaauguguccgggugcuacucuuguaugacuggagcgaaagugucgauaaagcugcacagcagcaaaaacuccaccgcccaugucaggugcaaggaggaugaaacagcuuuuaguguucuagagggcgugcacucuuauaccguaagccucuccuucgaccacgcaguggucgaugaacaaugucagcugaauugcgguggccaugagucacacgugacucuuaaggggaacuugaucuuucuggacguucccaaauucguggacggaucuuacaugcagacauaucauagcagugucccuacgggcgccaauauucccuccccaaccgauuggcucaacgcucuguuugggaauggauuaagccgcuggauccugggcgugauggguguucuucucgggggauuggcccuguucuuucuaauuaugucucuguucaagcucggcacuaaacagguguuucggucaagaacaaagcuggcauga

SEQ ID NO: 11561 - RNA, 3222 nt, Artificial Sequence
  derived and/or modified CDS sequence (opt3) from SFTSV(YG1)__AB817987.1__GP
augaugaaggugaucugguucagcucccugauuugccucgucauacaguguucuggcgacaccgggcccaucauuugcgccggaccuauccacucaaacaaaagugcuaauauuccacaucuucuggguuacagcgagaagaucugucaaauagauagauugauccacguuuccucuugguuaaggaaccauucgcaguuucagggcuauguggggcagcggggaggccgcucacaaguaagcuacuucccggcagaaaauaguuauucccgauggucuggucugcuaagccccugcgacgccgauuggcucgggaugcugguggucaaaaaggcgaaaggauccgacaugauugugccuggcccaucauacaagggcaagguuuucuucgagcgucccacauuugauggguaugugggaugggguuguggcagugggaaaagcagaacugaaucuggagagcuuugcuccucagacagcggcacgaguucuggucuguugccuuccgauaggguccucuggaucggggacguggcuugucagccaaugacccccauuccugaagagacauuccuggagcugaagucauuuucgcagucugaauuuccagauaucugcaaaauagacggaauuguauuuaaccagugugaguccgaaucacucccgcaacccuucgauguugccuggauggacgugggccacagucauaagaucauuaugcgggagcacaaaacuaaguggguccaggagagcuccucuaaggauuuugugugcuacaaagaaggcaccgggccuuguagcgagucagaagagaagacaugcaaaaccaguggauccugccgcggugacaugcaguucuguaagguggcaggcugcgaacacggggaggagacuagcgaagccaaauguagaugcucuuuaguccauaagccaggagagguugugguaucauauggcgguaugagggugcggcccaaauguuacggguuuagucgcaugauggcuacacuggaagucaauccuccagagcagcgaaucggccaaugcaccggaugucaccuugaaugcaucaacggcggggugagauugauuacgcugacuagcgagcuaaaguccgcaaccguuugugccucucauuucugcucgagcgcuacauccggaaagaaaucaacugagauacaguuccacagugguucucucgugggcaagaccgccauccacgucaaaggggcgcugguggacggaacagaauuuaccuucgagggcagcuguauguuucccgaugguugcgacgcaguagauugcacguucuguagggaauuucuuaagaauccgcagugcuacccugccaaaaaguggcuguucauuaucauaguuauuuugcucggguaugcuggccugauguuacugacuaacgugcucaaggccaucggaaucuggggcuccugggucauugcacccgugaaacuuauguuugcuaucauuaagaaacugaugcggucagucagcuguuugauggggaagcuaauggaccguggacgccaagugauacaugaggaaaucggugagaauagagagggcaaccaggaagauguuaggauugagauggcccggccacgacgcgugagacacuggauguacucuccuguaauccuggcgauccucgccauugggcuggcagaaggaugcgacgagaugguccaugcugauuccaaacuugugaguuguaagcagggcagcgguaauaugaaggagugcguuacaaccgggagggcccuguugcccgcugugaacccaggccaggaagccugucuccacuucacugcacccggaucuccugacuccaaaugccugaagauaaaagucaagcggaucaauuuaaaauguaagaagucaaguagcuauuuugugccagaugcccgcucgagaugcacauccguaaggcguugucggugggcuggcgacugccaaucugggugcccgagccauuucaccucaaacaguuuuuccgaugacugggcgggaaaaauggaccgagcaggccuggguuucucuggguguagcgauggaugcggcggugccgcuuguggcugcuuuaaugccgcacccuccuguauuuucuggagaaaguggguggagaacccucacgggaucauuuggaaaguuucaccaugcgccgcuuggguccccagcgccgugaucgaacuaacgaugccuaguggagaggugaggaccuuccacccaaugucuggcauacccacacaggucuuuaaggggguuuccgugacuuaccucggaagcgacauggaagugucgggccugaccgaucuuugugagaucgaggaauugaaaucaaagaaacuggcacucgcgccgugcaaccaggcugguauggggguagucggaaaggugggcgagauucaguguucuagugaagaguccgcccgcacaaucaagaaagacgguugcauuuggaaugcagaucugguuggcaucgaacuucggguggacgaugccgucuguuauagcaagauaacuucuguggaggcuguugccaacuacagcgcaauuccuaccacaaucgggggacugagauucgagaggucccaugacucacaaggcaaaauuagugggagcccauuggauaucaccgcuauacgcggaucuuuuuccgugaauuaucgaggccuccggcugucauuaagugaaaucacugccacgugcacaggugagguaaccaacgucagcgggugcuacuccuguaugacuggagcgaaggugucuauuaaacugcacucgagcaagaauagcaccgcccaugugcguugcaagggcgacgaaacagcuuucuccguccuagaggguguucacaguuacaccgugucucucagcuuugaucacgcaguaguggacgaacagugucagcugaacugcggcgggcaugagucccaggucacucuuaaaggaaauuugaucuuccuggaugugcccaaguuuguugacggcucauauaugcaaacauaccacucuagcgugccuacgggggccaacauucccaguccaaccgacuggcucaaugcucuguucggaaacggcuuauccagauggauccugggugucauaggggugcuuuugggaggccucgcccuguuuuuccuaauuaugagccuguuuaaacucggcacuaagcagguuuucaggucucgcacaaaacuggcauga

SEQ ID NO: 11562 - RNA, 3222 nt, Artificial Sequence
  derived and/or modified CDS sequence (opt3) from SFTSV(SDTA_1)__KX641913.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgcgugagucagacaugauugugccuggcccaaguuauaaaggcaagguuuucuuugaaagacccaccuucgauggguacgugggaugggguuguggcagcgggaagucuaggacagaguccggagaacuuugcucaagcgacaguggcacuucuuccggucuguugccuagcgaucggguccucuggaucggggacguggcuugucagcugaugacgccaauucccgaggagaccuuucuggaacucaaaucguucucucaguccgaguuuccugauaucugcaagauagacggaauuguauucaaucagugugaaggcgagucauuaccacaaccguuugauguugccuggauggacgugggccacagucauaaaaucauuaugcgcgagcacaagacaaaauggguccaggaaagcuccucuaaggauuucgugugcuauaaggaggggacuggacccuguagcgaaucagaggaaaaagcaugcaagaccagugguuccugcagaggcgacaugcaguuuuguaaaguggccgggugcgagcacggagaggaaacaagcgaggcuaaguguaggugcucucugguccauaaaccuggcgaaguugugguaucauacggugggaugcgggugcgcccaaaguguuacggcuucagucgaaugauggcaacccuugaggucaaucccccugaacagagaaucggacaaugcacuggcugucacuuggagugcaucaacgggggagugaggcugauuacacuaaccagcgagcuccgguccgccacgguuugugcuucucauuuuugcucgagcgccuccucagguaaaaagaguacugaaauacacuuccacucuggcagccugguggggaagaccgcgauccaugucaaaggagcacuuguggacggcacagaguucacuuuugaagguuccuguauguucccagaugggugcgacgccguagauugcaccuuuugucgugaguuccugaagaacccccagugcuauccggcuaaaaagugguuguuuauuaucauaguuauucuccugggcuacgccggauuaaugcugcucacaaaugugcuuaaagcaaucggcgucugggggucaugggugaucgcuccugucaagcugauguucgccauuaucaagaaauugaugcgcaccgugagcugucuaguuggaaagcugauggacagagguaggcaagugauucacgaagagauaggcgagaacggggaaggaaaucaggaugacguacggaucgagauugcgcgaccccgcagagucaggcauuggauguauucuccagugauccucacgauccuggccauuggccuugcagaagguugcgaugagaugguucacgcugacuccaaacuggugaguugucggcaggggagcggcaacaugaaggagugcauaacuacaggacgcgccuugcucccugcugucaaucccggccaggaagccugucugcauuuuaccgcaccagggucucccgauuccaaaugcuuaaagaucaaggugaaaagaauuaaccugaaguguaaaaagucaaguagcuacuucguaccugacgccaggucgcguugcacuuccgugcggcgauguagaugggcuggagauugccagucuggcugcccaccgcacuuuacaagcaauucauucagugacgacugggcggguaaaauggauagggcagggcuaggauuuuccggcuguucugacgguugcggcggggccgcuuguggaugcuucaacgccgcacccagcuguaucuuuuggcgcaaguggguugagaauccucacggcauuaucuggaaggucuccccaugcgccgcuugggugcccucagccgugauagaacucaccaugccuagcggggagguccggacguuccauccaaugaguggaauccccacccaaguuuucaaaggcgugucugugacauaucuggguuccgauauggaaguaagcgggcuuacugacuugugugagauugaggaacugaagucgaaaaagcucgcacuggcgccgugcaaccaggcuggaaugggcgucguggguaaaguuggcgagauccaguguucaucugaagagagugccagaaccauuaagaaagaugggugcaucuggaacgcagaccuugugggaauagaacugagggucgaugacgccguguguuacuccaagauuacaagcguugaggcuguggccaauuauucugcaaucccuacuaccauuggcggguugcgcuuugagcgaagccacgauucccagggaaagaucucaggcaguccacucgacauaacagcuauccgggguagcuucucuguaaacuaccgugggcugagauuaucccugucagaaauuaccgccacuugcacgggagaggucacaaaugugaguggcugcuacagcuguaugaccggugcgaaaguguccaucaagcuacauucuucgaaaaacagcacugcccacgucaggugcaagggcgaugaaaccgcuuuuucaguucucgagggggugcacuccuauauuguaagucugucuuucgaccaugcaguggucgaugaacaaugucagcuuaauugcggaggccacgagagccaggugacauugaaagggaaccugaucuuucucgacguucccaaguucguggacggauccuacaugcagaccuaucauucaacugucccuacaggcgccaauauacccucuccaacggauuggcugaacgcuuuauuugguaaugggcugagccgcuggauucuuggagugaucggcguuuugcucggcgggcuggcccuauucuuucugaucauguuccuccugaaacuuggaaccaagcaaguguuucggaguagaacuaaguuggcauga

SEQ ID NO: 11563 - RNA, 3222 nt, Artificial Sequence
  derived and/or modified CDS sequence (opt3) from SFTSV(SDTA_2)__KX641914.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucagauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauguugccuggauggacgugggccacagucauaagaucauuaugcgggagcacaaaacaaaguggguccaggaaagcuccucuaaggauuucgugugcuauaaagaggggacuggaccuuguagcgaaucagaggaaaaggcaugcaaaaccagugguuccugccgcggcgacaugcaguuuuguaagguggccgggugcgagcacggagaggaagcuagcgaggcaaaauguagaugcucuuuaguccauaagccaggcgaaguugugguaucauacggugggaugagggugcggcccaaauguuacggcuucagucgcaugauggccacacuggaggucaacccuccagaacacaugaucggacagugcaccggcugucaucuugagugcaucaaugggggagugcgauugauuacucugacaagcgagcuaagauccgcuaccguuugugccucucacuuuugcucgagcgcguccucagguaagaagaguacggaaauacacuuccauucuggcagccucguggggaaaacugcaauccacgucaagggagcccugguggacggcaccgaguucacauuugaagguuccuguauguuccccgaugggugcgacgcuguagauugcacuuuuuguagggaguuccuuaaaaacccgcaaugcuauccugccaagaaauggcuguuuauuaucauaguuauuuugcucggcuacgcaggacugauguuacugaccaaugugcucaaggcuaucggcgucugggggucaugggugaucgcccccgucaaacuuauguucgcgauuaucaagaagcugaugcggacagugagcuguuugguuggaaaacuaauggaccguggucgccaggugauucaugaagagauaggcgagaacggggaaggaaaucaggaugacguaagaaucgagauggccaggccacggcgaguccgccacuggauguauucuccugugauucugaccauccucgcaaucggccuggcugaagguugcgaugagaugguucaugccgacuccaaacuugugaguuguagacaagggagcggcaacaugaaggagugcauuacgacuggaagggcucuguugcccgccgucaauccaggccaggaagcaugucuccacuuuacagcccccgggucuccugauuccaagugccugaagauaaaagugaagcggaucaacuuaaaauguaagaaaucaaguagcuacuucguaccagacgcucgcucgagaugcaccuccgugaggcguugucggugggcgggagauugccagucuggcugcccgccccacuuuacuagcaauucauucagugacgacugggcagguaagauggaucgagccgggcugggauuuuccggcuguucugacgguugcggcggggcugccuguggaugcuucaacgcagccccuagcuguaucuuuuggagaaaguggguugagaauccacauggcauuauuuggaaagucucccccugcgcugccugggugccuucagcagugaucgaacuaacaaugccaagcggggaggucaggaccuuccaccccaugaguggaauaccgacgcagguuuucaagggcgugucugugaccuaucucgguuccgauauggaaguaagcgggcugacagaccuuugugagaucgaggaauugaaaucgaagaaacuggcgcucgcuccuugcaaccaagccggaaugggcgucguggguaagguuggcgagauucaguguucaucugaagagagugcacgcacuaucaaaaaggaugggugcauuuggaacgccgaccuggugggaaucgaacuucgggucgaugacgcuguguguuacuccaagauaaccagcguugaggccguggcaaauuauucugcuauuccaacaacuaucggcgggcugagauuugagaggagccaugauucccagggaaaaauuucaggcagucccuuggacaucaccgccauacgcgguagcuucucuguaaacuaccgagggcuccggcuguccuuaucagaaaucacagcgaccugcacuggagaggucacgaaugugaguggcugcuacagcuguaugacaggugccaagguguccauuaaacugcacucuucgaagaacagcaccgcucacguccguugcaaaggcgaugaaacugcauuuucaguucuagagggggugcauuccuauaucguaagucucucuuucgaccacgccguggucgaugaacagugucaacugaauugcggaggccaugagagccaggugacccuuaaggggaacuugauuuuucuggacguuccuaaguucguggacggauccuacaugcagacauaucacucaaccguccccacuggcgcuaauaucccaucuccuacagauuggcucaacgcccuguuugguaauggguuaagcagauggauacugggagugauuggcguucuuuugggcgggcucgcacuguucuuucuaaucauguuccugcucaaacugggaacgaagcaaguguuuaggagucgcaccaaacuugcguga

SEQ ID NO: 11564 - RNA, 3222 nt, Artificial Sequence
  derived and/or modified CDS sequence (opt3) from SFTSV(SDTA_3)__KX641915.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauguugccuggauggacgugggccacagucauaagaucauuaugcgggagcacaaaacaaaguggguccaggaaagcuccucuaaggauuucgugugcuauaaagaggggacuggaccuuguagcgaaucagaggaaaaggcaugcaaaaccagugguuccugccgcggcgacaugcaguuuuguaagguggccgggugcgagcacggagaggaagcuagcgaggcaaaauguagaugcucuuuaguccauaagccaggcgaaguugugguaucauacggugggaugagggugcggcccaaauguuacggcuucagucgcaugauggccacacuggaggucaacccuccagaacagcgaaucggacaaugcaccggcugucaccuugagugcaucaaugggggagugagauugauuacucugacaagcgagcuaagguccgcuaccguuugugccucucauuuuugcucgagcgcguccucagguaagaagaguacggaaauacacuuccacucuggcagccucguggggaaaacugcaauccaugucaagggagcccugguggacggcaccgaguucacauuugaagguuccuguauguuccccgaugggugcgacgcuguagauugcacuuuuugucgggaguuccuuaaaaacccgcagugcuauccugccaagaaauggcuguuuauuaucauaguuauuuugcucggcuacgcaggacugauguuacugaccaaugugcucaaggcuaucggcgucugggggucaugggugaucgcccccgucaaacuuauguucgcgauuaucaagaagcugaugcguacagugagcuguuugguuggaaaacuaauggaccgcgguagacaggugauucacgaagagauaggcgagaacggggaaggaaaucaagaugacguaaggaucgaggucgcccggccacgacgcgugagacauuggauguauucuccuguuauucugaccauccucgcaaucggccuggcugaagguugcgaugagauggugcacgccgacuccaaacuugucaguuguaggcaggggagcggcaacaugaaggagugcauuacgacuggacgggcucuguugcccgccgugaauccaggccaggaagcaugucuccauuuuacagcccccgggucuccugauuccaagugccugaagauaaaaguaaagcgcaucaacuuaaaauguaagaaaucaaguagcuacuucgugccagacgcuagaucgaggugcaccuccguucgucggugucgaugggcgggagauugccagucuggcugcccgccccacuuuacuagcaauucauucagugacgacugggcagguaagauggauagagccgggcugggauuuuccggcuguucugacgguugcggcggggcugccuguggaugcuucaacgcagccccuagcuguaucuuuuggaggaagugggucgagaauccacacggcauuauuuggaaagugucccccugcgcugccugggugccuucagcagucaucgaacuaacaaugccaagcggggagguucgcaccuuccaucccaugaguggaauaccgacgcaaguguucaagggcgugucuguaaccuaucucgguuccgauauggaagucagcgggcugacagaccuuugugagaucgaggaauugaaaucgaagaaacuggcgcucgcuccuugcaaccaggccggaaugggcgugguugguaaggugggcgagauucaguguucaucugaagagagugcacggacuaucaaaaaggaugggugcauuuggaacgccgaccuggucggaaucgaacuuagaguggaugacgcuguuuguuacuccaagauaaccagcguggaggccguagcaaauuauucugcuauuccaacaacuaucggcgggcugagguuugagcgcagccacgauucccagggaaaaauuucaggcagucccuuggacaucaccgccauacgagguagcuucucugucaacuaccgggggcuccgucuguccuuaucagaaaucacagcgaccugcacuggagaggugacgaaugugaguggcugcuacagcuguaugacaggugccaaggucuccauuaaacugcauucuucgaagaacagcaccgcucacguuagaugcaaaggcgaugaaacugcauuuucagugcuagaggggguacacuccuauaucgugagucucucuuucgaccaugccgucguggaugaacaaugucagcugaauugcggaggccacgagagccagguuacccuuaaggggaacuugauuuuucuggacgugccuaaguucgucgacggauccuacaugcagacauaucauucaaccgugcccacuggcgcuaauaucccaucuccuacagauuggcucaacgcccuguuugguaauggguuaaguagguggauacugggaguuauuggcgugcuuuugggcgggcucgcacuguucuuucuaaucauguuccugcucaaacugggaacgaagcaagucuuucgcagccggaccaaacuugcguga

SEQ ID NO: 11565 - RNA, 3222 nt, Artificial Sequence
  derived and/or modified CDS sequence (opt3) from SFTSV(SDTA_4)__KX641916.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauguugccuggauggacgugggccacagucauaagaucauuaugcgggagcacaaaacaaaguggguccaggaaagcuccucuaaggauuucgugugcuauaaagaggggacuggaccuuguagcgaaucagaggaaaaggcaugcaaaaccagugguuccugccgcggcgacaugcaguuuuguaagguggccgggugcgagcacggagaggaagcuagcgaggcaaaauguagaugcucuuuaguccauaagccaggcgaaguugugguaucauacggugggaugagggugcggcccaaauguuacggcuucagucgcaugauggccacacuggaggucaacccuccagaacagcgaaucggacaaugcaccggcugucaccuugagugcaucaaugggggagugagauugauuacucugacaagcgagcuaagguccgcuaccguuugugccucucauuuuugcucgagcgcgacguccgguaagaagucaacugaaauacacuuccacaguggcucucucguggggaaaaccgcaauccaugucaagggagcccugguggacggcacagaguucacuuuugaagguagcuguauuuuccccgaugggugcgacgcuguagauugcaccuuuugucgggaguuccuuaaaaacccgcagugcuauccugccaagaaauggcuguuuaucauaauuguuaucuugcucggcuacgcaggacugauguuacugacaaaugugcucaaggcuaucggcgucuggggguccugggugauugcccccgucaaguugaucuucgcgauuaugaaaaagcugaugcguaccgugucauguuugguuggaaaacuaauggaccgcgguagacaggugauacacgaagagaucggcgagaacggggaaggaaaucaagaugacguaaggauugagauggcccggccacgacgcgucagacauuggauguauagcccugugauccugacgauccucgcaauuggccuggcugaagguugcgaugagaugguucacgccgacucuaaacuuguguccuguaggcaggggaguggcaacaugaaggagugcauaacuacaggaggcgcucuguugcccgccgucaauccagggcaggaagcaugucuccauuuuaccgcccccggaagcccugauucuaagugccugaagaucaaagugaagcggauuaacuuaaaauguaagaaauccucaaguuacuucguaccagacgcucgcagcagaugcacuucggugaggcguugucggugggcgggcgauugccaguccgguugcccgccccacuuuacaucuaauagcuucucagacgacugggcagggaagauggaucgagccggacugggcuuuagugguuguuccgacggcugcgggggagcugccuguggcugcuucaacgcagccccuucuuguaucuuuuggagaaaguggguugagaauccacacgggauuaucuggaaagucagccccugcgcugccugggugccuuccgcagugauagaacuaaccaugccaucaggagaggucaggacguuccaucccaugagcggcaucccgacccaaguuuucaagggugugagugugacauaucucgggucugauauggaaguauccggacugacugaccuuugugagauugaggaauugaaaagcaagaaacuggcgcucgcuccuugcaaccaggccggcaugggugucgugggcaagguuggggagauccaguguucgucagaagagucugcacgcaccauuaaaaaggauggaugcaucuggaacgccgaccuggugggcauagaacuucgggucgaugacgcuguguguuacaguaagauuacauccguugaggccguggcaaauuauagcgcuaucccaacuaccauugggggacugagauuugagaggucucacgauagccagggcaaaaucuccgguucacccuuggacauaacagccauccgcgggaguuucagcguaaacuaccgaggacuccggcugucuuuauccgaaauuaccgcgacuugcacgggcgaggucacaaaugugucagguugcuacaguuguaugaccggcgccaaggugagcaucaaacugcauuccucuaagaacucgacugcucacguccguugcaaaggggaugaaaccgcauuuagcguucuagagggagugcacucauauauuguaucccucaguuucgaccaugccguggucgaugaacaaugucagcugaauugcggcgggcacgagucucaggugacacuuaagggaaacuugaucuuucuggacguuccuaaguucguggacggcagcuacaugcagaccuaucauuccacuguccccacaggugcuaauauaccaucaccuacggauuggcucaacgcccuguuugggaauggauuaucuagauggauucugggcgugaucggcguucuucuugggggacucgcacuguucuuucuaaucauguuccugcucaaacuggguaccaagcaaguguuuaggagccgcacuaaacuugcguga

SEQ ID NO: 11566 - RNA, 3222 nt, Artificial Sequence
  derived and/or modified CDS sequence (opt3) from SFTSV(HBGS13_human_2015)__KY440773.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcaauagggucuuguggaucggggacguggcuugucagccaaugacgcccauuccugaagagaccuuccucgagcugaagucguuuucucaguccgaauuuccagauaucugcaaaauagacggaauuguauuuaaccagugugagggcgaaucacugccgcaacccuucgauguugccuggauggacgugggccacagucauaagaucauuaugcgggagcacaaaacaaaguggguccaggagagcuccucuaaggauuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaucagccugagcaacgaaucggacagugcacuggcugucaccuggaaugcaucaacgggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggacggcacugaauuuaccuucgaggguagcuguauguuuccagaugggugcgacgccguagauugcacauucuguagggaauuucugaagaauccccaaugcuauccggcuaaaaaguggcuuuucauuaucauaguuauucuguugggcuacgccggacucaugcuguuaaccaacgugcugaaggcaaucggcaucuggggguccugggucauugcuccugugaaacucaucuuugccauuauaaagaaacuuaugcggacggucucaugucugaugggaaaguugauggaccguggucgccaggugauccaugaggaaauuggcgagaauagagaggggaaccaggaugacguuaggaucgaaauggcgcggccccgacgcgugagacacuggauguauagcccaguaauccuaacuauucuggccauaggaaucgcagagucuugcgaugaaaugguccaugcugacuccaaacucgugaguuguaggcagggcagcgguaauaugaaggagugcguuacaaccgggcgggcccugcuuccugcugugaaccccggccaagaggccugucugcacuucacugcaccaggaucucccgauuccaagugcuugcgcauuaaagucaagagaaucaaucucaaauguaagaaaucaaguagcuacuuugugccugacgccaggucgcguugcacauccguacggcgauguagaugggcuggcgauugccagucugggugcccaccgcauuucaccagcaacucauuuagugacgacugggcgggaaagauggauagggcaggccuggguuucuccggguguucugacggaugcggcggugccgcuuguggcugcuuuaaugccgcacccagcuguauuuucuggcgcaaguggguggaaaacccucacgggaucauauggaaaguuuccccaugcgccgcuuggguccccucagccgugaucgaguuaacgaugccuagcggagaagugcggaccuuccacccaaugaguggcauucccacacaggucuuuaaggggguuucugugacuuaucugggauccgauauggaggugagcggccuaaccgaccucugugaaaucgaggagcugaaaucgaagaaacuugcauuggcgccgugcaaccaggcugguauggggguagucggaaaggugggcgaaauucaauguucaucugaggaaagugccagaacaaucaaaaaggaugguugcauauggaaugcagaccugguuggcauugagcucaggguggaugacgccgucuguuacuccaagaucacuagcguggaagcuguugccaacuauucugcaauuccuaccacaaucgggggacugcgcuucgagcgaagccaugauucccagggcaaaauaucagggaguccacuugacaucaccgcuauucggggcagcuuuucugugaauuaccguggacugagauugucccucucagagaucacugccacgugcacaggugaaguaaccaacgucagugggugcuacagcuguaugacuggagcgaagguguccauuaaacugcacucuucgaagaauagcaccgcccaugugaggugcaaaggcgaugagacagcuuucucagucuuagaagguguucacuccuauaccgugagucugucuuuugaccacgcaguaguggaugagcagugucagcuaaacugcggcgggcaugaaagccaagucacucucaagggaaaucugaucuuccuugacgugcccaaguuuguugacggcuccuacaugcagacauaucacucaacggugccuaccggggccaacauacccucuccaacugauugguugaaugcucuguucggaaacggccucagccgcuggauucugggugucauggggguguuacugggaggccuugccuuguuuaucaucauuaugagucucuucaaacugggcacaaagcagguuuuucgguccagaaccaaacuagcauga

SEQ ID NO: 11567 - RNA, 3222 nt, Artificial Sequence
  derived and/or modified CDS sequence (opt3) from SFTSV(HBMC16_human_2015)__KY440776.1__GP
augaugaaggugaucugguucagcucccuggucugccucguuauucaguguucuggcgacucagggcccauaaucugcgccggaccuauucacaguaacaaaagcgcugguaucccacaucuucugggcuacuccgagaagauuugucaaaucgauagauugauacacgugucuucgugguuaaggaaucauucacaguuucagggguauguaggacagcggggcggucgcagccaagugaguuacuauccggcagaaaacuccuacucucgauggagcgggcugcuaucccccugcgacgccgauuggcucggaaugcuggucgugaaaaaggcgaaaggcucagacaugaucguuccuggcccaaguuauaaggggaagguguucuuugagcgucccaccuucgauggauacgucgguuggggcugugggagcggaaaaucuagaacagaauccggcgagcuuugcucaagcgacagugguacuucuuccgggcuguugccuagcgauagggugcucuggauuggagacguagcuugucagccaaugacgcccaucccugaagagaccuuucuggagcugaagucguucucucaguccgaauuuccagauauuugcaaaaucgacggcauaguuuucaaucagugugagggcgaaucacucccgcaacccuuugauguggccuggauggacgucgggcacagucauaagauuaucaugcgggagcacaaaacaaagugggugcaggagagcuccucuaaggauuucgugugcuauaaagaaggaacugguccuuguagcgagucagaagagaaggcaugcaaaaccaguggcuccugccgcggggacaugcaguuuuguaaggucgccggaugcgaacacggcgaggaggcuagcgaagcaaaauguagaugcucuuuaguucauaagccaggugaggugguagugucauacgggggcaugaggguccggcccaaauguuacggauucagucgcaugauggccacaauggaagugaacccuccagagcagcgaauuggccaaugcaccgggugucaccuggaaugcaucaauggagguguuagacuuaucacuuugacaagcgagcugaaguccgcuaccgugugugccucucauuuuugcucgagcgcgacguccggcaagaaaucaacugagauucacuuccacagugggucucuagucggaaaggcagccauacaugugaaaggcgcucucguagacgguaccgaauuuacauuugaggggagcuguauguuccccgauggcugcaacgccguugacugcacuuuuuguagggaguuccugaagaauccgcagugcuauccugccaaaaaguggcuuuuuaucauuaucgugauacuguugggauacgcuggccucaugcuguuaaccaacguccugaaggccauugggguguggggauccugggucaucgcgcccgugaaacucauguucgccaucaugaagaaacuuaugcggacaguuucaugucugguggguaaguugauggaucguggccgccagguaauucacgaagaaaucggggagaauggagagggcaaccaagacgaugucagaauugaaauggcaaggccacggcgagugcgccauuggauguauagcccuguuauacuaaccauccuggcuauuggucucgccgaggggugcgacgaaauggugcacgcugauucuaaacuggucuccuguagacagggcaguggaaauaugaaggagugcgugacgacuggcagggcccuucugcccgcaguaaacccagggcaggaggccuguuugcauuuuacagcucccggaagcccugacucuaagugccucaaaaucaaggugaaacggaucaaucugaaguguaaaaaguccucaaguuacuucguuccagaugcgcgcagcagaugcaccucggucaggcguugucggugggcaggcgacugccaguccgguugcccgccccacuuuacuucuaacagcuucucagaugacugggccgggaagauggaccgagcuggauuaggcuuuagugguuguuccgauggcugcgggggagccgcauguggcugcuucaaugccgcuccuucuuguauuuucuggagaaaauggguggaaaacccacacgggauaaucuggaaggugagccccugcgccgcaugggucccuuccgcgguuauugagcugacaaugccaucaggagaagugaggaccuuccaucccaugagcggcaucccgacgcaaguguucaaagguguaagugucaccuaucuagggucugacauggagguguccggacucacagaucugugugaaauugaggagcuuaagagcaaaaaguuggcucuggccccuugcaaccaggcaggcauggguguugugggcaaagucggggaaauccaguguucgucagaggaaucugcccgcacuauaaagaaggacggaugcaucuggaaugcugaucucgugggcauugagcugcggguugacgaugccguguguuacaguaaaaucaccuccguagaagcagucgcuaacuauagcgccauuccaacaacuaucgggggacuuagauuugagaggucucacgacagccagggcaagauauccgguucaccccuggauauuaccgcgauccgcgggaguuucagcgugaauuaccgaggauugcggcucucucuguccgagauuacagcaaccugcacuggcgaagugacgaacgucucagguugcuacaguuguaugacaggcgcuaaaguuagcaucaaguuacauuccucuaaaaauucgaccgcacacgugcguugcaagggggacgagacugccuuuagcguacuggaaggagugcacucauauaccgucucccuaaguuucgaucaugcugugguugacgagcaaugucagcucaacugcggcgggcacgaaucucaggugacacugaagggaaaucuuauauuuuuggaugucccuaaauucguggacggcagcuacaugcagaccuaucauuccacuguucccacaggugccaacaucccaucaccuacggacuggcugaaugcacucuuugggaacggacugucuagauggauuuuaggcgugaucggcguccugcuugggggauuggcccucuucuuucugauuauguuccuauuuaagcuggguaccaaacaaguauucaggagccgcacuaagcucgcguga

SEQ ID NO: 11568 - RNA, 3222 nt, Artificial Sequence
  derived and/or modified CDS sequence (opt3) from SFTSV(HBMC5_human_2016)__KY440770.1__GP
augaugaaggugaucugguucagcucccuggucugccucguuauucaguguucuggcgacucagggcccauaaucugcgccggaccuauucacaguaacaaaagcgcugguaucccacaucuucugggcuacuccgagaagauuugucaaaucgauagauugauacacgugucuucgugguuaaggaaucauucacaguuucagggguauguaggacagcggggcggucgcagccaagugaguuacuauccggcagaaaacuccuacucucgauggagcgggcugcuaucccccugcgacgccgauuggcucggaaugcuggucgugaaaaaggcgaaaggcucagacaugaucguuccuggcccaaguuauaaggggaaggugcuuuucgagcgucccaccuuugauggauacgucgguuggggcugugggagcggaaaaucuagaacagaauccggcgagcugugcucaagcgacagugguacuucuuccggguugcucccuagcgauagggugcuguggauuggagacguagcuugucagccaaugacgcccaucccugaagagaccuuccuggagcucaagucguuuucucaguccgaguucccagauauuugcaaaaucgacggcauaguuuuuaaucagugugaaggcgaaucauuaccgcaacccuucgauguggccuggauggacgucgggcacagucauaagauuaucaugcgggagcacaaaacaaagugggugcaggagagcuccucuaaggauuuugugugcuauaaagaaggaacugguccuuguagcgagucagaagagaaggcaugcaaaaccaguggcuccugccgcggggacaugcaguucuguaaggucgccggaugcgaacacggcgaggaggcuagcgaagcaaaauguagaugcucucugguucauaagccaggugaggugguagugucauacgggggcaugaggguccggcccaaauguuacggauuuagucgcaugauggccacaauggaagugaacccuccagagcagcgaauuggccaaugcaccgggugucaccuugaaugcaucaauggagguguuagauugaucacucugacaagcgagcuaaaguccgcuaccgugugugccucucauuucugcucgagcgcgacguccggcaagaaaucaacugagauucacuuucacagugggucucucgucggaaaggcagccauacaugugaaaggcgcucugguagacgguaccgaguucacauucgaagggagcuguauguuucccgauggcugcaacgccguugacugcacuuucuguagggaauuucuuaagaauccgcagugcuauccugccaaaaaguggcuguucaucauuaucgugauauugcucggauacgcuggccugauguuacugaccaacguccucaaggccauugggguguggggauccugggucaucgcgcccgugaaacuuauguuugccaucaugaagaaacugaugcggacaguuucauguuugguggguaagcuaauggaucguggccgccagguaauucacgaggaaaucggggagaauggagagggcaaccaagacgaugucagaauugaaauggcaaggccacggcgagugcgccauuggauguauagcccuguuauacugaccauccucgcuauuggucuggccgaggggugcgacgaaauggugcacgcugauucuaaacuugucuccuguagacagggcaguggaaauaugaaggagugcgugacgacuggcagggcccuguugcccgcaguaaacccagggcaggaggccugucuccauuucacagcucccggaagcccugacucuaagugccugaaaaucaaggugaaacggaucaauuuaaaguguaaaaaguccucaaguuacuuuguuccagaugcgcgcagcagaugcaccucggucaggcguugucggugggcaggcgacugccaguccgguugcccgccccacuucacuucuaacagcuuuucagaugacugggccgggaagauggaccgagcuggacugggcuucagugguuguuccgauggcugcgggggagccgcauguggcugcuuuaaugccgcuccuucuuguauuuucuggagaaaauggguggaaaacccacacgggauaaucuggaaggugagccccugcgccgcaugggucccuuccgcgguuauugagcuaacaaugccaucaggagaagugaggaccuuucaucccaugagcggcaucccgacgcaaguguucaaagguguaagugucaccuaucucgggucugacauggagguguccggacugacagaucuuugugaaauugaggaguugaaaagcaagaagcuggcucucgccccuugcaaccaggcaggcauggguguugugggcaaagucggggaaauccaguguucgucagaggaaucugcccgcacuauaaagaaggacggaugcaucuggaaugcugaucuggugggcauugagcuucggguugacgaugccguguguuacaguaaaaucaccuccguagaagcagucgcuaacuauagcgccauuccaacaacuaucgggggacugagauucgagaggucucacgacagccagggcaagauauccgguucacccuuggauauuaccgcgauccgcgggaguuuuagcgugaauuaccgaggacuccggcugucuuuauccgagauuacagcaaccugcacuggcgaagugacgaacgucucagguugcuacaguuguaugacaggcgcuaaaguuagcaucaagcugcauuccucuaaaaauucgaccgcacacgugcguugcaagggggacgagacugccuucagcguacuagaaggagugcacucauauaccgucucccucaguuuugaucaugcugugguugacgagcaaugucagcugaacugcggcgggcacgaaucucaggugacacuuaagggaaauuugauauuccuggaugucccuaaauuuguggacggcagcuacaugcagaccuaucauuccacuguucccacaggugccaacaucccaucaccuacggacuggcucaaugcacuguucgggaacggauuaucuagauggauucugggcgugaucggcguccuucucgggggauuggcgcuguuuuuccuaauuauguuucuguucaagcucgguaccaaacaaguauuuaggagccgcacuaagcuggccuga

SEQ ID NO: 11569 - RNA, 3222 nt, Artificial Sequence
  derived and/or modified CDS sequence (opt3) from SFTSV(HB29)__KP202164.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauguugccuggauggacgugggccacagucauaagaucauuaugcgggagcacaaaacaaaguggguccaggaaagcuccucuaaggauuucgugugcuauaaagaggggacuggaccuuguagcgaaucagaggaaaaggcaugcaaaaccagugguuccugccgcggcgacaugcaguuuuguaagguggccgggugcgagcacggagaggaagcuagcgaggcaaaauguagaugcucuuuaguccauaagccaggcgaaguugugguaucauacggugggaugagggugcggcccaaauguuacggcuucagucgcaugauggccacacuggaggucaacccuccagaacagcgaaucggacaaugcaccggcugucaccuugagugcaucaaugggggagugagauugauuacucugacaagcgagcuaagguccgcuaccguuugugccucucauuuuugcucgagcgcguccucagguaagaagaguacggaaauacacuuccacucuggcagccucguggggaaaacugcaauccaugucaagggagcccugguggacggcaccgaguucacauuugaagguuccuguauguuccccgaugggugcgacgcuguagauugcacuuuuugucgggaguuccuuaaaaacccgcagugcuauccugccaagaaauggcuguuuauuaucauaguuauucacuugggcuacgcaggacucaugcuguuaaccaaugugcugaaggcuaucggcgucugggggucaugggugaucgcccccgucaagcucauguucgcgauuaucaaaaaguugaugcguacagugagcugucugguuggaaaauugauggaccgcgguagacaggugauucaugaagagauaggcgagaacggggaaggaaaucaagaugacguaaggaucgagauggcccggccacgacgcgucagacacuggauguauucuccugugauucuaaccauccuggcaaucggccucgcugaagguugcgaugagaugguucaugccgacuccaagcuggugaguuguaggcaggggagcggcaacaugaaagagugcauuacgacuggacgggcccuucugcccgcugucaauccaggccaggaagcauguuugcacuuuacagcccccgggucuccugauuccaagugccucaagauaaaagugaagcgcaucaaccugaaauguaagaaaucaaguagcuacuucguaccagacgcuagaucgaggugcaccuccgugcgucggugucgaugggcgggagauugccagucuggcugcccgccccacuuuacuagcaauucauucagugacgacugggcagguaagauggauagagccggguuaggauuuuccggcuguucugacgguugcggcggggcugccuguggaugcuucaacgcagccccuagcuguaucuuuuggaggaaguggguugagaauccacauggcauuauuuggaaagucucccccugcgcugccugggugccuucagcagugaucgaacugacaaugccaagcggggagguccgcaccuuccaccccaugaguggaauaccgacgcaaguuuucaagggcgugucugugaccuaucuagguuccgauauggaaguaagcgggcucacagaccugugugagaucgaggaacuuaaaucgaagaaauuggcgcuggcuccuugcaaccaggccggaaugggcgucguggguaagguuggcgagauucaguguucaucugaagagagugcacggacuaucaaaaaggaugggugcauuuggaacgccgaccucgugggaaucgaacugagagucgaugacgcuguguguuacuccaagauaaccagcguugaggccguggcaaauuauucugcuauuccaacaacuaucggcgggcuuagguuugagcgcagccaugauucccagggaaaaauuucaggcaguccccuggacaucaccgccauacgagguagcuucucuguaaacuaccggggguugcgucucucccugucagaaaucacagcgaccugcacuggagaggucacgaaugugaguggcugcuacagcuguaugacaggugccaagguguccauuaaauuacacucuucgaagaacaauaccgcucacgucagaugcaaaggcgaugaaacugcauuuagcguucuggagggggugcauucauauaucguaucccuaaguuucgaccacgccguggucgaugaacaaugucagcucaacugcggaggccaugagucucaggugacccugaaggggaaucuuauuuuucuugacguuccuaaguucguggacggaagcuacaugcagacauaucacuccaccguccccacuggcgcuaacaucccaucaccuacagauuggcugaaugcccucuuugguaacgggcugucuagguggauauuaggagugauuggcguucugcuuggcggguuggcacucuucuuucugaucauguuccuacugaaacucggaacgaagcaaguguuucgcagccggaccaaacuggcguga

SEQ ID NO: 11570 - RNA, 3222 nt, Artificial Sequence
  derived and/or modified CDS sequence (opt3) from SFTSV(HNXY_115)__KC292312.1__GP
augaugaaggugaucugguucagcucccugauuuacuuugucauacagugcucuggcgacucagggaguaucauuugugccggacccauccacagcaacaaauccgcugauauuccucaucuccuugguuauucugagaagaucugccaaauagacagacugauccacguuucgucaugguugaggaaucauagccaguuccagggcuacguggggcagcggggaggccgcagucaaguauccuauuacccagcagaaaacucuuauagccgaugguccgguuuacugucaccgugugaugccgacuggcuagggaugcucguggucaaaaaggcgaaaggaagugauaugauugugcccggcccuagcuacaagggcaagguuuucuucgagcguccaaccuuugacggguaugugggaugggguugcggcucugggaaauccagaacagaaucaggagagcuguguagcagugauucuggcacuuccagcggucuucugcccucggacagggucuuguggaucggggauguggcuugccagccuaugacgccaauucccgaagagaccuuccucgagcugaagucuuuuucccagucagaauuuccugacaucuguaaaauagauggaauuguauuuaaucagugcgagggcgaaagucugccacaaccguucgacguugccuggauggaugugggccacagccauaagaucauuaugcgggagcacaaaacaaaguggguccaggaguccucuagcaaggacuuuguguguuacaaagaagggacuggacccugcucagagagugaagagaagaccuguaaaacauccgguagcugccgcggcgacaugcaguucugcaagguggcagggugugaacacggagaggaggccucugaagcuaaaugcagauguucacucguccauaagccuggcgagguugugguaaguuacggugggaugagggugcggccaaaaugcuauggcuuuagccgcaugauggcaaccuuagaagucaaccagcccgagcaacgaaucggacaguguacuggcugccaccuggaauguaucaaugggggagugagacuuauuacauugaccuccgagcugaagucugccacgguuugcgcuucgcauuucuguagcuccgccacuucagguaagaaaaguaccgagauacaguuccacucuggcagccuaguggggaagacagcgauccacgucaaaggagcacucguggauggcacugaauuuaccuucgaggguuccugcauguuuccugacgggugugaugccguagacugcacauucugcagggaauuucugaagaacccacaauguuaccccgcuaaaaaguggcuuuucauuaucauaguuauucuguugggcuaugccggacucaugcuguuaaccaaugugcugaaggcaaucggcaucugggggucaugggucauugcuccggugaaacucaucuuugccauuauaaagaaacuuaugcggacggucagcugccugaugggaaaguugauggaucguggucgccaggugauccaugaggaaauuggcgagaacagagaggggaaucaggacgauguuaggaucgaaauggcgcggccucgacgcgugagacacuggauguacucucccguaauccuaacuauucuggccauaggacucgcagaguccugugacgaaaugguccaugcugauaguaaacuggugagcugcaggcagggcucugguaacaugaaggaguguguuacaaccgggcgggcccuucugccagcugugaauccuggccaagaggccugcuugcacuucacugcacccggauccccagacucaaagugucucaaaaucaaggucaaacgcauuaaccugaagugcaaaaagaguagcucguauuuugugcccgaugccagauccagguguacaucuguacgucggugccgaugggcuggcgacugucagagcgggugcccuccacauuucaccucaaauaguuuuuccgacgauugggcgggaaagauggacagagcaggcuuagguuucucugggugcagcgauggauguggcggugccgcuugcggcuguuuuaacgccgcaccguccugcaucuucuggaggaaauggguggaaaauccccacgggauuaucuggaagguuucaccuugugccgcuugggucccaagcgccgugauagagcugacgaugcccaguggagaagugcgcaccuuccacccuaugucuggcaucccaacacaggucuuuaaagggguuuccgugacuuaccuaggaagcgacauggaggugucgggccucaccgaucugugcgaaauugaggagcuuaagagcaaaaaguuggcacuggcgcccuguaaccaggcugguauggggguagucggaaaagugggcgaaauccaaugcucuagugaggaauccgcccggacaauuaagaaggacgguuguaucuggaacgcagaucucguuggcauagagcugagaguggacgaugccgucugcuauagcaaaauuacuucuguggaagcuguugccaauuacagcgcaaucccgaccacaauugggggacuuagguucgagcgcucccaugacucacagggcaagaucagugggagcccucuggauauaaccgcuauccgaggaucuuuuuccgugaacuaccggggcuugcgucucucacugagugagauuacugccacguguacaggugaaguaaccaaugucagcgggugcuauuccugcaugacuggagcgaaagugucuaucaaguuacacucgagcaaaaacucaaccgcccaugugagauguaagggcgacgagacagcuuucuccguccuggaagguguucacaguuacaccgugucucuaucauuugaucacgcaguaguggacgagcagugccagcucaauuguggcgggcaugaaucccaagucacucugaagggaaaccuuauuuucuuggacgugccaaaauuuguugauggcucauauaugcagacauaccacucuacggugcccaccggggccaauaucccuagccccacugacuggcugaacgcucucuucggaaauggccugaguagguggauauuaggugucauuggggugcugcuuggaggcuuggcccucuuuuucaugaucaugucccuguuuaagcuaggcacaaaacagguuuuccgcagccggaccaagcuggcauga

SEQ ID NO: 11571 - RNA, 3222 nt, Artificial Sequence
  derived and/or modified CDS sequence (opt3) from SFTSV(HNXY_144)__KC292307.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcggacggucucaugucugaugggaaaguugauggaucguggucgccaggugauccaugaggaaauuggcgagaacagagaggggaaucaggacgauguuaggaucgaaauggcgcggccccgacgcgugagacacuggauguauagcccaguaauccuaacuauucuggccauaggacucgcagagucuugcgacgaaaugguccaugcugauuccaaacuggugaguuguaggcagggcagcgguaacaugaaggagugcguuacaaccgggcgggcccuucugccugcugugaaucccggccaagaggccuguuugcacuucacugcaccaggaucucccgacuccaagugccucaaaaucaaggucaaacgcauuaaccugaaguguaaaaagucaaguagcuacuuugugccugaugccagaucgaggugcacauccguacgucggugucgaugggcuggcgacugccagucugggugcccaccgcauuucaccagcaauucauuuagugacgauugggcgggaaagauggacagagcaggcuuagguuucuccggguguucugauggaugcggcggugccgcuuguggcugcuuuaacgccgcacccagcuguaucuucuggaggaaauggguggaaaauccucacgggauuaucuggaagguuuccccaugcgccgcuuggguccccucagccgugauagagcugacgaugccuagcggagaagugcgcaccuuccacccaaugaguggcauccccacacaggucuuuaaagggguuucugugacuuaucuaggauccgacauggaggugagcggccucaccgaucugugugaaauugaggagcuuaagucgaaaaaguuggcacuggcgccgugcaaccaggcugguauggggguagucggaaaagugggcgaaauccaauguucaucugaggaaagugcccggacaauuaagaaggacgguugcaucuggaacgcagaucucguuggcauagagcugagaguggacgaugccgucuguuacuccaaaauuacuagcguggaagcuguugccaauuauucugcaaucccuaccacaauugggggacuuagguucgagcgcagccaugacucccagggcaagaucucagggaguccacuggauauaaccgcuauccgaggcagcuuuucugugaacuaccggggauugcgucucucccugucagagauuacugccacgugcacaggugaaguaaccaaugucagugggugcuacagcuguaugacuggagcgaaaguguccaucaaguuacacucuucgaaaaacagcaccgcccaugugagaugcaagggcgacgagacagcuuucucaguccuggaagguguucacuccuauaccgugagucuaucuuuugaucacgcaguaguggacgagcagugucagcucaauugcggcgggcaugaaagccaagucacucugaagggaaaccuuauuuucuuggacgugcccaaauuuguugauggcuccuacaugcagacauaucacucaacggugccuaccggggccaauauccccucuccaacugacuggcugaacgcucucuucggaaauggccugaguagguggauauuaggugucaugggggugcugcuuggaggcuuggcccucuuuuucaugauuaugagccuguuuaagcuaggcacaaaacagguuuuccgcucccggaccaagcuggcauga

SEQ ID NO: 11572 - RNA, 3222 nt, Artificial Sequence
  derived and/or modified CDS sequence (opt3) from SFTSV(HNXY_157)__KC292305.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcaauagggucuuguggaucggggacguggcuugucagccaaugacgcccauuccugaagagaccuuccucgagcugaagucguuuucucaguccgaauuuccagauaucugcaaaauagacggaauuguauuuaaccagugugagggcgaaucacugccgcaacccuucgauguugccuggauggacgugggccacagucauaagaucauuaugcgggagcacaaaacaaaguggguccaggagagcuccucuaaggauuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaucagccugagcaacgaaucggacagugcacuggcugucaccuggaaugcaucaacgggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggacggcacugaauuuaccuucgaggguagcuguauguuuccagaugggugcgacgccguagauugcacauucuguagggaauuucugaagaauccccaaugcuauccggcuaaaaaguggcuuuucauuaucauaguuauucuguugggcuacgccggacucaugcuguuaaccaacgugcugaaggcaaucggcaucuggggguccugggucauugcuccugugaaacucaucuuugccauuauaaagaaacuuaugcggacggucucaugucugaugggaaaguugauggaccguggucgccaggugauccaugaggaaauuggcgagaauagagaggggaaccaggaugacguuaggaucgaaauggcgcggccccgacgcgugagacacuggauguauagcccaguaauccuaacuauucuggccauaggacucgcagagucuugcgaugaaaugguccaugcugacuccaaacuggugaguuguaggcagggcagcgguaauaugaaggagugcguuacaaccgggcgggcccuucugccugcugugaaccccggccaagaggccuguuugcacuucacugcaccaggaucucccgauuccaagugccuccgcaucaaagucaagagaauuaaucugaaauguaagaaaucaaguagcuacuuugugccugacgccaggucgcguugcacauccguacggcgauguagaugggcuggcgauugccagucugggugcccaccgcauuucaccagcaacucauuuagugacgacugggcgggaaagauggauagggcaggcuuagguuucuccggguguucugacggaugcggcggugccgcuuguggcugcuuuaaugccgcacccagcuguaucuucuggcgcaaguggguggaaaacccucacgggauuaucuggaaaguuuccccaugcgccgcuuggguccccucagccgugauagagcugacgaugccuagcggagaagugcggaccuuccacccaaugaguggcauccccacacaggucuuuaaggggguuucugugacuuaucuaggauccgauauggaggugagcggccucaccgaccugugugaaauugaggagcuuaaaucgaagaaauuggcacuggcgccgugcaaccaggcugguauggggguagucggaaaggugggcgaaauccaauguucaucugaggaaagugccagaacaauuaaaaaggaugguugcaucuggaaugcagaccucguuggcauagagcugaggguggaugacgccgucuguuacuccaagauuacuagcguggaagcuguugccaacuauucugcaaucccuaccacaauugggggacuucgcuucgagcgaagccaugauucccagggcaaaaucucagggaguccacuggacauaaccgcuauccggggcagcuuuucugugaauuaccguggauugagacucucccugucagagauuacugccacgugcacaggugaaguaaccaacgucagugggugcuacagcuguaugacuggagcgaagguguccaucaaauuacacucuucgaagaauagcaccgcccaugugaggugcaaaggcgaugagacagcuuucucaguccuggaagguguucacuccuauaccgugagucuaucuuuugaccacgcaguaguggaugagcagugucagcucaacugcggcgggcaugaaagccaagucacucugaagggaaaucuuauuuucuuggacgugcccaaguuuguugacggcuccuacaugcagacauaucacucaacggugccuaccggggccaacauccccucuccaacugauuggcugaaugcucucuucggaaacggccugagccgcugggucuuaggugugauggggguucugcuuggaggcuuggcccucuuuuucaugauaaugagucuguuuaaacuaggcacaaaacagguguuccgguccagaaccaagcuggcauga

SEQ ID NO: 11573 - RNA, 3222 nt, Artificial Sequence
  derived and/or modified CDS sequence (opt3) from SFTSV(HNXY_170)__KC292304.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcaauagggucuuguggaucggggacguggcuugucagccaaugacgcccauuccugaagagaccuuccucgagcugaagucguuuucucaguccgaauuuccagauaucugcaaaauagacggaauuguauuuaaccagugugagggcgaaucacugccgcaacccuucgauguugccuggauggacgugggccacagucauaagaucauuaugcgggagcacaaaacaaaguggguccaggagagcuccucuaaggauuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaucagccugagcaacgaaucggacagugcacuggcugucaccuggaaugcaucaacgggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggacggcacugaauuuaccuucgaggguagcuguauguuuccagaugggugcgacgccguagauugcacauucuguagggaauuucugaagaauccccaaugcuauccggcuaaaaaguggcuuuucauuaucauaguuauucuguugggcuacgccggacucaugcuguuaaccaacgugcugaaggcaaucggcaucuggggguccugggucauugcuccugugaaacucaucuuugccauuauaaagaaacuuaugcggacggucucaugucugaugggaaaguugauggaccguggucgccaggugauccaugaggaaauuggcgagaauagagaggggaaccaggaugacguuaggaucgaaauggcgcggccccgacgcgugagacacuggauguauagcccaguaauccuaacuauucuggccauaggacucgcagagucuugcgaugaaaugguccaugcugacuccaaacuggugaguuguaggcagggcagcgguaauaugaaggagugcguuacaaccgggcgggcccuucugccugcugugaaccccggccaagaggccuguuugcacuucacugcaccaggaucucccgauuccaagugccuccgcaucaaagucaagagaauuaaucugaaauguaagaaaucaaguagcuacuuugugccugacgccaggucgcguugcacauccguacggcgauguagaugggcuggcgauugccagucugggugcccaccgcauuucaccagcaacucauuuagugacgacugggcgggaaagauggauagggcaggcuuagguuucuccggguguucugacggaugcggcggugccgcuuguggcugcuuuaaugccgcacccagcuguaucuucuggcgcaaguggguggaaaacccucacgggauuaucuggaaaguuuccccaugcgccgcuuggguccccucagccgugauagagcugacgaugccuagcggagaagugcggaccuuccacccaaugaguggcauccccacacaggucuuuaaggggguuucugugacuuaucuaggauccgauauggaggugagcggccucaccgaccugugugaaauugaggagcuuaaaucgaagaaauuggcacuggcgccgugcaaccaggcugguauggggguagucggaaaggugggcgaaauccaauguucaucugaggaaagugccagaacaauuaaaaaggaugguugcaucuggaaugcagaccucguuggcauagagcugaggguggaugacgccgucuguuacuccaagauuacuagcguggaagcuguugccaacuauucugcaaucccuaccacaauugggggacuucgcuucgagcgaagccaugauucccagggcaaaaucucagggaguccacuggacauaaccgcuauccggggcagcuuuucugugaauuaccguggauugagacucucccugucagagauuacugccacgugcacaggugaaguaaccaacgucagugggugcuacagcuguaugacuggagcgaagguguccaucaaauuacacucuucgaagaauagcaccgcccaugugaggugcaaaggcgaugagacagcuuucucaguccuggaagguguucacuccuauaccgugagucuaucuuuugaccacgcaguaguggaugagcagugucagcucaacugcggcgggcaugaaagccaaauuacucugaagggaaaucuuaucuucuuggacguccccaaguuuguggacggcuccuacaugcagacauaucacucaacgguuccuaccggggccaacauacccucuccaacugauuggcugaaugcucucuucggaaacggccugagccgcuggguguuaggugucauuggggugcugcuuggaggcuuggcccucuuuuucaugaucaugagucuguuuaaacuaggcacaaagcagguuuuccgguccagaaccaaacuggcauga

SEQ ID NO: 11574 - RNA, 3222 nt, Artificial Sequence
  derived and/or modified CDS sequence (opt3) from SFTSV(HNXY_174)__KC292306.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugccggauagauggaauuguauuuaaucagugugagggcgaaucacugccgcaacccuucgacguugccuggauggaugugggccacagucauaaaaucauuaugcgcgagcacaagacaaaauggguccaggagagcuccucuaaggacuuugugugcuauaaggaagggacuggaccuuguagcgagucagaagagaaaaccugcaagacaagugguuccugcagaggcgacaugcaguucuguaaaguggcagggugcgaacacggagaggaggccagcgaagcuaaguguaggugcucucucguccauaaaccaggcgagguugugguaucauacggugggaugcgggugcgccccaaguguuacggcuuuagucgaaugauggcaaccuuagaagucaaccagccugagcaaagaaucggacagugcacuggcugucaccuggaaugcaucaaugggggagugaggcuuauuacauugaccagcgagcugaaauccgccacgguuugugcuucucauuucugcucgagcgccacuuccgguaagaagucaaccgagauacaguuccacaguggcucucuaguggggaaaacagcgauccacgucaagggagcacucguggauggcacugaauuuaccuucgaggguagcuguauguuuccagacgggugcgaugccguagacugcacauucugucgggaauuucugaaaaacccccaaugcuauccggcuaagaaauggcuuuucauuaucauaguuauucuguugggcuacgccggacucaugcuguuaaccaaugugcugaaggcaaucggcaucuggggguccugggucauugcuccugugaagcucaucuuugccauuauaaagaaacuuaugcguacggucucaugucugaugggaaaauugauggaucgcgguagacaggugauccaugaggaaauuggcgagaacagggaggggaaucaggacgauguucggaucgaaauggcgcgaccccgcagagugaggcacuggauguauagcccaguaauccuaacuauucuggccauaggacucgcagagucuugcgacgaaaugguccaugcugauuccaagcuggugaguugucggcagggcagcgguaacaugaaagagugcguuacaaccgggcgcgcccuucugccugcugugaaucccggccaagaggccuguuugcacuucacugcaccaggaucucccgacuccaagugccucagaaucaaggucaaaaggauuaaccugaaguguaaaaagucaaguagcuacuuugugccugaugcccguucgcggugcacauccguacgaagauguaggugggcuggcgacugccagucugggugcccaccgcauuucaccagcaauucauuuagugacgauugggcgggaaaaauggaccgcgcaggcuuagguuucuccggguguucugauggaugcggcggugccgcuuguggcugcuuuaacgccgcacccagcuguaucuucuggcggaaguggguggaaaauccucacgggauuaucuggaagguuuccccaugcgccgcuuggguccccucagccgugauagagcugacgaugccuagcggagaagugagaaccuuccacccaaugaguggcauccccacacaggucuuuaaagggguuucugugacuuaucuaggauccgacauggaggugagcggccucaccgaucugugugaaauugaggagcuuaagucgaaaaaguuggcacuggcgccgugcaaccaggcugguauggggguagucggaaaagugggcgaaauccaauguucaucugaggaaagugccaggacaauuaagaaagacgguugcaucuggaacgcagaucucguuggcauagagcugcgcguggacgaugccgucuguuacuccaagauuacuagcguggaagcuguugccaauuauucugcaaucccuaccacaauugggggacuucgauucgagcggagccaugacucccagggcaagaucucagggaguccacuggauauaaccgcuauccguggcagcuuuucugugaacuacagaggauugaggcucucccugucagagauuacugccacgugcacaggugaaguaaccaaugucagugggugcuacagcuguaugacuggagcgaaaguguccaucaaguuacacucuucgaaaaacagcaccgcccaugugcgcugcaagggcgacgagacagcuuucucaguccuggaagguguucacuccuauaccgugagucuaucuuuugaucacgcaguaguggacgagcagugucagcucaauugcggcgggcaugaaagccaagucacucugaaaggaaaccuuauuuucuuggacgugcccaaguuuguugauggcuccuacaugcagacauaucacucaacggugccuaccggggccaauauccccucuccaacugacuggcugaacgcucucuucggaaauggcaugagccgguggauacugggugucauggggguguuacugggaggccuugccuuguuuuucaugauuaugagucucuuuaagcugggcacaaaacagguuuucagauccaggaccaagcuagcauga

SEQ ID NO: 11575 - RNA, 3222 nt, Artificial Sequence
  derived and/or modified CDS sequence (opt3) from SFTSV(HNXY_182)__KC292324.1__GP
augaugaaggugaucugguucagcucccugauuugcuuugucauacaguguucuggcgacucagggcccaucauuugcgccggaccuauccacaguaacaaaagcgcugauauuccacaucuccaagguuacuccgagaagaucugucagauagacagacuuauccacguuucuucguggcugaggaaucauucacaguuccagggcuauguggggcaacggggaggccgcagccagguaaguuacuauccggcagaaaacuccuacucucgauggagcgguuuguuaucccccugcgaugccgacuggcuggggaugcuaguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcucugcucaagcgauaguggcacuucuuccggucugcuuccuagcgacaggguccuguggaucggggauguggcuugucagccaaugacgcccauuccugaagagaccuucuuggagcucaagucguuuucucaguccgaauuuccagacaucugcaaaauagauggaauuguauuuaaucaaugugagggcgaaucacugccgcagcccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucugguccauaagccaggcgagguugugguaucauacggugggaugagggugcggcccaaauguuacggcuuuagucgcaugauggcaacccucgaagucaaccaaccugagcagcgaaucggacagugcacuggcugucacuuagaaugcaucaaugggggagugagacugauuacacuuaccagcgaguugaaguccgccacgguuugugcuucucauuucugcucgagcgccacuuccgguaagaaaucaaccgagauacaauuccacaguggcucucugguggggaagacagcgauccacgucaaaggagcacuuguggauggcacugaauuuaccuucgaggguagcuguauguuuccagacgggugcgaugccguagacugcacauucuguagggaauuucucaagaacccccagugcuauccggcuaaaaaguggcuguucauuaucauaguuauucuucugggcuacgccggauugaugcuccugaccaauguguuaaaggcaaucggcaucuggggguccugggucauugcuccugugaaacugaucuuugccauuauaaagaaacucaugcggacggucucaugucuuaugggaaagcugauggaucguggucgccaggugauccaugaggaaauuggcgagaacagagaggggaaucaggacgauguuaggaucgaaauggcgcggccccgacgcgugagacacuggauguauagcccaguaaucuugacuauucuagccauaggacuggcagagucuugcgacgaaaugguccaugcugauuccaaacucgugaguuguaggcaaggcagcgguaacaugaaggagugcguuacaaccgggcgggcccugcuuccugcugugaaucccggccaggaggccugucugcacuucacugcaccaggaucucccgacuccaagugcuugaaaaucaaggucaaacgcauuaaccucaaguguaaaaagucaaguagcuacuuugugccugaugccagaucgaggugcacauccguacgucggugucgaugggcuggcgacugccagucugggugcccaccgcauuucaccagcaauucauuuagugacgauugggcgggaaagauggacagagcaggccuggguuucuccggguguucugauggaugcggcggugccgcuuguggcugcuuuaacgccgcacccagcuguaucuucuggaggaaauggguggaaaauccucacgggauuaucuggaagguuuccccaugcgccgcuuggguccccucagccgugauagaguuaacgaugccuagcggagaagugcgcaccuuccacccaaugaguggcauccccacacaggucuuuaaagggguuucugugacuuaucugggauccgacauggaggugagcggccuaaccgaucucugugaaauugaggagcugaagucgaaaaagcuagcauuggcgccgugcaaccaagcugguauggggguagucggaaaagugggcgaaauccaguguucaucugaggaaagugcccggacaauuaagaaggacgguugcaucuggaacgcagaucugguuggcauagagcucagaguggacgaugccgucuguuacuccaaaauuacuagcguggaagcuguugccaauuauucugcaaucccuaccacaauugggggacugagguucgagcgcagccaugacucccagggcaagaucucagggaguccacuugauauaaccgcuauccgaggcagcuuuucugugaacuaccggggacugcguuugucccucucagagauuacugccacgugcacaggugaaguaaccaaugucagugggugcuacagcuguaugacuggagcgaaaguguccaucaagcugcacucuucgaaaaacagcaccgcccaugugagaugcaagggcgacgagacagcuuucucagucuuagaagguguucacuccuauaccgugagucugucuuuugaucacgcaguaguggacgagcagugucaacuaaauugcggcgggcaugaaagccaggucacucucaagggaaaccugauuuuccuugacgugcccaaauuuguugauggcuccuacaugcagacauaucacucaacggugccuaccggggccaauauccccucuccaacugacugguugaacgcucuguucggaaauggccucaguagguggauacuggguuuaauugggguccugcuuggaggcuuggcccucuuuuucaugaucaugagccuguuuaagcuaggcacaaaacagguguuccgcucccggaccaagcuggcauga

SEQ ID NO: 11576 - RNA, 3222 nt, Artificial Sequence
  derived and/or modified CDS sequence (opt3) from SFTSV(HNXY_188)__KC292301.1__GP
augaugaaggugaucugguucagcucccugauuugccucgucauacaguguggcgggggaaccggucccaucauuugcgccggcccuauccacucuaacaaaucagcugacauuccacaucuucugggguacagugagaagaucugucaaauagauagauugauccacguuagcuccugguuaaggaaucauucucaguuucagggauaugugggccagcggggugggcgcucgcaaguaucauacuauccggcagaaaacagcuacagucgaugguccggacugcuaucucccugcgacgccgauuggcucggcaugcugguggucaaaaaggcgaaaggcagcgacaugauugugccugggccauccuauaagggaaagguuuucuuugagcgucccacauucgaugguuacgugggcuggggguguggaucaggcaaaaguagaacugaaagcggugagcuuugcaguuccgacucagggacgagcaguggacuguugccuucugauaggguccucuggaucggcgacguggcuugucagccaaugacccccauuccugaagagacauuucuggagcugaaguccuucagccagucggaauuuccagauaucugcaaaauagacggcauuguauucaaucagugugagggggaaucucucccgcaacccuuugauguugccuggauggacgugggacacucccauaagaucauuaugcgggagcacaaaacuaaguggguccaggagucaaguagcaaggauuucgugugcuauaaagaagguaccggcccuuguuccgagucugaagagaagacaugcaaaaccagcgggucaugccgcggagacaugcaguuuuguaagguggcaggcugcgaacacggugaggaggccagugaagcuaaauguagaugcuccuuaguccauaagccaggggagguugugguaagcuacggcggaaugagggugcggcccaaauguuacggcuucucucgcaugauggcaacucuggaagucucacagccugagcaacgaaucgggcagugcacaggaugucaccuugaaugcaucaacgguggcgugagauugauuacccugacgagugagcuaaagagcgccacuguuugugcuucccauuuuuguucuucggccaccagcgggaagaaauccacagagauacaguuccacucaggaagucucgugggcaagacugcgauccacgucaaaggugcacugguggacgggaccgaguucacauuugaaggcucuugcauguucccagauggaugcgacgccguagauugcaccuuuuguagggaguuccuuaagaauccccaaugcuauccggcuaaaaaguggcuguuuauuaucauaguuauuuugcucggcuacgccgggcugauguuacugacgaacgugcucaaggcaaucggagucugggguagcugggugaucgcuccugucaaacuuguguucgccauuaucaagaaacugaugcgggcgguuuccuguuugaugggcaagcuaauggaccgugggcgccaggugauucaugaagaaauaggagagaauagagagggcaaccaggaugacguaaggaucgaaauggcccggccccgacgcgucagacacuggauguauucaccagugauucugacuauccucgcaaucggucuggcugaggggugcgaugaaaugguucaugccgacagcaaacuugugucuuguaggcagggcuccggaaauaugaaggagugcgucacaaccggccgggcucuguugccugccgugaaccccgggcaagaggcaugucuccacuuuacugccccaggaagucccgauagcaagugccugaaaauuaagguaaaacgcauaaauuuaaaguguaaaaagucuuccucauacuucgugccugacgcuagaaguaggugcacaagcguucgucggugucgaugggcgggcgauugccagucggguugcccaccgcauuuuaccuccaacucuuucagcgacgacugggcagggaagauggauagagccggacugggcuuuucagguuguagugacggcugcgggggagcugccuguggcugcuucaaugcagcccccuccuguaucuuuuggaggaaaugggucgaaaacccucacgggauuaucuggaaggugucuccaugcgcugccugggugcccagcgcagucauugagcuaacgaugccuuccggagaaguucgcaccuuccacccaaugucaggcauccccacacagguguucaaaggugugagcguaacuuaucucgggagugauauggaggucucuggacugaccgaccuuugugaaauagaggaguugaaguccaaaaagcuggcgcucgcuccgugcaaucaggccggcaugggugugguuggcaaagugggggaaauccaauguagcucggaggaaucagcacggacaauuaagaaggauggaugcaucuggaacgccgaccuggucggcauugagcuuagaguggaugacgcuguuuguuacucuaaaaucacuucuguggaagccguagcaaacuauuccgcuauaccuaccacaauugggggacugagguuugagcgcagccaugauucucagggcaagaucagcgguuccccauuggacauuaccgccauccgagggucauucagugucaauuaccggggacuccgucugagcuuaucugagauaacugcgacgugcacaggcgaagugaccaacguguccgguugcuacucauguaugacuggcgccaaagucaguaucaagcugcacagcuccaaaaauucuaccgcucauguuagaugcaagggggaugagacagcauuuucggugcuagaaggaguacacagcuauucagugucccucaguuucgaccacgccgucguggaugagcagugucagcugaacugcggcgggcaugaaucucaaguuacccuuaggggaaauuugauuuuucuggacgugcccaaguucgucgacggcagcuacaugcagacuuaucacuccacagugccuacgggugcuaacauccccucaccaaccgauuggcucaaugcccuguuugggaacggauuaucucgcuggauucugggcguuaucggcgugcuucucgggggauuggcacuguucuuucuaauaaugagccuguucaaacucgguacuaagcagauuuuucggaguagaacaaaacuggcguga

SEQ ID NO: 11577 - RNA, 3222 nt, Artificial Sequence
  derived and/or modified CDS sequence (opt3) from SFTSV(HNXY_191)__KC292323.1__GP
augaugaaggugaucugguucagcucccugauuugccucgucauacaguguggcggggacaccggacccaucauuugcgccgguccuacacacucuaacaaaucagcugauaucccacaucuucugggcuacagugagaagauuugucaaaucgacagauugauacacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugaucgugccuggcccauccuauaaggggaagguuuucuuugagcgucccacuuucgacggauacguggguuggggcugugggucaggaaaaaguagaacggaaagcggcgagcuuugcaguuccgauucagguaccagcagugggcuguugccuucugacaggguccucuggauuggagauguggcuugucagccaaugacacccaucccugaagagacuuuucuggagcugaaguccuucagccagucggaauuuccagacauuugcaaaaucgauggcauaguauucaaucagugugagggcgaaucucucccgcaacccuuugacguugccuggauggauguggggcacucccauaagauuaucaugcgggagcacaaaaccaaguggguccaggagucaaguagcaaggacuucgugugcuauaaagaaggaacagguccuuguuccgagucugaagagaagaccugcaaaacuagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacacuggaagucucacagccugagcaacgaauuggccagugcaccgggugucaccuugaaugcaucaacggaggugugagauugaucacgcugacuucugagcuaaagagcgccaccguuugugcuucccauuuuuguucuucggccacaagcggcaagaaauccacugagauucaguuccacucagggagucucgugggaaagaccgcgauacacgucaaaggcgcacugguggaugguacagaguucaccuuugaagggucuugcauguucccagacggcugcgaugccguagacugcacguuuuguagggaguuccuuaagaauccccaaugcuauccggcuaaaaaguggcuguuuaucauuaucguuauauugcucggauacgccggccugauguuacugacuaacgugcucaaggcaauuggggucuggggaagcugggugaucgcuccugucaaacuuguguucgccaucauuaagaaacugaugcgggcgguuuccuguuugauggguaagcuaauggaucguggccgccaggugauccaugaagaaauuggggagaauagagagggaaaccaggacgauguaaggauagaaauggcccggccccgacgcgucagacacuggauguauucaccagugauccugacaauucucgcaaucggccuggcugaggguugcgacgaaaugguucaugccgauagcaaacuugugucuuguaggcagggguccggcaauaugaaggagugcgucaccacuggacgggcucuguugccugccgugaaccccggccaagaggcaugucuccacuuuacagccccagggagucccgacagcaagugccugaaaaucaagguaaaacgcauuaauuuaaaguguaaaaagucuuccucauacuucgugccugaugcuagaaguaggugcaccagcguucgucggugucgaugggcgggagacugccagucgggcugcccaccgcauuuuacguccaacucuuucagcgacgauugggcagguaagauggacagagccgggcugggauuuucaggcuguagugaugguugcggcggggcugccuguggaugcuucaaugcagcccccuccuguauauuuuggaggaaaugggucgaaaacccucacggcaucauuuggaaggugucuccaugcgcugccugggugcccagcgcagucaucgagcuaaccaugccuuccggggaaguucgcacauuccacccaaugucaggcauucccacucagguguucaaaggagugagcguaaccuaucucgguagugacauggaggucucugggcugacagaucuuugugaaaucgaggaguugaaguccaaaaagcuggcgcucgcuccgugcaaucaggccggaaugggcgugguugguaaagugggcgaaauacaauguagcucggaggaaucagcacggacuaucaagaaggacgggugcauuuggaacgccgaucuggucggaaucgagcuuagaguggacgaugcuguuuguuacucuaaaauuaccaguguggaagccguagcaaacuauuccgcuaucccuacaaccauaggcgggcugagguuugagcgcagccaugacucucagggaaagauuagcggcuccccauuggauaucacugccauucgagguucauucagugucaauuaccgggggcuccgucugagcuuaucugagaucacggcgacaugcaccggagaagugacuaacguguccggcugcuacucauguaugaccggugccaaagucaguauaaagcugcacagcuccaaaaauucuacagcucauguuagaugcaagggcgacgagaccgcauuuucggugcuagaagggguacacagcuauucagugucccucaguuucgaucacgccgucguggacgagcagugucagcugaacugcggaggccaugaaucucaaguuacucuuagggggaauuugaucuuucuggacgugcccaaguucgucgauggaagcuacaugcagacauaucacuccacggugccuaccggcgcuaacauucccucaccaacugacuggcucaaugcccuguuugguaacggguuaucucgcuggauccugggaguuauuggcgugcuuuugggcgggcucgcacuguucuuucuaaucaugagccuguucaaacucggaacaaagcagauauuucggaguagaaccaaacuggcguga

SEQ ID NO: 11578 - RNA, 3222 nt, Artificial Sequence
  derived and/or modified CDS sequence (opt3) from SFTSV(HNXY_195)__KC292326.1__GP
augaugaaggugaucugguucagcucccugauuugcuuugucauacaguguucuggcgacucagggcccaucauuugcgccggaccuauccacaguaacaaaagcgcugauauuccacaucuccaagguuacuccgagaagaucugucagauagacagacuuauccacguuucuucguggcugaggaaucauucacaguuccagggcuauguggggcaacggggaggccgcagccagguaaguuacuauccggcagaaaacuccuacucucgauggagcgguuuguuaucccccugcgaugccgacuggcuggggaugcuaguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcucugcucaagcgauaguggcacuucuuccggucugcuuccuagcgacaggguccuguggaucggggauguggcuugucagccaaugacgcccauuccugaagagaccuucuuggagcucaagucguuuucucaguccgaauuuccagacaucugcaaaauagauggaauuguauuuaaucaaugugagggcgaaucacugccgcagcccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucugguccauaagccaggcgagguugugguaucauacggugggaugagggugcggcccaaauguuacggcuuuagucgcaugauggcaacccucgaagucaaccaaccugagcagcgaaucggacagugcacuggcugucacuuagaaugcaucaaugggggagugagacugauuacacuuaccagcgaguugaaguccgccacgguuugugcuucucauuucugcucgagcgccacuuccgguaagaaaucaaccgagauacaauuccacaguggcucucugguggggaagacagcgauccacgucaaaggagcacuuguggauggcacugaauuuaccuucgaggguagcuguauguuuccagacgggugcgaugccguagacugcacauucuguagggaauuucucaagaacccccagugcuauccggcuaaaaaguggcuguucauuaucauaguuauucuucugggcuacgccggauugaugcuccugaccaauguguuaaaggcaaucggcaucuggggguccugggucauugcuccugugaaacugaucuuugccauuauaaagaaacucaugcggacggucucaugucuuaugggaaagcugauggaucguggucgccaggugauccaugaggaaauuggcgagaacagagaggggaaucaggacgauguuaggaucgaaauggcgcggccccgacgcgugagacacuggauguauagcccaguaaucuugacuauucuagccauaggacuggcagagucuugcgacgaaaugguccaugcugauuccaaacucgugaguuguaggcaaggcagcgguaacaugaaggagugcguuacaaccgggcgggcccugcuuccugcugugaaucccggccaggaggccugucugcacuucacugcaccaggaucucccgacuccaagugcuugaaaaucaaggucaaacgcauuaaccucaaguguaaaaagucaaguagcuacuuugugccugaugccagaucgaggugcacauccguacgucggugucgaugggcuggcgacugccagucugggugcccaccgcauuucaccagcaauucauuuagugacgauugggcgggaaagauggacagagcaggccuggguuucuccggguguucugauggaugcggcggugccgcuuguggcugcuuuaacgccgcacccagcuguaucuucuggaggaaauggguggaaaauccucacgggauuaucuggaagguuuccccaugcgccgcuuggguccccucagccgugauagaguuaacgaugccuagcggagaagugcgcaccuuccacccaaugaguggcauccccacacaggucuuuaaagggguuucugugacuuaucugggauccgacauggaggugagcggccuaaccgaucucugugaaauugaggagcugaagucgaaaaagcuagcauuggcgccgugcaaccaagcugguauggggguagucggaaaagugggcgaaauccaguguucaucugaggaaagugcccggacaauuaagaaggacgguugcaucuggaacgcagaucugguuggcauagagcucagaguggacgaugccgucuguuacuccaaaauuacuagcguggaagcuguugccaauuauucugcaaucccuaccacaauugggggacugagguucgagcgcagccaugacucccagggcaagaucucagggaguccacuugauauaaccgcuauccgaggcagcuuuucugugaacuaccggggacugcguuugucccucucagagauuacugccacgugcacaggugaaguaaccaaugucagugggugcuacagcuguaugacuggagcgaaaguguccaucaagcugcacucuucgaaaaacagcaccgcccaugugagaugcaagggcgacgagacagcuuucucagucuuagaagguguucacuccuauaccgugagucugucuuuugaucacgcaguaguggacgagcagugucaacuaaauugcggcgggcaugaaagccaggucacucucaagggaaaccugauuuuccuugacgugcccaaauuuguugauggcuccuacaugcagacauaucacucaacggugccuaccggggccaauauccccucuccaacugacugguugaacgcucuguucggaaauggccucaguagguggauacugggugucauugggguguuacugggaggccuugccuuguuuuucaugaucaugagccucuuuaagcugggcacaaaacagguuuuccgcucccggaccaagcuagcauga

SEQ ID NO: 11579 - RNA, 3222 nt, Artificial Sequence
  derived and/or modified CDS sequence (opt3) from SFTSV(HNXY_2)__KC292318.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcggacggucucaugucugaugggaaaguugauggaucguggucgccaggugauccaugaggaaauuggcgagaacagagaggggaaucaggacgauguuaggaucgaaauggcgcggccccgacgcgugagacacuggauguauagcccaguaauccuaacuauucuggccauaggacucgcagagucuugcgacgaaaugguccaugcugauuccaaacuggugaguuguaggcagggcagcgguaacaugaaggagugcguuacaaccgggcgggcccuucugccugcugugaaucccggccaagaggccuguuugcacuucacugcaccaggaucucccgacuccaagugccucaaaaucaaggucaaacgcauuaaccugaaguguaaaaagucaaguagcuacuuugugccugaugccagaucgaggugcacauccguacgucggugucgaugggcuggcgacugccagucugggugcccaccgcauuucaccagcaauucauuuagugacgauugggcgggaaagauggacagagcaggcuuagguuucuccggguguucugauggaugcggcggugccgcuuguggcugcuuuaacgccgcacccagcuguaucuucuggaggaaauggguggaaaauccucacgggauuaucuggaagguuuccccaugcgccgcuuggguccccucagccgugauagagcugacgaugccuagcggagaagugcgcaccuuccacccaaugaguggcauccccacacaggucuuuaaagggguuucugugacuuaucuaggauccgacauggaggugagcggccucaccgaucugugugaaauugaggagcuuaagucgaaaaaguuggcacuggcgccgugcaaccaggcugguauggggguagucggaaaagugggcgaaauccaauguucaucugaggaaagugcccggacaauuaagaaggacgguugcaucuggaacgcagaucucguuggcauagagcugagaguggacgaugccgucuguuacuccaaaauuacuagcguggaagcuguugccaauuauucugcaaucccuaccacaauugggggacuuagguucgagcgcagccaugacucccagggcaagaucucagggaguccacuggauauaaccgcuauccgaggcagcuuuucugugaacuaccggggauugcgucucucccugucagagauuacugccacgugcacaggugaaguaaccaaugucagugggugcuacagcuguaugacuggagcgaaaguguccaucaaguuacacucuucgaaaaacagcaccgcccaugugagaugcaagggcgacgagacagcuuucucaguccuggaagguguucacuccuauaccgugagucuaucuuuugaucacgcaguaguggacgagcagugucagcucaauugcggcgggcaugaaagccaagucacucugaagggaaaccuuauuuucuuggacgugcccaaauuuguugauggcuccuacaugcagacauaucacucaacggugccuaccggggccaauauccccucuccaacugacuggcugaacgcucucuucggaaauggcaugaguagguggauacugggugucauugggguguuacugggaggccuugccuuguuuuucaugaucaugagccucuuuaagcugggcacaaaacagguuuuccgcucccggaccaagcuagcauga

SEQ ID NO: 11580 - RNA, 3222 nt, Artificial Sequence
  derived and/or modified CDS sequence (opt3) from SFTSV(HNXY_202)__KC292325.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcaauagggucuuguggaucggggacguggcuugucagccaaugacgcccauuccugaagagaccuuccucgagcugaagucguuuucucaguccgaauuuccagauaucugcaaaauagacggaauuguauuuaaccagugugagggcgaaucacugccgcaacccuucgauguugccuggauggacgugggccacagucauaagaucauuaugcgggagcacaaaacaaaguggguccaggagagcuccucuaaggauuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaucagccugagcaacgaaucggacagugcacuggcugucaccuggaaugcaucaacgggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggacggcacugaauuuaccuucgaggguagcuguauguuuccagaugggugcgacgccguagauugcacauucuguagggaauuucugaagaauccccaaugcuauccggcuaaaaaguggcuuuucauuaucauaguuauucuguugggcuacgccggacucaugcuguuaaccaacgugcugaaggcaaucggcaucuggggguccugggucauugcuccugugaaacucaucuuugccauuauaaagaaacuuaugcggacggucucaugucugaugggaaaguugauggaccguggucgccaggugauccaugaggaaauuggcgagaauagagaggggaaccaggaugacguuaggaucgaaauggcgcggccccgacgcgugagacacuggauguauagcccaguaauccuaacuauucuggccauaggacucgcagagucuugcgaugaaaugguccaugcugacuccaaacuggugaguuguaggcagggcagcgguaauaugaaggagugcguuacaaccgggcgggcccuucugccugcugugaaccccggccaagaggccuguuugcacuucacugcaccaggaucucccgauuccaagugccuccgcaucaaagucaagaaaauuaaucugaaguguaaaagaucaaguagcuacuuugugccugacgccaggucgcguugcacauccguacggcgauguagaugggcuggcgauugccagucugggugcccaccgcauuucaccagcaacucauuuagugacgacugggcgggaaagauggauagggcaggcuuagguuucuccggguguucugacggaugcggcggugccgcuuguggcugcuuuaaugccgcacccagcuguaucuucuggcgcaaguggguggaaaacccucacgggauuaucuggaaaguuuccccaugcgccgcuuggguccccucagccgugauagagcugacgaugccuagcggagaagugcggaccuuccacccaaugaguggcauccccacacaggucuuuaaggggguuucugugacuuaucuaggauccgauauggaggugagcggccucaccgaccugugugaaauugaggagcuuaaaucgaagaaauuggcacuggcgccgugcaaccaggcugguauggggguagucggaaaggugggcgaaauccaauguucaucugaggaaagugccagaacaauuaaaaaggaugguugcaucuggaaugcagaccucguuggcauagagcugaggguggaugacgccgucuguuacuccaagauuacuagcguggaagcuguugccaacuauucugcaaucccuaccacaauugggggacuucgcuucgagcgaagccaugauucccagggcaaaaucucagggaguccacuggacauaaccgcuauccggggcagcuuuucugugaauuaccguggauugagacucucccugucagagauuacugccacgugcacaggugaaguaaccaacgucagugggugcuacagcuguaugacuggagcgaagguguccaucaaauuacacucuucgaagaauagcaccgcccaugugaggugcaaaggcgaugagacagcuuucucaguccuggaagguguucacuccuauaccgugagucuaucuuuugaccacgcaguaguggaugagcagugucagcucaacugcggcgggcaugaaagccaagucacucugaagggaaaucuuauuuucuuggacgugcccaaguuuguugacggcuccuacaugcagacauaucacucaacggugccuaccggggccaacauccccucuccaacugauuggcugaaugcucucuucggaaacggccugagccgcuggauauuaggugucaugggggugcugcuuggaggcuuggcccucuuuuucaugauuaugagucuguuuaaacuaggcacaaagcagguuuuccgguccagaaccaaacuggcauga

SEQ ID NO: 11581 - RNA, 3222 nt, Artificial Sequence
  derived and/or modified CDS sequence (opt3) from SFTSV(HNXY_206)__KC292302.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuuguucuuccgauucagguacgagcagugggcuguugccuucugacaggguccucuggaucggagauguggcuugccagccaaugacccccauuccugaagagacauuucuggagcugaaguccuucagccagucggaauuuccagacaucugcaaaauagauggcauuguauucaaucagugugagggcgaaucucucccgcaacccuuugacguugccuggauggauguggggcacucccauaagaucauuaugcgggagcacaaaacuaaguggguccaggagucaaguagcaaggacuucgugugcuauaaagaaggaaccgguccuuguuccgagucugaagagaagacaugcaaaaccagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacucuggaagucucacagccugagcaacgaaucggccagugcacagggugucaccuugaaugcaucaacggaggugugagauugauuacccugacgagugagcuaaagagcgccacuguuugugcuucccauuuuuguucuucggccaccagcggcaagaaauccacagagauacaguuccacucagggagucucgugggaaagacugcgauccacgucaaaggcgcacugguggaugguaccgaauuuacauuugaggggucuugcauguucccagacggcugcgaugccguagacugcaccuuuuguagggaguuccuuaagaauccccaaugcuauccgacgaaaaaguggcuguuuauuaucauaguuauuuugcucggauacgcuggccugauguuacugacuaacgugcucaaggccaucggggucuggggaagcugggugaucgcaccugucaaacuuguguucgcuauuaucaagaaacugaugcgggccguuuccuguuugauggguaagcuaauggaucguggccgccaggugauucaugaagaaauaggggagaauagagagggaaaccaggacgauaucaggauugaaauggcgcggccccgacgcguaagacacuggauguauucaccagucauccugacaauccucgccauuggccuggcagaggguugcgacgaaauggugcaugcugauagcaaacuuguuucuuguaggcagggguccggcaauaugaaggagugcgugaccacuggacgggcccuguugccugcugucaaccccggccaagaggccugucuccacuuuacaaccccagggagucccgacagcaagugccugaaaauaaaggugaaacgcaucaauuuaaaguguaaaaagucuuccucauacuucguaccugaugcaagaaguaggugcacgagcgugcgucggugucgaugggccggagacugccagucgggcugcccaccgcauuuuaccuccaacucuuucagcgacgauugggcugguaagauggacagagcggggcugggauuuucaggcuguagugaugguugcggcggggcagccuguggaugcuucaaugcugcccccuccuguauuuucuggaggaaauggguugaaaacccucacggcaucauuuggaaggucucuccaugcgcagccugggugcccagcgcugugaucgagcuaacaaugccuuccggggaaguccgcacuuuccacccaaugucaggaauacccacccagguuuucaaaggcgugagcgugacauaucucgguagugacauggagguaucugggcugacugaucuuugugaaaucgaggaguugaaguccaaaaagcuggcccucgcaccgugcaaucaggcgggaaugggcgucguggguaaaguuggcgaaauucaauguagcucggaggaaucagcucggaccaucaagaaggacgggugcauuuggaacgccgaucuggugggaaucgagcuuagagucgacgaugcaguguguuacucuaaaauaacaaguguugaagccguggcuaacuauuccgccauuccuaccacuaucggcgggcugagguuugagcgcagccaugacucucagggaaagauuagcggcuccccauuggauaucacggcaauacgagguucauucaguguaaauuaccgggggcuccgucugagcuuaucugagaucacagcuaccugcacuggagaagucaccaacguguccggcugcuacucauguaugacaggugccaaagugaguauuaagcugcacagcuccaaaaauucuaccgcgcaugucagaugcaagggcgacgagacugccuuuucgguucuagaaggggugcacagcuauucaguaucccucaguuucgaucacgcuguggucgacgagcagugucagcugaacugcggaggccaugaaucucaagugacacuuagggggaauuugaucuuucuggacguucccaaguucguggauggaagcuacaugcagacguaucacuccaccgucccuacuggcgcaaacauucccucaccaacagacuggcucaaugcccuguuugguaacggguuaucucgcuggauccugggagugauaggcguucuuuugggcgggcucgcucuguucuuucuaauuaugagccuguucaaacucggaaccaagcagaucuuucggaguagaacaaaacuggccuga

SEQ ID NO: 11582 - RNA, 3222 nt, Artificial Sequence
  derived and/or modified CDS sequence (opt3) from SFTSV(HNXY_207)__KC292315.1__GP
augaugaaggugaucugguuccccagccugauuugcuuugucauacaguguuccggcgacucugggccuaucauuugcgccggaccaauccacucaaacaaaagugcugauauuccgcaucuccuugguuacagcgagaagaucugucaaauagacagacugauccacguuuccucuugguugaggaaucauucgcaguuccagggcuauguggggcagcggggaggccgcucacaaguaagcuacuaucccgcagaaaacaguuacucccgauggucugguuuacugagcccuugcgaugccgacuggcuagggaugcucguggucaaaaaggcgaaaggauccgauaugauugugccaggccccucauauaagggcaagguuuucuucgagcguccuaccuuugacggguacgugggaugggguuguggcagugggaaaagcagaacagaaucuggagagcugugcuccucagauagcggcacuagcucuggucuucugccauccgacagggucuuguggaucggggauguggcuugucagcccaugacgccuauuccagaagagaccuuccucgagcugaagaguuuuucgcagucugaauuuccggacaucugcaaaauagauggaauuguauuuaaucagugugagggcgaaucccugccccaaccuuucgacguugccuggauggaugugggccacucacauaagaucauuaugcgggagcacaaaacaaaguggguccaggagaguagcuccaaggacuuugugugcuauaaagaagggacuggaccauguucugagagcgaagagaagaccugcaaaacaucagguaguugccgcggcgacaugcaguucuguaagguggcagggugcgaacacggagaggaggccuccgaagcuaaauguagaugcagccucguccauaagcccggcgagguugugguaucuuacggugggaugagggugcggccuaaauguuacggcuuuucacgcaugauggcaaccuuagaagucaaccagccagagcaacgaaucggacagugcacuggcugucaccuggaaugcaucaaugggggagugagacuuauuacauugaccagugagcuaaagagcgccacgguuugugcuucccauuucugcagcucggccacuagcgguaagaaauccaccgagauacaguuccacucaggcagucugguggggaagacagcgauccacgucaaaggagcacucguggauggcacugaauuuaccuucgaggguucuuguauguuucccgacgggugcgaugccguagacugcacauucuguagggaauuucugaagaacccgcaaugcuauccugcuaaaaaguggcuuuucauuaucauaguuauucuguugggcuacgccggacucaugcuguuaaccaaugugcugaaggcaaucggcaucugggggagcugggucauugcucccgugaaacucauguuugccaucauuaagaaacuuaugcggacggucuccugucugaugggaaaguugauggaucguggucgccaggugauacaugaggaaaucggcgagaacagagaggggaaucaggacgauguuaggauugaaauggcgcggccacgacgcgugagacacuggauguauucaccuguaauccuaacuauccuggccauuggacucgcagagagcugcgacgaaaugguccaugcugauucuaaacugguguccuguaggcagggcagugguaacaugaaggagugcguuacaaccgggcgggcccuucugcccgcugugaauccaggccaagaggccuguuugcacuucacugcacccggaagcccugacucuaagugccucaaaauaaaggucaaacgcaucaaccugaaguguaaaaaguccucaaguuacuuugugccagaugccagaucuaggugcacaucgguacgucggugucgaugggcuggcgacugccaguccgggugcccgccccauuucaccucuaauagcuuuucagacgauugggcgggaaagauggacagagcaggcuuagguuucaguggguguuccgauggaugcggcggugccgcuuguggcugcuuuaacgccgcaccuucuuguauuuucuggaggaaauggguggaaaauccacacgggaucauuuggaagguuagccccugcgccgcuugggucccuuccgccgugaucgagcugacgaugccaucaggagaagugcgcaccuuccaccccaugagcggcauaccgacacaggucuuuaaagggguuagugugacuuaucuaggaucugacauggagguguccggccucaccgaucugugugaaaucgaggagcuuaagagcaaaaaguuggcacuggcgccuugcaaccaggcugguauggggguagucggaaaagugggcgaaauucaauguucgucagaggaaucugcccggacaaucaagaaggacgguugcauuuggaacgcagaucucguuggcaucgagcugagaguggacgaugccgucuguuacaguaaaauaacuuccguggaagcuguugccaauuauagcgcaauuccaaccacaaucgggggacuuagguucgagcgcucucaugacagccagggcaagauuuccgggucaccccuggauaucaccgcuauacgaggaaguuuuagcgugaacuaccggggcuugcgucucucucuguccgagaucacugccacgugcacaggugaaguaaccaaugucucagggugcuacaguuguaugacuggagcgaaagugagcauuaaguuacacuccucuaaaaacucgaccgcccaugugagaugcaagggcgacgagacagcuuucagcguccuggaagguguucacucauauaccgugucccuaaguuuugaucacgcaguaguggacgagcagugucagcucaauugcggcgggcaugaaucucaagucacucugaagggaaaccuuaucuucuuggacgugccuaaauuuguugauggcagcuacaugcagacauaucacuccacggugcccaccggggccaauauuccaucaccuacugacuggcugaacgcucucuucggaaauggccugucuagguggaucuuaggugucauaggggugcugcuuggaggcuuggcccucuuuuucaugauuaugagccuguuuaagcuaggcacaaaacagguuuuccgcagucggaccaagcuggcauga

SEQ ID NO: 11583 - RNA, 3222 nt, Artificial Sequence
  derived and/or modified CDS sequence (opt3) from SFTSV(HNXY_224)__KC292317.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucguugugauacuguugggcuacgccggacucaugcuguuaaccaauguccugaaggcaauuggcaucuggggguccugggugaucgcuccugucaaacucauguuugccauuaucaagaaacuuaugcggacggugucaugucugaugggaaaguugauggaucguggucgccagguuauucaugaggaaauaggcgagaacagagaggggaaucaggacgaugugaggaucgaaauggcgcggccccgacgcguaagacacuggauguauagcccagucauucuaacuauccuggccaucggacucacagagucuugcgacgaaauggugcaugcagauuccaaacugguuaguuguaggcagggcagcgguaacaugaaggagugcgugaccacugggcgggcccuucugccugcugucaaucccggccaagaggcuuguuugcacuucacagccccaggaucucccgacuccaagugccucaaaauuaaggugaaacgcauaaaccugaaguguaaaaagucaaguagcuacuuuguaccugaugcaagaucgaggugcaccuccgugcgucggugucgaugggccggcgacugcgaaucugggugcccaccgcauuucacgagcaauucauuuagugacgauugggcuggaaagauggacagagcgggcuuagguuucuccggguguucugauggaugcggcggugcagccuguggcugcuuuaacgcugcccccagcuguaucuucuggaggaaauggguugagaauccucacgggauuaucuggaaggucuccccaugcgcagccugggugcccucagcugugauugaacugaccaugccuagcggagagguccgcacauuccagccaaugaguggcauccccacucagguuuuuaaaggggugucugugaccuaucuaggauccgacauggaaguaagcggccucacagaucugugugagauagaggaacuuaagucgaaaaaguuggcccuggcaccgugcaaccaggcggguaugggggucgugggaaaaguuggcgagauccaauguucaucugaagagagugcucggacuauuaagaaggacgguugcaucuggaacgccgaucucgugggcauugaacugagagucgacgaugcaguguguuacuccaaaaucaccagcguugaggccguggcuaauuauucugccauaccuacaaccauugggggacuuagguucgagcgcagccacgacucccagggcaagaucucagggaguccacuggauauuacugcaauccgaggcagcuuuucuguaaacuaccggggauugcgucucucccugucagaaauaacggcuacaugcaccggugaggucacuaaugugagugggugcuacagcuguaugaccggagccaaaguguccaucaaguuacauucuucgaaaaacagcacagcgcacgucagaugcaagggcgacgaaaccgccuucucaguucuggagggugugcauuccuauacuguaagucuaucuuuugaucacgcuguggucgacgaacagugucagcucaauugcggcgggcacgagagccaagugacacugaagggaaaccuuauuuucuuggacguucccaaauuuguggauggcuccuacaugcagacguaucauucaaccgucccuacuggggcaaauauccccucuccaacagacuggcugaacgcccucuucggaaauggccugaguagguggauuuuaggugugaucgggguucugcuuggaggcuuggcucucuuuuucaugauaaugagccuguuuaagcuaggcaccaaacagguguuccgcucccggacaaagcuggccuga

SEQ ID NO: 11584 - RNA, 3222 nt, Artificial Sequence
  derived and/or modified CDS sequence (opt3) from SFTSV(HNXY_231)__KC292313.1__GP
augaugaaggugaucugguucagcucccugauuugcuuugucauacaguguucuggcgacucagggcccaucauuugcgccggaccuauccacaguaacaaaagcgcugguauuccacaucuccuuggcuacuccgagaagaucugucaaauagauagacugauccacguuucuucgugguugaggaaucauucacaguuccagggguaugugggacagcggggcggucgcagccaaguaaguuacuauccggcagaaaacuccuacucucgauggagcggguuacugucccccugcgacgccgauuggcuaggaaugcucguggucaaaaaggcgaaaggcucagacaugauugugccuggcccaaguuauaaggggaagguuuucuucgagcgucccaccuuugauggauacguggguuggggcugugggagcggaaaaucuagaacagaauccggcgagcugugcucaagcgacagugguacuucuuccgggcuucugccuagcgauagggucuuguggaucggagacguggcuugucagccaaugacgcccauuccugaagagaccuuccucgagcugaagucguuuucucaguccgaauuuccagauaucugcaaaauagacggcauuguauuuaaucagugugagggcgaaucacugccgcaacccuucgauguugccuggauggacguggggcacagucauaagaucauuaugcgggagcacaaaacaaaguggguccaggagagcuccucuaaggauuuugugugcuauaaagaaggaacugguccuuguagcgagucagaagagaagaccugcaaaacaaguggcuccugccgcggggacaugcaguucuguaagguggcaggaugcgaacacggcgaggaggccagcgaagcuaaauguagaugcucucucguccauaagccaggugagguugugguaucauacgggggcaugagggugcggcccaaauguuacggauuuagucgcaugauggcaaccuuagaagucaaccagccugagcaacgaaucggccagugcacugggugucaccuggaaugcaucaauggaggugugagacuuauuacauugaccagcgagcugaaguccgccacgguuugugcuucucauuucugcucgagcgccacuuccggcaagaaaucaaccgagauacaguuccacagugggucucuagugggaaagacagcgauccacgucaaaggcgcacucguggacgguacugaauuuaccuucgaggggagcuguauguuuccagauggcugcgacgccguagauugcacauucuguagggaauuucugaagaacccccaaugcuauccggcuaaaaaguggcuuuucauuaucauaguuauucuguugggauacgccggccucaugcuguuaaccaaugugcugaaggcaaucgggaucuggggauccugggucauugcuccugugaaacucaucuuugccauuauaaagaaacuuaugcggacggucucaugucugauggguaaguugauggaccguggccgccaggugauccaugaggaaauuggggagaacagagagggaaaucaggaugacguuaggaucgaaauggcgcggccccgacgcgugagacacuggauguauagcccaguaauccuaacuauucuggccauaggccucgcagagucuugcgaugaaaugguccaugcugacuccaaacuggugaguuguaggcaggguagcgggaacaugaaggagugcguuacaaccggccgggcccuucugccugcugugaaucccggacaagaggccuguuugcacuucacugcaccaggcucucccgauuccaagugccucaaaaucaaggucaaacgcauuaaccugaaguguaaaaagucaaguagcuacuuugugccugacgccagaucgaggugcacauccguacgucggugucgaugggcuggggauugccagucuggaugcccaccgcauuucaccagcaauucauuuagugacgacugggcgggcaagauggauagagcagguuuaggguucuccggauguucugacggcugcgguggcgccgcuugugggugcuuuaacgccgcacccagcuguaucuucuggaggaaauggguggaaaauccucacggaauuaucuggaagguuuccccaugcgccgcuuggguccccucagccgugauagagcugacgaugccuagcggcgaagugcgcaccuuccacccaaugagugggauccccacacaggucuuuaaaggaguuucugugacuuaucuaggcuccgauauggaggugagcggucucaccgaccugugugaaauugaggagcuuaagucgaaaaaguuggcacuggcgccgugcaaccaggcugggaugggaguagucggcaaagugggugaaauccaauguucaucugaggaaagugcccggacaauuaagaaggauggcugcaucuggaacgcagaccucguugggauagagcugagaguggaugacgccgucuguuacuccaaaauuacuagcguggaagcuguugccaauuauucugcaaucccuaccacaauuggaggccuuagguucgagcgcagccaugauucccaggggaagaucucaggaaguccacuggacauaaccgcuauccgaggcagcuuuucugugaacuaccgggguuugcgucucucccugucagagauuacugccacgugcacaggggaaguaaccaaugucaguggaugcuacagcuguaugacuggcgcgaaaguguccaucaaguuacacucuucgaaaaacagcaccgcccaugugagaugcaagggugaugagacagcuuucucaguccuggaaggcguucacuccuauaccgugagucuaucuuuugaccacgcaguaguggaugagcagugucagcucaauugcgggggacaugaaagccaagucacucugaagggcaaccuuauuuucuuggacgugcccaaauuuguugacggguccuacaugcagacauaucacucaacggugccuaccggagccaauauccccucuccaacugauuggcugaacgcucucuucggcaauggucugaguagguggauauuaggggucauuggagugcugcuuggcggcuuggcccucuuuuucaugaucaugagccuguuuaagcuagggacaaaacagguuuuccgcucccggaccaagcuggcauga

SEQ ID NO: 11585 - RNA, 3222 nt, Artificial Sequence
  derived and/or modified CDS sequence (opt3) from SFTSV(HNXY_245)__KC292320.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcaauagggucuuguggaucggggacguggcuugucagccaaugacgcccauuccugaagagaccuuccucgagcugaagucguuuucucaguccgaauuuccagauaucugcaaaauagacggaauuguauuuaaccagugugagggcgaaucacugccgcaacccuucgauguugccuggauggacgugggccacagucauaagaucauuaugcgggagcacaaaacaaaguggguccaggagagcuccucuaaggauuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaucagccugagcaacgaaucggacagugcacuggcugucaccuggaaugcaucaacgggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggacggcacugaauuuaccuucgaggguagcuguauguuuccagaugggugcgacgccguagauugcacauucuguagggaauuucugaagaauccccaaugcuauccggcuaaaaaguggcuuuucauuaucauaguuauucuguugggcuacgccggacucaugcuguuaaccaacgugcugaaggcaaucggcaucuggggguccugggucauugcuccugugaaacucaucuuugccauuauaaagaaacuuaugcggacggucucaugucugaugggaaaguugauggaccguggucgccaggugauccaugaggaaauuggcgagaauagagaggggaaccaggaugacguuaggaucgaaauggcgcggccccgacgcgugagacacuggauguauagcccaguaauccuaacuauucuggccauaggacucgcagagucuugcgaugaaaugguccaugcugacuccaaacuggugaguuguaggcagggcagcgguaauaugaaggagugcguuacaaccgggcgggcccuucugccugcugugaaccccggccaagaggccuguuugcacuucacugcaccaggaucucccgauuccaagugccuccgcaucaaagucaagagaauuaaucugaaauguaagaaaucaaguagcuacuuugugccugacgccaggucgcguugcacauccguacggcgauguagaugggcuggcgauugccagucugggugcccaccgcauuucaccagcaacucauuuagugacgacugggcgggaaagauggauagggcaggcuuagguuucuccggguguucugacggaugcggcggugccgcuuguggcugcuuuaaugccgcacccagcuguaucuucuggcgcaaguggguggaaaacccucacgggauuaucuggaaaguuuccccaugcgccgcuuggguccccucagccgugauagagcugacgaugccuagcggagaagugcggaccuuccacccaaugaguggcauccccacacaggucuuuaaggggguuucugugacuuaucuaggauccgauauggaggugagcggccucaccgaccugugugaaauugaggagcuuaaaucgaagaaauuggcacuggcgccgugcaaccaggcugguauggggguagucggaaaggugggcgaaauccaauguucaucugaggaaagugccagaacaauuaaaaaggaugguugcaucuggaaugcagaccucguuggcauagagcugaggguggaugacgccgucuguuacuccaagauuacuagcguggaagcuguugccaacuauucugcaaucccuaccacaauugggggacuucgcuucgagcgaagccaugauucccagggcaaaaucucagggaguccacuggacauaaccgcuauccggggcagcuuuucugugaauuaccguggauugagacucucccugucagagauuacugccacgugcacaggugaaguaaccaacgucagugggugcuacagcuguaugacuggagcgaagguguccaucaaauuacacucuucgaagaauagcaccgcccaugugaggugcaaaggcgaugagacagcuuucucaguccuggaagguguucacuccuauaccauuagucuaucuuuugaccacgcagugguagaugagcagugucagcucaacugcggcgggcaugaaagccaagugacucugaagggaaaucuuaucuucuuggacguccccaaguuuguggacggcuccuacaugcagacauaucacucaacgguuccuaccggggccaacauacccucuccaacugauuggcugaaugcucucuucggaaacggccugagccgcuggauuuuaggugugauggggguccugcuuggaggcuuggcccucuuuuucaugaucaugagucuguuuaaacuaggcacaaaacagguguuccgguccagaaccaagcuggcauga

SEQ ID NO: 11586 - RNA, 3222 nt, Artificial Sequence
  derived and/or modified CDS sequence (opt3) from SFTSV(HNXY_262)__KC292309.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccgaguaaguuacuauccggcagaaaacuccuacucucguuggagcgguuuacugucccccugcgaugccgacuggcuagggaugcucguggucaaaaaggcgaaaggaucagauaugauugugccuggcccaaguuauaagggcaagguuuucuucgagagacccaccuuugacggguacgugggaugggguuguggcagcgggaaaucuaggacagaauccggagagcugugcucaagcgauaguggcacuucuuccggucuucugccuagcgaccgggucuuguggaucggggauguggcuugucaaccaaugacgcccauuccugaagagaccuuccucgagcugaagucguuuucucaguccgaauuuccagacaucugcaaaauagauggaauuguauuuaaucagugugagggcgaaucacugccgcagcccuucgacguugccuggauggaugugggccacagucauaagaucauuaugcgcgagcacaaaacaaaguggguccaagagagcuccucuaaggacuuugugugcuauaaagaagggacuggaccuuguagcgagucagaagagaagaccugcaaaacaagugguuccugcagaggcgacaugcaguucuguaagguggcagggugcgaacacggagaggaggccagcgaagcuaaauguaggugcucucucguccauaagccaggcgagguugugguaucauacggugggaugcgggugcgccccaaauguuacggcuuuagucgaaugauggcaaccuuagaagucaaccagccugagcagagaaucggacaaugcacuggcugucaccuggaaugcaucaaugggggagugaggcuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucugucgggaauuucugaagaacccccagugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcguacggucucaugucugaugggaaaguugauggaucgcgguagacaagugauccaugaggaaauuggcgagaacagggaggggaaucaggacgauguucggaucgaaauggcgcgaccccgcagagugaggcacuggauguauagcccaguaauccuaacuauucuggccauaggacucgcagagucuugcgacgaaaugguccaugcugauuccaaacuggugaguugucggcagggcagcgguaacaugaaggagugcguuacaaccgggcgcgcccuucugccugcugugaaucccggccaggaggccuguuugcacuucacugcaccaggaucucccgacuccaagugccucaaaaucaaggucaaaagaauuaaccugaaguguaaaaagucaaguagcuacuuugugccugaugccaggucgcguugcacauccguacggcgauguagaugggcuggcgacugccaaucugggugcccaccgcauuucaccagcaauucauuuagugacgauugggcgggaaagauggacagggcaggcuuagguuucuccggguguucugauggaugcggcggugccgcuuguggcugcuuuaacgccgcacccagcuguaucuucuggcgcaaauggguggaaaauccucacgggauuaucuggaagguuuccccaugcgccgcuuggguccccucagccgugauagagcugacgaugccuagcggagaagugcggaccuuccacccaaugaguggcauccccacacaggucuuuaaagggguuucugugacuuaucuaggauccgacauggaggugagcggccucaccgaucugugugaaauugaggagcuuagaucgaagaaauuggcacuggcgccgugcaaccaggcugguauggggguagucggaaaggugggcgaaauccaguguucaucugaggaaagugccaggacaauuaaaaaggacgguugcaucuggaacgcagaucucguuggcauagagcugcgcguggacgaugccgucuguuacuccaagauuacuagcguggaagcuguugccaauuauucugcaaucccuaccacaauugggggacuucgauucgagcggagccaugacucccaaggcaaaaucucagggaguccacuggauauaaccgcuauccguggcagcuuuucugugaacuacagaggauugaggcucucccugucagagauuacugccacgugcacaggugaaguaaccaaugucagugggugcuacagcuguaugacuggagcgaagguguccaucaaauuacacucuucgaagaacagcaccgcccaugugcgcugcaaaggcgacgagacagcuuucucaguccuggaagguguucacuccuauaccgugagucuaucuuuugaucacgcaguaguggacgagcagugucagcucaauugcggcgggcaugaaagccaggucacucugaagggaaaccuuauuuucuuggacgugcccaaguuuguugauggcuccuacaugcaaacauaucacucaacggugccuaccggggccaauauccccucuccaacugacuggcugaacgcucucuucggaaauggccugagccgguggauauuaggugucaugggggugcugcuuggaggcuuggcccucuuuuucaugauuaugagucuguuuaaacuaggcacaaagcagguuuucagauccaggaccaaacuggcauga

SEQ ID NO: 11587 - RNA, 3222 nt, Artificial Sequence
  derived and/or modified CDS sequence (opt3) from SFTSV(HNXY_278)__KC292322.1__GP
augaugaaggugaucugguucagcucccugauuugccucgucauacaguguggcggggacaccggacccaucauuugcgccgguccuacacacucuaacaaaucagcugauaucccacaucuucugggcuacagugagaagauuugucaaaucgacagauugauacacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugaucgugccuggcccauccuauaaggggaagguuuucuuugagcgucccacuuucgacggauacguggguuggggcugugggucaggaaaaaguagaacggaaagcggcgagcuuugcagcuccgauucagguaccagcagugggcuguugccuucugacaggguccucuggauuggagauguggcuugucagccaaugacacccaucccugaagagacuuuucuggagcugaaguccuucagccagucggaauuuccagacauuugcaaaaucgauggcauaguauucaaucagugugagggcgaaucucucccgcaacccuuugacguugccuggauggauguggggcacucccauaagauuaucaugcgggagcacaaaaccaaguggguccaggagucaaguagcaaggacuucgugugcuauaaagaaggaacagguccuuguuccgagucugaagagaagaccugcaaaacuggcgggagcugccgcggagacaugcaguuuuguaagguggcaggcugcgaacacggugaggaggccucagaagcuaaauguagaugcaguuuaguccauaagccaggggagguugugguauccuacggcggaaugagggugcggcccaaauguuacggcuucagccgcaugauggcaacacuggaagucucucagccugagcaacgaauugggcagugcaccggaugucaccuugaaugcaucaacgguggcgugagauugaucacgcugacuucagagcuaaagagugccaccguuugugcuagccauuuuugcuccucugccacaucggggaagaaaagcacugagauucaguuccacuccggaucacucgugggcaagaccgcgauacacgucaaaggugcacugguggaugggacagaguucaccuuugaaggcaguuguauguucccagacggaugcgaugccguagacugcacguuuuguagggaguuccuuaagaauccccaaugcuauccggcuaaaaaguggcuguuuaucauuaucguuauauugcucggcuacgccgggcugauguuacugacuaacgugcucaaggcaauuggagucugggguucuugggugaucgcuccugucaaacuuguguucgccaucauuaagaaacugaugcgggcgguuagcuguuugaugggcaagcuaauggaucgugggcgccaggugauccaugaagaaauuggagagaauagagagggcaaccaggacgauguaaggauagaaauggcccggccccgacgcgucagacacuggauguauuccccagugauccugacaauucucgcaaucggucuggcugaggggugcgacgaaaugauccaugccgauucaaaacuuguuagcuguaggcagggcucuggaaauaugaaggagugcgugaccacuggccgggcucuguugccugccgucaaccccgggcaagaggcaugucuccacuuuacagccccaggaucccccgacaguaagugccugaaaauuaaggugaaacgcauaaauuuaaaguguaaaaagucuucuuccuacuucguaccugaugcuagaucaaggugcaccagugugcgucggugucgaugggcgggcgacugccagagcgguugcccaccgcauuuuacgcccaacucguucuccgacgauugggcagggaagauggacagagccggacugggcuuuucugguuguagcgauggcugcgggggagcugccuguggcugcuucaaugcagccccuucauguaucuuuuggaggaaauggguugaaaacccacacgggauuaucuggaaggucagucccugcgcugccugggugccuuccgcagugauugagcuaaccaugccaucuggagaaguccgcacauuccaccccaugagcggcaucccgacucagguuuucaaagguguguccgugaccuaucucgggucagacauggagguaagcggacugacagaucuuugugaaauagaggaguugaagaguaaaaagcuggcgcucgcuccuugcaaucaggccggcaugggugucgugggcaaaguuggggaaauccaauguucuuccgaggaaagcgcacggacuauuaagaaggacggaugcaucuggaacgccgaucuggugggcauugagcuuagagucgacgaugcuguguguuacucgaaaaucaccucaguugaagccguggcaaacuauucugcuauaccaacaaccauugggggacugagguuugagcgcagucaugacucccagggcaagaucagcgguucucccuuggauauuacugccauccgagggagcuucuccguaaauuaccggggacuccgucugucauuaagugagauaacggcgacaugcaccggcgaagucacuaacgugagcgguugcuacucuuguaugaccggcgccaaaguguccaucaagcugcacucaaguaaaaauagcacagcucaugucagaugcaagggggacgagaccgcauuuuccguucuagaaggagugcacucuuauucgguaagccucucauucgaucacgccguggucgacgagcagugucagcugaacugcggcgggcaugaaucccaagugacucuuaggggaaauuugauuuuucuggacguuccuaaguucguggauggcaguuacaugcagacauaucacucuacgguccccaccggugcuaacaucccaagcccuacugacuggcucaaugcccuguuugggaacggauuaucccgcuggauucugggcgugaucggcguucuucucgggggauuggcacuguucuuucuaauaaugucacuguucaaacucgguacaaagcagauuuuucggucuagaaccaaacuggcguga

SEQ ID NO: 11588 - RNA, 3222 nt, Artificial Sequence
  derived and/or modified CDS sequence (opt3) from SFTSV(HNXY_31)__KC292310.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcggacggucucaugucugaugggaaaguugauggaucguggucgccaggugauccaugaggaaauuggcgagaacagagaggggaaucaggacgauguuaggaucgaaauggcgcggccccgacgcgugagacacuggauguauagcccaguaauccuaacuauucuggccauaggacucgcagagucuugcgacgaaaugguccaugcugauuccaaacuggugaguuguaggcagggcagcgguaacaugaaggagugcguuacaaccgggcgggcccuucugccugcugugaaucccggccaagaggccuguuugcacuucacugcaccaggaucucccgacuccaagugccucaaaaucaaggucaaacgcauuaaccugaaguguaaaaagucaaguagcuacuuugugccugaugccagaucgaggugcacauccguacgucggugucgaugggcuggcgacugccagucugggugcccaccgcauuucaccagcaauucauuuagugacgauugggcgggaaagauggacagagcaggcuuagguuucuccggguguucugauggaugcggcggugccgcuuguggcugcuuuaacgccgcacccagcuguaucuucuggaggaaauggguggaaaauccucacgggauuaucuggaagguuuccccaugcgccgcuuggguccccucagccgugauagagcugacgaugccuagcggagaagugcgcaccuuccacccaaugaguggcauccccacacaggucuuuaaagggguuucugugacuuaucuaggauccgacauggaggugagcggccucaccgaucugugugaaauugaggagcuuaagucgaaaaaguuggcacuggcgccgugcaaccaggcugguauggggguagucggaaaagugggcgaaauccaauguucaucugaggaaagugcccggacaauuaagaaggacgguugcaucuggaacgcagaucucguuggcauagagcugagaguggacgaugccgucuguuacuccaaaauuacuagcguggaagcuguugccaauuauucugcaaucccuaccacaauugggggacuuagguucgagcgcagccaugacucccagggcaagaucucagggaguccacuggauauaaccgcuauccgaggcagcuuuucugugaacuaccggggauugcgucucucccugucagagauuacugccacgugcacaggugaaguaaccaaugucagugggugcuacagcuguaugacuggagcgaaaguguccaucaaguuacacucuucgaaaaacagcaccgcccaugugagaugcaagggcgacgagacagcuuucucaguccuggaagguguucacuccuauagugugucucucagcuuugaucacgcaguaguggacgagcagugucagcuaaauugcggcgggcaugaaucccaagucacccugaggggaaaccuuauuuucuuggacgugcccaaguuuguugauggcucauacaugcagacuuaucacucuacagugccuacgggggccaauauccccagcccaaccgacuggcugaacgcucucuucggaaauggccugagucgcuggauauuaggugucauuggggugcugcuuggaggcuuggcccucuuuuucaugaucaugucccuguuuaaacuaggcacuaagcagguuuuccggagcagaacaaaacuggcauga

SEQ ID NO: 11589 - RNA, 3222 nt, Artificial Sequence
  derived and/or modified CDS sequence (opt3) from SFTSV/FTLSV(2011YGS5)__KF711925.1__GP
augaugaaggugaucugguucagcucccuggucugccucguuauucaguguucuggcgacucagggcccauaaucugcgccggaccuauucacaguaacaaaagcgcugcaaucccacaucuucuggguuacuccgagaagauuugucaaaucgauagauugauacacgugucuucgugguuaaggaaucauucacaguuucagggcuauguagggcagcggggaggccgcagccaagugaguuacuauccggccgaaaacuccuacucucgauggagcggucugcuaucccccugcgacgcggauuggcucgggaugcuggucgugaaaaaggcuaaaggaucagacaugaucguuccuggcccaaguuauaagggcaagguguucuuugagcgucccaccuucgauggguacgucggaugggguuguggcagcgggaaaucuagaacagaauccggagagcuuugcucaagcgacaguggcacuucuuccggucuguugccuagcgauagggugcucuggauuggggacguagccugucagccaaugacgcccaucccugaagagaccuuucuggagcugaagucguucucucaguccgaauuuccagauauuugcaaaaucgacggaauaguuuucaaucagugugagggcgaaucacucccgcaacccuuugauguggcauggauggacgucggccacagucauaagauuaucaugcgggagcacaaaacaaagugggugcaggagagcuccucuaaggauuucgugugcuauaaagaagggacuggaccuuguagcgagucagaagagaaggccugcaaaaccagugguuccugccgcggcgacaugcaguuuuguaaggucgcugggugcgaacacggagaggaggcaagcgaagccaaauguagaugcucuuuaguucauaagccaggcgaggugguagugucauacggugggaugaggguccggcccaaauguuacggcuucagucgcaugauggcuacaauggaagugaacccuccagagcagcgaauuggacaaugcaccggcugucaccuggaaugcaucaaugggggaguuagacuuaucacuuugacaagcgagcugaaguccgccaccgugugugcgucucauuuuugcucgagcgcaacguccgguaagaaaucaacugagauucacuuccacaguggcucucuagucgggaagaccgccauacaugugaaaggagcucucguagacggcacagaauuuacuuuugaggguagcuguauguuccccgaugggugcaacgccguugacugcaccuuuuguagggaguuccugaagaauccgcagugcuauccugcgaaaaaguggcuuuuuaucauuaucgugauacuguugggcuacgcuggacucaugcuguuaacaaacguccugaaggccauuggcguguggggguccugggucaucgcgcccgugaaacucauguucgccaucaugaagaaacuuaugcggaccguuucaugucuggugggaaaguugauggaucguggucgccagguaauucacgaagaaaucggcgagaauggggagggaaaccaugacgaugucagaauugaaauggcaaggccacggcgagugcgccacuggauguauagcccuguuauacuaacgauccuggcuauuggccucgccgaggguugcgacgaaauggugcaugcugauucuaaacuggucuccuguagacaagggaguggcaauaugaaggagugcgugacuacaggaagggcccuucugcccgcaguaaacccaggccaggaggccuguuugcacuuuaccgcucccgggagcccugacucuaagugccucaaaaucaaggugaaacggaucaaucugaaguguaaaaaguccucaaguuacuucguuccagaugcgcgcaacagaugcacuagcgucaggcguugucggugggcaggagacugccagucgggcugcccgccccacuuuacauccaauucuuucagcgaugacugggccgguaagauggaccgagcuggguuaggauuuucaggcuguagugaugguugcggcggggccgcauguggaugcuucaacgccgcuccuuccuguauuuucuggagaaaauggguggaaaacucucauggcauaaucuggaaggugagcccaugcgccgcauggguccccuccgcgguuauugagcugaccaugccuucaggggaagugaggacguuccacccaaugagcggaauccccacccagguguucaaaggcguaagugucacauaucuagguucugacauggagguguccgggcucacugaucugugugaaauugaggagcuuaagagcaaaaaguuggcucuggccccgugcaaucaagcaggaaugggcguuguggguaaagucggcgaaauccaguguucgucagaggaaucugcccgcaccauaaagaaggacgggugcaucuggaacgcugaucucgugggaauugagcugcggguugacgaugccguguguuacaguaaaaucacauccguagaagcagucgcuaauuauagcgccauuccuacuaccaucggcgggcuuagauuugagaggucucaugacagccagggaaagauauccggcucaccacuggauauuacagcgauccgcgguaguuucagcgugaacuaccgaggguugcggcucucucuguccgagauuaccgccacuugcacgggagaagugacaaaugucucaggcugcuacaguuguaugaccggugcuaaaguuagcaucaaguuacacuccucuaaaaacucgacugcacacgugcguugcaagggcgacgagaccgccuuuagcguacuggaaggggugcauucauauacagucucccuaaguuucgaucacgcugugguugacgagcagugucaacucaauugcggaggccaugaaucucaggugacccugaaggggaaccuuauauuuuuggauguccccaaauucguggacggaagcuacaugcagacuuaucacuccacaguuccuacgggcgccaauauccccucaccaaccgacuggcugaacgcacucuuugguaaugggcugucuagauggauuuuaggagugaucggcguccugcuuggcggguuggcacucuucuuucugauuauguuccuauuuaagcugggaacuaaacagguauucaggagccgcacaaagcucgccuga

SEQ ID NO: 11590 - RNA, 3222 nt, Artificial Sequence
  derived and/or modified CDS sequence (opt3) from SFTSV/FTLSV(2011YGS7)__KF711922.1__GP
augaugaaggugaucugguucagcucccuggucugccucguuauucaguguucuggcgacucagggcccauaaucugcgccggaccuauucacaguaacaaaagcgcugcaaucccacaucuucuggguuacuccgagaagauuugucaaaucgauagauugauacacgugucuucgugguuaaggaaucauucacaguuucagggcuauguagggcagcggggaggccgcagccaagugaguuacuauccggccgaaaacuccuacucucgauggagcggucugcuaucccccugcgacgcggauuggcucgggaugcuggucgugaaaaaggcuaaaggaucagacaugaucguuccuggcccaaguuauaagggcaagguguucuuugagcgucccaccuucgauggguacgucggaugggguuguggcagcgggaaaucuagaacagaauccggagagcuuugcucaagcgacaguggcacuucuuccggucuguugccuagcgauagggugcucuggauuggggacguagccugucagccaaugacgcccaucccugaagagaccuuucuggagcugaagucguucucucaguccgaauuuccagauauuugcaaaaucgacggaauaguuuucuaucagugugagggcgaaucacucccgcaacccuuugauguggcauggauggacgucggccacagucauaagauuaucaugcgggagcacaaaacaaagugggugcaggagagcuccucuaaggauuucgugugcuacaaagaagggacuggaccuuguagcgagucagaagagaaggccugcaaaaccagugguuccugccgcggcgacaugcaguuuuguaaggucgcugggugcgaacacggagaggaggcaagcgaagccaaauguagaugcucuuuaguucauaagccaggcgaggugguagugucauacggugggaugaggguccggcccaaauguuauggcuucagucgcaugauggcuacaauggaagugaauccuccagagcagcgaauuggacaaugcaccggcugucaccuggaaugcaucaacgggggaguuagacuuaucacuuugacaagcgagcugaaguccgccaccgugugugcgucucauuuuugcucgagcgcaacguccgguaagaaaucaacugagauucacuuccacaguggcucucuagucgggaagaccgccauacaugugaaaggagcucucguagacggcacagaauuuacuuuugaggguagcuguauguuccccgaugggugcaaugccguugacugcaccuuuuguagggaguuccugaagaacccgcagugcuacccugcuaaaaaguggcuuuuuaucauuaucgugauacuguugggcuaugcaggacucaugcuguuaacaaauguccugaaggccauuggcguguggggguccugggucaucgcgcccgugaaacucauguucgccaucaugaagaaacuuaugcggaccguuucaugucuggugggaaaguugauggaucguggucgccagguaauucacgaagaaaucggcgagaacggggagggaaaucaugacgaugucagaauugaaauggcaaggccacggcgagugcgccacuggauguacagcccuguuauacuaacgauccuggcuauuggccucgccgaggguugcgacgaaauggugcaugcugauucuaaacuggucuccuguagacaagggaguggcaacaugaaggagugcgugacuacaggaagggcccuucugcccagcguaaauccaggccaggaggcauguuugcacuuuaccgcccccgggucuccugacuccaagugccucaaaaucaaggugaaacggaucaaccugaaguguaaaaagucaaguagcuauuucguuccagaugcucgcaauagaugcacuucggucaggcguugucggugggcgggagacugccaguccggcugcccgccccacuuuacaucuaacagcuucucagaugacugggcagguaagauggaccgagccggguuaggauuuaguggcuguuccgaugguugcggcggggcugccuguggaugcuucaaugcagccccuucuuguauuuucuggagaaaauggguggaaaacagccauggcauaaucuggaagguguccccaugcgcugccuggguccccucagcaguuauugagcugaccaugccuagcggggaagugaggacguuccacccaaugaguggaauccccacccagguguucaaaggcguaucugucacauaccuagguuccgacauggaggugagcgggcucacugaucugugugaaauugaggagcuuaagucgaaaaaguuggcgcuggcuccgugcaaccaagccggaaugggcguuguggguaaagucggcgaaauccaguguucaucugaggaaagugcacgcaccauaaagaaggacgggugcaucuggaaugccgaucucgugggaauugagcugcggguugacgaugcuguguguuauuccaaaaucacaagcguagaagccgucgcaaacuacucugcuauuccuacuaccaucggcgggcuuagauuugagaggagccaugacucccagggaaagauaucaggcaguccacuggauauuacagccauccgcgguagcuucucugugaauuaccgaggguugcggcucucccugucagagauuaccgcgacuugcacgggagaagugacaaacgucaguggcugcuauagcuguaugaccggugccaaaguuuccaucaaguuacacucuucgaaaaauagcacugcucacgugcguugcaagggcgacgagaccgcauuuucaguacuggaaggggugcauuccuacacagucagucuaucuuucgaucacgccgugguugacgagcagugucaacucaacugcggaggccaugaaagccaggugacccugaaggggaaucuuauauuuuuggauguccccaaauucguggacggauccuauaugcagacuuaccacucaacaguuccuacgggcgcuaacauccccucuccaaccgacuggcugaaugcccucuuugguaacgggcugagcagauggauuuuaggagugaucggcguccugcuuggcggguuggcacucuucuuucugauuauguuccuauuuaagcugggaacuaaacagguauucaggagucgcacaaagcucgcguga

SEQ ID NO: 11591 - RNA, 3222 nt, Artificial Sequence
  derived and/or modified CDS sequence (opt3) from SFTSV/FTLSV(2011YPQ11)__KF711926.1__GP
augaugaaggugaucugguucagcucccuggucugccucguuauucaguguucuggcgacucagggcccauaaucugcgccggaccuauucacaguaacaaaagcgcugcaaucccacaucuucuggguuacuccgagaagauuugucaaaucgauagauugauacacgugucuucgugguuaaggaaucauucacaguuucagggcuauguagggcagcggggaggccgcagccaagugaguuacuauccggccgaaaacuccuacucucgauggagcggucugcuaucccccugcgacgcggauuggcucgggaugcuggucgugaaaaaggcuaaaggaucagacaugaucguuccuggcccaaguuauaagggcaagguguucuuugagcgucccaccuucgauggguacgucggaugggguuguggcagcgggaaaucuagaacagaauccggagagcuuugcucaagcgacaguggcacuucuuccggucuguugccuagcgauagggugcucuggauuggggacguagccugucagccaaugacgcccaucccugaagagaccuuucuggagcugaagucguucucucaguccgaauuuccagauauuugcaaaaucgacggaauaguuuucaaucagugugagggcgaaucacucccgcaacccuuugauguggcauggauggacgucggccacagucauaagauuaucaugcgggagcacaaaacaaagugggugcaggagagcuccucuaaggauuucgugugcuauaaagaagggacuggaccuuguagcgagucagaagagaaggccugcaaaaccagugguuccugccgcggcgacaugcaguuuuguaaggucgcugggugcgaacacggagaggaggcaagcgaagccaaauguagaugcucuuuaguucauaagccaggcgaggugguagugucauacggugggaugaggguccggcccaaauguuacggcuucagucgcaugauggcuacaauggaagugaacccuccagagcagcgaauuggacaaugcaccggcugucaccuggaaugcaucaaugggggaguuagacuuaucacuuugacaagcgagcugaaguccgccaccgugugugcgucucauuuuugcucgagcgcaacguccgguaagaaaucaacugagauucacuuccacaguggcucucuagucgggaagaccgccauacaugugaaaggagcucucguagacggcacagaauuuacuuuugaggguagcuguauguuccccgaugggugcaacgccguugacugcaccuuuuguagggaguuccugaagaauccgcagugcuauccugcuaaaaaguggcuuuuuaucauuaucgugauacuguugggcuacgcaggacucaugcuguuaacaaacguccugaaggccauuggcguguggggguccugggucaucgcgcccgugaaacucauguucgccaucaugaagaaacuuaugcggaccguuucaugucuggugggaaaguugauggaucguggucgccagguaauucacgaagaaaucggcgagaauggggagggaaaccaugacgaugucagaauugaaauggcaaggccacggcgagugcgccacuggauguauagcccuguuauacuaacgauccuggcuauuggccucgccgaggguugcgacgaaauggugcaugcugauucuaaacuggucuccuguagacaagggaguggcaauaugaaggagugcgugacuacaggaagggcccuucugcccagcguaaacccaggccaggaggcauguuugcacuuuaccgcccccgggucuccugacuccaagugccucaaaaucaaggugaaacggaucaaucugaaguguaaaaagucaaguagcuacuucguuccagaugcucgcuauagaugcacuucggucaggcguuguccgugggcgggagacugccaguccggcugucccccucacuuuacaucuaacagcuucucagaugacugggcagguaagauggaccgggccggguuaggauuuaguggcugcuccgaugguugcggcggggcugccuguggaugcuucaaugcagccccaucuuguauuuucuggcgaaaauggguggaaaacagccauggcauaaucuggaaggugucccccugcgcugccugggucccuucagcaguuauugagcugaccaugccaagcggggaagugagaacguuccaccccaugaguggaaucccgacccagguguucaaaggcguaucugucacauaccuagguuccgacauggaggugagcgggcucacugaucugugugaaauugaggagcuuaagucgaaaaaguuggcgcuggcuccuugcaaccaagccggaaugggcguuguggguaaagucggcgaaauccaguguucaucugaggaaagugcaaggaccauaaagaaggacgggugcaucuggaaugccgaucucgugggaauugagcugcgcguugacgaugcuguguguuauuccaaaaucacaagcguagaagccgucgcaaacuacucugcuauuccaacuaccaucggcgggcuucgguuugagagaagccaugacucccagggaaagauaucaggcaguccccuggauauuacagccaucagggguagcuucucugugaauuaccgcggguugcgacucucccugucagagauuaccgcgacuugcacgggagaagugacaaacgucaguggcugcuauagcuguaugaccggugccaaaguuuccaucaaguuacacucuucgaaaaauagcacugcucacgugcggugcaagggcgacgagaccgcauuuucaguacuggaaggggugcauuccuacacagucagucuaucuuucgaucacgccgugguugacgagcagugucaacucaacugcggaggccaugaaagccaggugacccugaaggggaaucuuauauuuuuggaugucccuaaauucguggacggauccuauaugcagacuuaccacucaacaguucccacgggcgcuaacaucccaucuccuaccgacuggcugaaugcccucuuugguaacgggaugagccguuggauucugggagugaucggcgucuuacugggcgggcuugcauuguucuuucucauuauguuccuguuuaagcuaggaacuaaacagguauucagaaguaggacaaagcuggcguga

SEQ ID NO: 11592 - RNA, 3222 nt, Artificial Sequence
  derived and/or modified CDS sequence (opt3) from SFTSV/FTLSV(2011YPQ12)__KF711930.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcaauagggucuuguggaucggggacguggcuugucagccaaugacgcccauuccugaagagaccuuccucgagcugaagucguuuucucaguccgaauuuccagauaucugcaaaauagacggaauuguauuuaaccagugugagggcgaaucacugccgcaacccuucgauguugccuggauggacgugggccacagucauaagaucauuaugcgggagcacaaaacaaaguggguccaggagagcuccucuaaggauuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucagccagccugagcaacgaaucggacagugcacuggcugucaccuggaaugcaucaaugggggagugagacuuauuacauugaccuccgagcugaagucugccacgguuugugcuucgcauuucugcagcuccgccacuucagguaagaaaaguaccgagauacaguuccacucuggcagccuaguggggaagacagcgauccacgucaaaggagcacucguggacggcacugaauuuaccuucgaggguuccuguauguuuccagaugggugcgacgccguagauugcacauucuguagggaauuucugaagaacccccaaugcuauccggcuaaaaaguggcuuuucauuaucauaguuauucuguugggcuacgccggacucaugcuguuaaccaaugugcugaaggcaaucggcgucugggggucaugggugaucgcuccugucaaacucguguuugccauuaucaagaaacuuaugcgggcgguuagcugucugaugggaaaguugauggaccguggucgccaggugauucaugaggaaauaggcgagaacagagaggggaaucaggaugacguaaggaucgaaauggcccggccccgacgcgucagacacuggauguauucuccagugauucuaacgauccuggcaaucggacucgcugagggcugcgaugaaaugguucaugccgacuccaaacuggugaguuguaggcaggguagcgggaacaugaaggagugcgucacuacaggccgggcccuucugccugcugugaaucccggacaagaggcauguuugcacuucaccgccccaggcucucccgauuccaagugccucaaaauuaagguaaaacgcauaaaccugaaguguaaaaagucaaguagcuacuuugugccuguugcuagauauaggugcacuucgguccgucggugucgaugggcgggggacugccaguccggaugcccaccgcauuucacaucuaauagcuuuucagaugacugggcaggcaagauggacagagccgguuuaggguucaguggauguuccgauggcugcgguggcgcugccugugggugcuuuaacgcagcccccucuuguaucuucuggaggaaauggguggaaaauccucacggaauuaucuggaaggugagcccaugcgcugccuggguccccuccgcaguuauugagcugaccaugccuucaggcgaagugcgcacguuccacccaaugagcgggauccccacccagguguuuaaaggaguaagugucacauaccuaggcucugacauggagguguccggucucacugaucugugugaaauagaggagcuuaagagcaaaaaguuggcgcuggcuccgugcaaccaggccgggaugggaguugugggcaaagucggugaaauccaauguucgucagaggaaucugcacggaccauuaagaaggacggcugcaucuggaacgccgaucucguggggauugagcugagaguugacgaugcuguguguuauaguaaaaucacauccguagaagccgucgcaaauuacagcgcuauaccuacuaccauuggaggccuuagguucgagcgcucucaugacagccaggggaagaucuccggaucaccacuggauauuacagccauccgaggcaguuuuagcgugaacuaccgggguuugcgucucucucuguccgagauaaccgcgacuugcacgggggaagugacaaaugucucaggaugcuauaguuguaugaccggcgccaaaguuagcaucaaguuacacuccucuaaaaacucgacugcucaugugagaugcaagggugacgagaccgcauucagcguacuggaaggcgugcacucauacuccgucagucuaucuuuugaucacgccgugguugacgagcagugucagcucaauugcgggggacaugaaagccaagugacacugaggggcaaccuuauuuucuuggauguccccaaguuuguggacggguccuauaugcagaccuaccacucaacuguuccuacaggagcuaauauccccucuccaacggacuggcugaacgcccucuucggcaauggucugagccgcuggauuuuaggggugaucggaguccugcuuggcggcuuggcacucuuuuuccugauaaugagucuauuuaaacuggggaccaagcagauuuuccgguccagaacuaaacucgcguga

SEQ ID NO: 11593 - RNA, 3222 nt, Artificial Sequence
  derived and/or modified CDS sequence (opt3) from SFTSV/FTLSV(2011YPQ17)__KF711923.1__GP
augaugaaggugaucugguucagcucccuggucugccucguuauucaguguucuggcgacucagggcccauaaucugcgccggaccuauucacaguaacaaaagcgcugcaaucccacaucuucuggguuacuccgagaagauuugucaaaucgauagauugauacacgugucuucgugguuaaggaaucauucacaguuucagggcuauguagggcagcggggaggccgcagccaagugaguuacuauccggccgaaaacuccuacucucgauggagcggucugcuaucccccugcgacgcggauuggcucgggaugcuggucgugaaaaaggcuaaaggaucagacaugaucguuccuggcccaaguuauaagggcaagguguucuuugagcgucccaccuucgauggguacgucggaugggguuguggcagcgggaaaucuagaacagaauccggagagcuuugcucaagcgacaguggcacuucuuccggucuguugccuagcgauagggugcucuggauuggggacguagccugucagccaaugacgcccaucccugaagagaccuuucuggagcugaagucguucucucaguccgaauuuccagauauuugcaaaaucgacggaauaguuuucaaucagugugagggcgaaucacucccgcaacccuuugauguggcauggauggacgucggccacagucauaagauuaucaugcgggagcacaaaacaaagugggugcaggagagcuccucuaaggauuucgugugcuauaaagaagggacuggaccuuguagcgagucagaagagaaggccugcaaaaccagugguuccugccgcggcgacaugcaguuuuguaaggucgcugggugcgaacacggagaggaggcaagcgaagccaaauguagaugcucuuuaguucauaagccaggcgaggugguagugucauacggugggaugaggguccggcccaaauguuacggcuucagucgcaugauggcuacaauggaagugaacccuccagagcagcgaauuggacaaugcaccggcugucaccuggaaugcaucaaugggggaguuagacuuaucacuuugacaagcgagcugaaguccgccaccgugugugcgucucauuuuugcucgagcgcaacguccgguaagaaaucaacugagauucacuuccacaguggcucucuagucgggaagaccgccauacaugugaaaggagcucucguagacggcacagaauuuacuuuugaggguagcuguauguuccccgaugggugcaacgcccuggacugcaccuuuuguagggaguuccuuaagaauccgcacugcuauccugcuaaaaaguggcuguuuaucauuaucguuauauugcucggcuacgcaggacugauguuacugacaaacgugcucaaggccauuggcgucuggggguccugggugaucgcgcccgucaaacuuauguucgccaucaugaagaaacugaugcggaccgugucauguuugguuggaaagcuaauggaucguggucgccaggugauucaugaagaaaucggcgagaauggggagggaaaccacgacgauguaagaauugaaauggcaaggccacggcgaguccgccauuggauguauagcccugugauacugacgauccucgcuauuggccuggccgaggguugcgacgaaaugguucacgcugauucuaaacuuguguccuguagacaggggaguggcaauaugaaggagugcgucacuacaggaagggcccuguugcccagcgugaacccaggccaagaggcaugucuccacuuuaccgcccccgggucuccugacuccaagugccugaaaaucaagguaaaacggaucaauuuaaaguguaaaaagucaaguagcuacuucgugccagaugcucgcaacagaugcacuucgguuaggcguugucggugggcgggagacugccaguccggcugcccgccccauuuuacaucuaauagcuucucagaugacugggcagguaagauggaccgagccgggcugggauuuaguggcuguuccgaugguugcggcggggcugccuguggaugcuucaacgcagccccuucuuguauuuucuggagaaaaugggucgaaaacagccacggcauaaucuggaagguguccccaugcgcugccugggugcccucagcagucauugagcuaaccaugccuagcggggaaguuaggacguuccauccaaugaguggaauccccacccagguguucaaaggcgugucuguaacauaucucgguuccgacauggaggucagcgggcugacugaucuuugugaaauugaggaguugaagucgaaaaagcuggcgcucgcuccgugcaaucaggccggaaugggcgugguugguaaagugggcgaaauccaauguucaucugaggaaagugcacgcaccauaaagaaggacgggugcaucuggaacgccgaucuggucggaauugagcuucggguggacgaugcuguuuguuacuccaaaaucacaagcguggaagccguagcaaauuauucugcuauuccuacuaccaucggcgggcugagauuugagaggagccacgacucccagggaaagauaucaggcaguccauuggauauuacagccauccgcgguagcuucucugucaacuaccgagggcuccggcuguccuuaucagagauuaccgcgacuugcacgggagaagugacaaaugugaguggcugcuacagcuguaugaccggugccaaagucuccaucaagcugcacucuucgaaaaacagcacugcucauguucguugcaagggcgacgagaccgcauuuucagugcuagaagggguacacuccuauacagugagucucucuuucgaucaugccgucguggacgagcagugucagcugaauugcggaggccacgaaagccaaguuacccuuaaggggaacuugauauuucuggaugugcccaaauucgucgacggauccuacaugcagacuuaucauucaacagugccuacgggcgcuaauauccccucuccaaccgacuggcucaacgcccuguuugguaauggguuaagcagauggauucugggaguuaucggcgugcuuuugggcgggcucgcacuguucuuucuaauuauguuccuguuuaagcucggaacuaaacaggucuucaggagucgcacaaagcuggcguga

SEQ ID NO: 11594 - RNA, 3222 nt, Artificial Sequence
  derived and/or modified CDS sequence (opt3) from SFTSV/FTLSV(2011YSC22)__KF711927.1__GP
augaugaaggugaucugguucagcucccuggucugccucguuauucaguguucuggcgacucagggcccauaaucugcgccggaccuauucacaguaacaaaagcgcugcaaucccacaucuucuggguuacuccgagaagauuugucaaaucgauagauugauacacgugucuucgugguuaaggaaucauucacaguuucagggcuauguagggcagcggggaggccgcagccaagugaguuacuauccggccgaaaacuccuacucucgauggagcggucugcuaucccccugcgacgcggauuggcucgggaugcuggucgugaaaaaggcuaaaggaucagacaugaucguuccuggcccaaguuauaagggcaagguguucuuugagcgucccaccuucgauggguacgucggaugggguuguggcagcgggaaaucuagaacagaauccggagagcuuugcucaagcgacaguggcacuucuuccggucuguugccuagcgauagggugcucuggauuggggacguagccugucagccaaugacgcccaucccugaagagaccuuucuggagcugaagucguucucucaguccgaauuuccagauauuugcaaaaucgacggaauaguuuucaaucagugugagggcgaaucacucccgcaacccuuugauguggcauggauggacgucggccacagucauaagauuaucaugcgggagcacaaaacaaagugggugcaggagagcuccucuaaggauuucgugugcuauaaagaagggacuggaccuuguagcgagucagaagagaaggccugcaaaaccagugguuccugccgcggcgacaugcaguuuuguaaggucgcugggugcgaacacggagaggaggcaagcgaagccaaauguagaugcucuuuaguucauaagccaggcgaggugguagugucauacggugggaugaggguccggcccaaauguuacggcuucagucgcaugauggcuacaauggaagugaacccuccagagcagcgaauuggacaaugcaccggcugucaccuggaaugcaucaaugggggaguuagacuuaucacuuugacaagcgagcugaaguccgccaccgugugugcgucucauuuuugcucgagcgcaacguccgguaagaaaucaacugagauucacuuccacaguggcucucuagucgggaagaccgccauacaugugaaaggagcucucguagacggcacagaauuuacuuuugaggguagcuguauguuccccgaugggugcaacgccguugacugcaccuuuuguagggaguuccugaagaauccgcagugcuauccugcuaaaaaguggcuuuuuaucauuaucgugauacuguugggcuacgcaggacucaugcuguuaacaaacguccugaaggccauuggcguguggggguccugggucaucgcgcccgugaaacucauguucgccaucaugaagaaacuuaugcggaccguuucaugucuggugggaaaguugauggaucguggucgccagguaauucacgaagaaaucggcgagaauggggagggaaaccaugacgaugucagaauugaaauggcaaggccacggcgagugcgccacuggauguauagcccuguuauacuaacgauccuggcuauuggccucgccgaggguugcgacgaaauggugcaugcugauucuaaacuggucuccuguagacaagggaguggcaauaugaaggagugcgugacuacaggaagggcccuucugcccagcguaaacccaggccaggaggcauguuugcacuuuaccgcccccgggucuccugacuccaagugccucaaaaucaaggugaaacggaucaauguuaaguguaaaaagucaaguagcuacuucgucccagaugcucgcaacagaugcacuucggugaggcguugucggugggcgggagacugccaguccggcugcccgccccacuuuacaucuaauagcuucucagaugacugggcagguaagauggaccgagccgggcugggauuuaguggcuguuccgaugguugcggcggggcugccuguggaugcuucaacgcagccccuucuuguauuuucuggagaaaauggguggaaaacagccauggcauaaucuggaaggucuccccaugcgcugccuggguucccucagcagugauugaguuaaccaugccuagcggggaagugaggacguuccacccaaugaguggaauccccacccagguauucaaaggcgucucugugacauaucuggguuccgacauggagguuagcgggcuaacugaucucugugaaauugaggagcugaagucgaaaaaguuggcgcuugcuccgugcaaucaagccggaaugggcguggucgguaaagugggcgaaauccaguguucaucugaggaaagugcacgcaccauaaagaaggacgggugcaucuggaacgccgaucugguuggaauugagcuccggguggacgaugcuguauguuacuccaaaaucacaagcgucgaagccguggcaaauuauucugcuauuccuacuaccaucggcgggcugagauuugagaggagccaugacucccagggaaagauaucaggcaguccacuugauauuacagccauccgcgguagcuucucugugaacuaccgagggcugcgguugucccucucagagauuaccgcgacuugcacgggagaagucacaaauguuaguggcugcuacagcuguaugaccggugccaaaguguccaucaagcugcacucuucgaaaaacagcacugcucacguacguugcaagggcgacgagaccgcauuuucaguguuagaagggguccauuccuauacagugagucugucuuucgaucacgccguuguggacgagcagugucaacuaaauugcggaggccaugaaagccaggucacccucaaggggaaccugauauuucuugaugugcccaaauucguugacggauccuacaugcagacuuaucacucaacagugccuacgggcgcuaauauccccucuccaaccgacugguugaacgcccugcucgguaaugggaugagcagauggauucugggagucaucggcguauuacugggcgggcuugcauuguuuuuccucauuauguuucuguucaagcuaggaacuaaacagguguuuaggagucgcacaaagcuggcguga

SEQ ID NO: 11595 - RNA, 3222 nt, Artificial Sequence
  derived and/or modified CDS sequence (opt3) from SFTSV/FTLSV(2011YSC60)__KF711945.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuuguucuuccgauucagguacgagcagugggcuguugccuucugacaggguccucuggaucggagauguggcuugccagccaaugacccccauuccugaagagacauuucuggagcugaaguccuucagccagucggaauuuccagacaucugcaaaauagauggcauuguauucaaucagugugagggcgaaucucucccgcaacccuuugacguugccuggauggauguggggcacucccauaagaucauuaugcgggaguauaaaacuaaguggguccaggagucaaguagcaaggacuucgugugcuacaaagaaggaaccgguccuuguuccgagucugaagagaagacaugcaaaaccagcggcucaugccgcggggacaugcaguuuuguaagguggcaggaugcgaacacggcgaggaggccagugaagcuaaauguagaugcuccuuaguccacaagccaggugagguugugguaagcuacgggggcaugagggugcggcccaaauguuauggauucucucgcaugauggcaacucuggaagucaaccagccugagcaacgaaucggccagugcacagggugucaucuugaaugcaucaauggaggugugagauugauuacccugacgucagagcuaaagagugccacuguuugugcuagccacuuuugcuccucugccaccucgggcaagaaaagcacagagauacaguuccauuccgggucacucgugggaaagacugcgauccacgucaaaggcgcacugguggaugguaccgaguucacauuugaagggaguuguauguucccagacggcugcgaugccguagacugcaccuuuuguagggaguuccuuaagaacccccaaugcuacccggcuaaaaaguggcuguuuauuaucauaguuauuuugcucggauaugccggccugauguuacugacgaaugugcucaaggcaaucgggaucuggggaucuugggucauugcuccugugaaacuuaucuucgccauuauaaagaaacugaugcggacugucagcuguuugauggguaagcuaauggaucguggccgccaggugauccacgaagaaauuggggagaacagagagggaaaucaggacgauguuaggaucgaaauggcgcggccccgacgcgugagacauuggauguacuccccaguaauccugacaauucucgccauaggccuggcagagucaugcgacgaaaugguccacgcugauagcaaacuugugucuuguaggcaggguuccgggaacaugaaggagugcguuaccacuggccgggcccuguugccugcugugaaucccggacaagaggccugucuccauuuuacagcaccaggcagucccgacagcaagugccugcgcaucaaagucaagagaauuaacuuaaaauguaagaaaucuuccucauauuucgugccugaugccaggaaucguugcaccaguguacggcgauguagaugggcuggggacugccagagcggaugcccaccgcacuuuacgucgaacuccuucucugacgauugggcgggcaagauggacagggcaggucugggguuuagcggauguucagauggcugcgguggcgccgcuugugggugcuucaaugccgcacccaguuguaucuuuuggcgcaaguggguggaaaacccucauggaauuaucuggaaaguuuccccaugcgccgcuuggguccccucugccgugauagagcuaaccaugccuagcggcgaagugcggacauuccacccaauguccgggauccccacucaggucuucaagggaguuucagugaccuaccucggcagcgacauggaggugaguggucugacagaucuuugugaaauugaggaguugaaaucuaagaaacuggcacucgcgccgugcaaccaggcugggaugggaguagucggcaaggugggugaaauccaauguuccagcgaggaaucggccagaacuauuaaaaaggacggcugcaucuggaaugcagaucugguugggauagagcuuaggguggacgaugccgucuguuauucaaagauuaccucuguggaagcuguugccaacuacagugcaaucccuacaaccauuggaggccugcgcuuugagcgaucccacgacagccaggggaaaaucucuggaagcccauuggauauaacugcuauccggggcuccuucucagugaauuaccguggucucagacugaguuuaagcgagauuacggccacaugcaccggggaaguaacuaacgucucuggaugcuauuccuguaugaccggcgcgaaggugucaaucaaacugcauaguagcaaaaauuccacagcccacgugaggugcaagggugacgagaccgcuuuuucuguccuagaaggcguucauucguacacugugagccucucauucgaucacgcaguaguggacgagcagugucagcugaacugcgggggacacgaaucccaagucacacuuaagggcaauuugauuuuucuggacgugcccaaguucguugaugggaguuauaugcagacguaccauucuaccgugccuacuggagccaacauccccagcccaacagacuggcucaaugcucuguuuggcaacgguuuaucccgcuggguccugggggugaugggaguucuuuugggcggccucgcccuguucuuuaugauaaugucacuauucaaacuggggaccaaacagguguuucggucuagaacaaagcucgcauga

SEQ ID NO: 11596 - RNA, 3222 nt, Artificial Sequence
  derived and/or modified CDS sequence (opt3) from SFTSV/FTLSV(2011YSH45)__KF711947.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcggacggucucaugucugaugggaaaguugauggaucguggucgccaggugauccaugaggaaauuggcgagaacagagaggggaaucaggacgauguuaggaucgaaauggcgcggccccgacgcgugagacacuggauguauagcccaguaauccuaacuauucuggccauaggacucgcagagucuugcgacgaaaugguccaugcugauuccaaacuggugaguuguaggcagggcagcgguaacaugaaggagugcguuacaaccgggcgggcccuucugccugcugugaaucccggccaagaggccuguuugcacuucacugcaccaggaucucccgacuccaagugccucaaaaucaaggucaaacgcauuaaccuggaauguaagaaaucaaguagcuacuuugugccugaugccagaaauaggugcacaucgguacgucggugucgaugggcuggcgacugccaguccgggugcccaccgcauuucaccucuaacagcuuuucagacgauugggcgggaaagauggacagagcaggcuuagguuucaguggguguuccgauggaugcggcggugccgcuuguggcugcuuuaaugccgcacccucuuguaucuucuggaggaaguggguggagaacccucacgggauuaucuggaaaguuagcccaugcgccgcuuggguccccuccgccgugauagaacugacgaugccuucaggagaggugcgcaccuuccacccaaugagcggcauccccacacaggucuuuaaggggguuagugugacuuaucuaggaucugacauggaaguguccggccucaccgaucugugugagauugaggaacuuaaaagcaagaaauuggcacuggcgccgugcaaccaggcugguauggggguagucggaaaggugggcgagauccaauguucgucagaagagucugcccggacaauuaaaaaggacgguugcaucuggaaugcagaucucguuggcauagaacugagaguggacgaugccgucuguuacaguaagauuacuuccguggaggcuguugccaacuauagcgcaaucccuaccacaauugggggacuuagguucgagcgcucucaugacagccagggcaaaaucuccgggucaccacuggauauaaccgcuauccgaggaaguuuuagcgugaauuaccggggcuugcgucucucucuguccgaaauuacugccacgugcacaggugagguaaccaacgucucagggugcuacaguuguaugacuggagcgaaggugagcaucaaauuacacuccucuagaaauucgaccgcccaugugaggugcaagggcgacgaaacagcuuucagcguccuggaggguguucacucauauaccgugucccuaaguuuugaucacgcaguaguggacgaacagugucagcucaacugcggcgggcaugagucucaagucacucugaaaggaaaucuuauuuucuuggacgugcccaaguuuguugauggcagcuacaugcagacauaucacuccacggugccuaccggggccaacauccccucaccaacugacuggcugaaugcucucuucggaaacggccugucucgcugggucuuaggugugauggggguucugcuuggaggcuuggcccucuuuuucaugauaaugagccuguuuaagcuaggcacaaaacagguguuccggaguagaaccaagcuggcauga

SEQ ID NO: 11597 - RNA, 3222 nt, Artificial Sequence
  derived and/or modified CDS sequence (opt3) from SFTSV/FTLSV(2011YSH52)__KF711928.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuuguucuuccgauucagguacgagcagugggcuguugccuucugacaggguccucuggaucggagauguggcuugccagccaaugacccccauuccugaagagacauuucuggagcugaaguccuucagccagucggaauuuccagacaucugcaaaauagauggcauuguauucaaucagugugagggcgaaucucucccgcaacccuuugacguugccuggauggauguggggcacucccauaagaucauuaugcgggagcacaaaacuaaguggguccaggagucaaguagcaaggacuucgugugcuauaaagaaggaaccgguccuuguuccgagucugaagagaagacaugcaaaaccagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacucuggaagucucacagccugagcaacgaaucggccagugcacagggugucaccuugaaugcaucaacggaggugugagauugauuacccugacgagugagcuaaagagcgccacuguuugugcuucccauuuuuguucuucggccaccagcggcaagaaauccacagagauacaguuccacucagggagucucgugggaaagacugcgauccacgucaaaggcgcacugguggaugguaccgaauuuacauuugaggggucuugcauguucccagacggcugcgaugccguagacugcaccuuuuguagggaguuccuuaagaauccccaaugcuauccggcuaaaaaguggcuguuuauuaucauaguuauuuugcucggauacgccggcuucaugcuguuaacgaacgugcugaaggcaaucggggucuggggaagcugggugaucgcuccugucaaacucguguuugccauuaucaagaaacuuaugcgggcgguuuccugucugauggguaaguugauggaucguggccgccaggugauucaugaagaaauaggggagaauagagagggaaaccaggacgauguaaggaucgaaauggcccggccccgacgcgucagacacuggauguauucaccagugauucuaacuauccuggcaaucggccucgcugaggguugcgacgaaaugguucaugccgauagcaaacuggugucuuguaggcagggguccggcaauaugaaggagugcgucacaaccggacgggcccuucugccugcugugaaccccggccaagaggcauguuugcacuucacugccccagggagucccgacagcaagugccucaaaauuaagguaaaacgcauaaauaagaaauguaagaagucuuccucauacuuugugccugaugcuagauauaggugcacaaguguucgucggugucgaugggcgggagacugccagagcggcugcccaccgcauuucaccucgaacuccuuuucugacgauugggcagguaaaauggacagagccgggcugggauucagcggcuguucagaugguugcggcggggcugccuguggaugcuuuaaugcagcccccaguuguaucuucuggaggaagugggucgaaaacccucacggcauuaucuggaaaguguccccaugcgcugccugggugcccucugcagucauugaguuaacgaugccuagcggggaaguucgcaccuuccacccaauguccggaauccccacacagguguuuaagggcgugucaguaacuuaccuggguagcgacauggaggucagugggcuaucugaucucugugaaauagaggagcuuaauuccaaaaagcuggcguuggcuccgugcaaccaggccggaaugggcgugguugguaaagugggcgaaauccaauguagcucggaggaaucagcacggaccauuaagaaggacgggugcaucagaaacgccgaucuggucggaauugaggugaggguugacgaugcuguguucuauuuuaaaaucacaucuguagaagccgucgcaaauuacagugcuauaccuacuaccauuggcgggcuccgcuucgagcgaucccaugacagccagggaaagaucucuggcagcccacuggauauuacagccauccgggguuccuuuucagugaacuaccgugggcuuagacugaguuugagcgagauaaccgcgacuuguacgggagaagugacaaaugucucuggcugcuauuccugcaugaccggugccaaaguuucaaucaagcuccacaguagcaaaaacuccacugcucaugugagguguaagggcgacgagaccgcauucucuguacuggaaggggugcacucguacagcgucucauuauccuuugaucacgccgugguugacgagcagugccagcugaauuguggaggccaugaaagucaagugacacuacgcgggaaccucauuuuccuggacguccccaaguuuguggauggaucuuauaugcagaccuaccacagcacuguuccuacaggcgcuaauauccccuccccaacggacuggcuuaacgccuuguucgguaaugggcugucacgguggauucucggagugaucggcguccuguuaggcgggcuggcacuuuucuucuugauacucucucuguuuaaacuaggaaccaagcagauuuucagaagcaggacuaaacuggcguga

SEQ ID NO: 11598 - RNA, 3222 nt, Artificial Sequence
  derived and/or modified CDS sequence (opt3) from SFTSV/FTLSV(2011YXX9)__KF711924.1__GP
augaugaaggugaucugguucagcucccuggucugccucguuauucaguguucuggcgacucagggcccauaaucugcgccggaccuauucacaguaacaaaagcgcugcaaucccacaucuucuggguuacuccgagaagauuugucaaaucgauagauugauacacgugucuucgugguuaaggaaucauucacaguuucagggcuauguagggcagcggggaggccgcagccaagugaguuacuauccggccgaaaacuccuacucucgauggagcggucugcuaucccccugcgacgcggauuggcucgggaugcuggucgugaaaaaggcuaaaggaucagacaugaucguuccuggcccaaguuauaagggcaagguguucuuugagcgucccaccuucgauggguacgucggaugggguuguggcagcgggaaaucuagaacagaauccggagagcuuugcucaagcgacaguggcacuucuuccggucuguugccuagcgauagggugcucuggauuggggacguagccugucagccaaugacgcccaucccugaagagaccuuucuggagcugaagucguucucucaguccgaauuuccagauauuugcaaaaucgacggaauaguuuucaaucagugggagggcgaaucacucccgcaacccuuugauguggcauggauggacgucggccacagucauaagauuaucaugcgggagcacaaaacaaagugggugcaggagagcuccucuaaggauuucguguguuauaaagaagggacuggaccuugcagcgagucagaagagaaggccuguaaaaccagugguuccugccgcggcgacaugcaguuuugcaaggucgcugggugugaacacggagaggaggcaagcgaagccaaaugcagauguucuuuaguucauaagccaggcgaggugguagugucauacggugggaugaggguccggcccaaaugcuacggcuucagucgcaugauggcuacaauggaagugaacccuccagagcagcgaauuggacaauguaccggcugccaccuggaauguaucaaugggggaguuagacuuaucacuuugacaagcgagcugaaguccgccaccgugugcgcgucucauuuuuguucgagcgcaacguccgguaagaaaucaacugagauucacuuccacaguggcucucuagucgggaagaccgccauacaugugaaaggagcucucguagacggcacagaauuuacuuuugaggguagcugcauguuccccgauggguguaacgccguugacugcaccuuuugcagggaguuccugaagaauccgcaguguuauccugcuaaaaaguggcuuuuuaucauuaucgugauacuguugggcuacgcaggacucaugcuguuaacaaacguccugaaggccauuggcguguggggguccugggucaucgcgcccgugaaacucauguucgccaucaugaagaaacuuaugcggaccguuucaugccuggugggaaaguugauggaucguggucgccagguaauucacgaagaaaucggcgagaauggggagggaaaccaugacgaugucagaauugaaauggcaaggccacggcgagugcgccacuggauguauagcccuguuauacuaacgauccuggcuauuggccucgccgaggguugugacgaaauggugcaugcugauucuaaacuggucuccugcagacaagggaguggcaauaugaaggagugugugacuacaggaagggcccuucugcccagcguaaacccaggccaggaggcaugcuugcacuuuaccgcccccgggucuccugacuccaagugucucaaaaucaaggugaaacggaucaaucugaagugcaaaaagucaaguagcuacuucguuccagaugcucgcaacagauguacuucggucaggcguugccggugggcgggagacugucaguccggcugcccgccccacuuuacaucuaauagcuucucagaugacugggcagguaagauggaccgagccggguuaggauuuaguggcugcuccgaugguuguggcggggcugccugcggauguuucaacgcagccccuucuugcauuuucuggagaaaauggguggaaaacagccauggcauaaucuggaagguguccccaugugcugccuggguccccucagcaguuauugagcugaccaugccuagcggggaagugaggacguuccacccaaugaguggaauccccacccagguguucaaaggcguaucugucacauaucuagguuccgacauggaggugagcgggcucacugaucugugcgaaauugaggagcuuaagucgaaaaaguuggcgcuggcuccguguaaucaagccggaaugggcguuguggguaaagucggcgaaauccagugcucaucugaggaaagugcacgcaccauaaagaaggacggguguaucuggaacgccgaucucgugggaauugagcugcggguugacgaugcugugugcuacuccaaaaucacaagcguagaagccgucgcaaauuauucugcuauuccuacuaccaucggcgggcuuagauuugagaggagccaugacucccagggaaagauaucaggcaguccacuggauauuacagccauccgcgguagcuucucugugaacuaccgaggguugcggcucucccugucagagauuaccgcgacuuguacgggagaagugacaaaugucaguggcugcuacagcugcaugaccggugccaaaguuuccaucaaguuacacucuucgaaaaacagcacugcucacgugcguuguaagggcgacgagaccgcauuuucaguacuggaaggggugcauuccuauacagucagucuaucuuucgaucacgccgugguugacgagcagugccaacucaauuguggaggccaugaaagccaggugacccugaaggggaaccuuauauuuuuggauguccccaaauucguggacggauccuacaugcagacuuaucacucaacaguuccuacgggcgcuaauauccccucuccaaccgacuggcugaacgcccucuuugguaaugggcugagcagauggauuuuaggagugaucggcguccugcuuggcggguuggcacucuucuuucugauuauguuccuauuuaagcugggaacuaaacagguauucaggagucgcacaaagcucgcguga

SEQ ID NO: 11599 - RNA, 3222 nt, Artificial Sequence
  derived and/or modified CDS sequence (opt3) from SFTSV/FTLSV(2012YGS10)__KF711937.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcggacggucucaugucugaugggaaaguugauggaucguggucgccaggugauccaugaggaaauuggcgagaacagagaggggaaucaggacgauguuaggaucgaaauggcgcggccccgacgcgugagacacuggauguauagcccaguaauccuaacuguccuggccauuggacucgcagagucuugcgacgaaauggugcaugcugauuccaaacugguuaguuguaggcagggcagcgguaacaugaaggagugcgugacaaccgggcgggcccuucugccugcugucaaucccggccaagaggccuguuugcacuucacugcaccaggaucucccgacuccaagugccucaaaauaaaggugaaacgcaucaaccugaaguguaaaaagucaaguagcuacuuuguaccugaugccagaucgaggugcacauccgugcgucggugucgaugggcuggcgacugccagucugggugcccaccgcauuucaccagcaauucauuuagugacgauugggcgggaaagauggacagagcaggcuuagguuucuccggguguucugauggaugcggcggugccgcuuguggcugcuuuaacgccgcacccagcuguauuuucuggaggaaauggguugaaaauccucacgggaucauuuggaaggucuccccaugcgccgcuugggugcccucagccgugaucgagcugacgaugccuagcggagaaguccgcaccuuccacccaaugaguggcauacccacacagguuuuuaaaggggugucugugacuuaucuaggauccgacauggagguaagcggccucaccgaucugugugaaaucgaggagcuuaagucgaaaaaguuggcacuggcgccgugcaaccaggcugguaugggggucgugggaaaaguuggcgaaauucaauguucaucugaggaaagugcccggacaaucaagaaggacgguugcauuuggaacgcagaucucgugggcaucgagcugagagucgacgaugccguguguuacuccaaaauaacuagcguugaagcuguggccaauuauucugcaauuccuaccacaaucgggggacuuagguucgagcgcagccaugacucccagggcaagauuucagggaguccacuggauaucaccgcuauacgaggcagcuuuucuguaaacuaccggggauugcgucucucccugucagagaucacugccacgugcacaggugaagucaccaaugugagugggugcuacagcuguaugacuggagcgaaaguguccauuaaguuacacucuucgaaaaacagcaccgcccaugucagaugcaagggcgacgagacagcuuucucaguucuggaaggugugcacuccuauaccguaagucuaucuuuugaucacgcaguggucgacgagcagugucagcucaauugcggcgggcaugaaagccaagugacucugaagggaaaccuuaucuucuuggacguucccaaauuuguggauggcuccuacaugcagacauaucacucaacggucccuaccggggccaauauucccucuccaacugacuggcugaacgcucucuucggaaauggccugaguagguggaucuuaggugugauagggguucugcuuggaggcuuggcccucuuuuucaugauuaugagccuguuuaagcuaggcacaaaacagguguuccgcucccggaccaagcuggcauga

SEQ ID NO: 11600 - RNA, 3222 nt, Artificial Sequence
  derived and/or modified CDS sequence (opt3) from SFTSV/FTLSV(2012YGS4)__KF711933.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcggacggucucaugucugaugggaaaguugauggaucguggucgccaggugauccaugaggaaauuggcgagaacagagaggggaaucaggacgauguuaggaucgaaauggcgcggccccgacgcgugagacacuggauguauagcccaguaauccuaacuauucuggccauaggacucgcagagucuugcgacgaaaugguccaugcugauuccaaacuggugaguuguaggcagggcagcgguaacaugaaggagugcguuacaaccgggcgggcccuucugccugcugugaaucccggccaagaggccuguuugcacuucacugcaccaggaucucccgacuccaagugccucaaaaucaaggucaaacgcauuaaccugaaguguaaaaagucaaguagcuacuuugugccugaugccagaucgaggugcacauccguacgucggugucgaugggcuggcgacugccagucugggugcccaccgcauuucaccagcaauucauuuagugacgauugggcgggaaagauggacagagcaggcuuagguuucuccggguguucugauggaugcggcggugccgcuuguggcugcuuuaacgccgcacccagcuguaucuucuggaggaaauggguggaaaauccucacgggauuaucuggaagguuuccccaugcgccgcuuggguccccucagccgugauagagcugacgaugccuagcggagaagugcgcaccuuccacccaaugaguggcauccccacacaggucuuuaaagggguuucugugacuuaucuaggauccgacauggaggugagcggccucaccgaucugugugaaauugaggagcuuaagucgaaaaaguuggcacuggcgccgugcaaccaggcugguauggggguagucggaaaagugggcgaaauccaauguucaucugaggaaagugcccggacaauuaagaaggacgguugcaucuggaacgcagaucucguuggcauagagcugagaguggacgaugccgucuguuacuccaaaauuacuagcguggaagcuguugccaauuauucugcaaucccuaccacaauugggggacuuagguucgagcgcagccaugacucccagggcaagaucucagggauaccacuggauaucaccgcuauucgaggaaguuuuagcgugaacuaccggggcuugcgucucucucuguccgagaucacugccacgugcacaggugaaguaaccaaugucucagggugcuacaguuguaugacuggagcgaaagugagcauuaaguuacacuccucuaaaaacucgaccgcccaugugagaugcaagggcgacgagacagcuuucagcguccuggaagguguucacucauauaccgugucccuaaguuuugaucacgcaguaguggacgagcagugucagcucaauugcggcgggcaugaaucucaagucacucugaagggaaaccuuaucuucuuggacgugcccaaauuuguugauggcagcuacaugcagacauaucacuccacggugccuaccggggccaauauacccucaccaacugacuggcugaacgcucucuucggaaauggccugucuagguggauuuuaggugucaucggggugcugcuuggaggcuuggcccucuuuuucaugaucaugagccuguuuaagcuaggcacaaaacagguuuuccgcagucggaccaagcuggcauga

SEQ ID NO: 11601 - RNA, 3222 nt, Artificial Sequence
  derived and/or modified CDS sequence (opt3) from SFTSV/FTLSV(2012YSC6)__KF711931.1__GP
augaugaaggugaucugguucagcucccugauuugcuuugucauacaguguucuggcgggucaggacccaucauuugcgccgguccuauccacaguaacaaaagcgcugacauuccacaucuccuuggcuacuccgagaagaucugucaaauagauagacugauccacguuucuucgugguugaggaaucauucacaguuccagggguaugugggacagcggggcggucgcagccaaguaaguuacuauccggcagaaaacuccuacucucgauggagcggguuacugucccccugcgacgccgauuggcuaggaaugcucguggucaaaaaggcgaaaggcucagacaugauugugccuggcccaaguuauaaggggaagguuuucuucgagcgucccaccuuugauggauacguggguuggggcugugggagcggaaaaucuagaacagaauccggcgagcugugcucaagcgacagugguacuucuuccgggcuucugccuagcgauagggucuuguggaucggagacguggcuugucagccaaugacgcccauuccugaagagaccuuccucgagcugaagucguuuucucaguccgaauuuccagauaucugcaaaauagacggcauuguauuuaaucagugugagggcgaaucacugccgcaacccaucgauguugccuggauggacguggggcacagucauaagauuaucaugcgggagcacaaaacaaaguggguccaggagagcuccucuaaggauuucgugugcuauaaagaaggaacugguccuuguagcgagucagaagagaagaccugcaaaacaaguggcuccugccgcggggacaugcaguuuuguaagguggcaggaugcgaacacggcgaggaggccagcgaagcuaaauguagaugcucucucguccauaagccaggugagguugugguaucauacgggggcaugagggugcggcccaaauguuacggauucagucgcaugauggcaaccuuagaagucaaccagccugagcaacgaaucggccagugcacugggugucaccuggaaugcauuaauggaggugugagacuuauaacauugaccagcgagcugaaguccgccacgguuugugcuucucauuuuugcucgagcgccacuuccggcaagaaaucaaccgagauccaguuccacagugggucucuagugggaaagacagcgauucacgucaaaggcgcacucguggacgguacugaauuuaccuuugaggggagcuguauguucccagauggcugcgacgccguagauugcacauuuuguagggaguuccugaagaacccccaaugcuauccggcuaaaaaguggcuuuuuaucauaauuguuauccuguugggauacgccggccucaugcuguuaaccaaugugcugaaggcaaucgggauuuggggauccugggucaucgcuccugugaaacucauuuucgccauaaucaagaaacuuaugcggacggucucaugucugauggguaaguugauggaccguggccgccaggugauucaugaagaaaucggggagaacagagagggaaaucaggaugacguuaggaucgaaauggcgcggccccgacgcgugagacacuggauguauagcccaguaauucuaacuauacuggccaucggccucgcagagucuugcgaugaaaugguccaugcugacuccaaacuggugaguuguaggcaggguagcgggaacaugaaggagugcguuacaaccggccgggcccuucugccugcugugaaucccggacaagaggccuguuugcacuuuacugcaccaggcucucccgauuccaagugccucaaaauuaaggucaaacgcaucaaccugaaguguaaaaagucaaguagcuacuucgugccugacgccagaucgaggugcacauccguacgucggugucgaugggcuggggauugccagucuggaugcccaccgcauuuuaccagcaauucauucagugacgacugggcgggcaagauggauagagcagguuuaggguuuuccggauguucugacggcugcgguggcgccgcuugugggugcuucaacgccgcacccagcuguauuuucuggaggaaauggguggaaaauccucacggaaucauauggaagguuuccccaugcgccgcuuggguccccucagccgugaucgagcugacgaugccuagcggcgaagugcgcaccuuccacccaaugagugggauucccacacaggucuucaaaggaguuucugugacuuaucuaggcuccgauauggaggugagcggucucaccgaccugugugaaaucgaggagcuuaagucgaaaaaguuggcacuggcgccgugcaaccaggcugggaugggaguagucggcaaagugggugaaauucaauguucaucugaggaaagugcccggacaaucaagaaggauggcugcauauggaacgcagaccucguugggauugagcugagaguggaugacgccgucuguuacuccaaaaucacuagcguggaagcuguugccaauuauucugcaauuccuaccacaaucggaggccuuagguuugagcgcagccaugauucccaggggaagauaucaggaaguccacuggacaucaccgcuauucgaggcagcuucucugugaacuaccgggguuugcgucucucccugucagagaucacugccacgugcacaggggaaguaaccaaugucaguggaugcuacagcuguaugacuggcgcgaaaguguccauuaaguuacacucuucgaaaaacagcaccgcccaugugagaugcaagggugaugagacagcuuuuucaguccuggaaggcguucacuccuauaccgugagucuaucuuucgaccacgcaguaguggaugagcagugucagcucaauugcgggggacaugaaagccaagucacucugaagggcaaccuuaucuuuuuggacgugcccaaauucguugacggguccuacaugcagacauaucacucaacggugccuaccggagccaauauacccucuccaacugauuggcugaacgcucucuuuggcaauggucugaguagguggauuuuaggggucaucggagugcugcuuggcggcuuggcccucuucuuuaugaucaugagccuguucaagcuagggacaaaacagguuuuucgcucccggaccaagcuggcauga

SEQ ID NO: 11602 - RNA, 3222 nt, Artificial Sequence
  derived and/or modified CDS sequence (opt3) from SFTSV/FTLSV(2012YSH10)__KF711940.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcaauagggucuuguggaucggggacguggcuugucagccaaugacgcccauuccugaagagaccuuccucgagcugaagucguuuucucaguccgaauuuccagauaucugcaaaauagacggaauuguauuuaaccagugugagggcgaaucacugccgcaacccuucgauguugccuggauggacgugggccacagucauaagaucauuaugcgggagcacaaaacaaaguggguccaggagagcuccucuaaggauuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaucagccugagcaacgaaucggacagugcacuggcugucaccuggaaugcaucaacgggggagugagacuuauuacauugaccagcgagcugaaguccgccacgguuugugcuucucauuucugcucgagcgccauguccgguaagaaaucaacugagauacaguuccacaguggcucucuaguggggaagaccgcgauccacgucaaaggagcacucguggacggcacagaauuuacuuucgaggguagcuguauguuuccagaugggugcgacgccguagauugcaccuucuguagggaauuucugaagaauccccaaugcuauccggcuaaaaaguggcuuuucauuaucauaguuauucuguugggcuacgccggacucaugcuguuaacaaacgugcugaaggcaaucggcaucuggggguccugggucauugcuccugugaaacucaucuuugccauuauaaagaaacuuaugcggaccgucucaugucugaugggaaaguugauggaccguggucgccaggugauccaugaggaaauuggcgagaauagagaggggaaccaggaugacguuaggaucgaaauggcgcggccccgacgcgugagacacuggauguauagcccaguaauccuaacgauucuggccauaggacucgcagagucuugcgaugaaaugguccaugcugacuccaaacuggugaguuguaggcagggcagcgguaauaugaaggagugcguuacuacagggcgggcccuucugccugcugugaaccccggccaagaggccuguuugcacuucaccgcaccaggaucucccgauuccaagugccuccgcaucaaagucaagagaauuaaucugaaauguaagaaaucaaguagcuacuuugugccugacgccaggucgcguugcacuuccguacggcgauguagaugggcuggcgauugccagucugggugcccaccgcauuucacaagcaacucauuuagugacgacugggcgggaaagauggauagggcaggcuuagguuucuccggguguucugacggaugcggcggugccgcuuguggcugcuuuaaugccgcacccagcuguaucuucuggcgcaaguggguggaaaacccucacgggauuaucuggaaaguuuccccaugcgccgcuuggguccccucagccgugauagagcugaccaugccuagcggagaagugcggacguuccacccaaugaguggcauccccacccaggucuuuaaggggguuucugugacauaucuaggauccgauauggaggugagcggccucacugaccugugugaaauugaggagcuuaaaucgaagaaauuggcacuggcgccgugcaaccaggcugguauggggguagucggaaaggugggcgaaauccaauguucaucugaggaaagugccagaaccauuaaaaaggaugguugcaucuggaaugcagaccucguuggcauagagcugaggguggaugacgccgucuguuacuccaagauuacaagcguggaagcuguugccaacuauucugcaaucccuacuaccauugggggacuucgcuucgagcgaagccaugauucccagggcaaaaucucagggaguccacuggacauaacagcuauccggggcagcuuuucugugaauuaccguggauugagacucucccugucagagauuaccgccacuugcacgggugaaguaacaaacgucagugggugcuacagcuguaugaccggagcgaagguguccaucaaauuacacucuucgaagaauagcacugcccaugugaggugcaaaggcgaugagaccgcuuucucaguccuggaagguguucacuccuauacagugagucuaucuuuugaccacgcaguaguggaugagcagugucagcucaacugcggcgggcaugaaagccaagucacccugaagggaaaucuuauuuucuuggacgugcccaaguuuguugacggcuccuacaugcagacuuaucacucaacagugccuacgggggccaacauccccucuccaaccgauuggcugaaugcucucuucggaaacggccugagccgcugggucuuaggugugauggggguucugcuuggaggcuuggcccucuuuuucaugauaaugagucuguuuaaacuaggcacuaaacagguguuccgguccagaacaaagcuggcauga

SEQ ID NO: 11603 - RNA, 3222 nt, Artificial Sequence
  derived and/or modified CDS sequence (opt3) from SFTSV/FTLSV(2012YSH104)__KF711943.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcaauagggucuuguggaucggggacguggcuugucagccaaugacgcccauuccugaagagaccuuccucgagcugaagucguuuucucaguccgaauuuccagauaucugcaaaauagacggaauuguauuuaaccagugugagggcgaaucacugccgcaacccuucgauguugccuggauggacgugggccacagucauaagaucauuaugcgggagcacaaaacaaaguggguccaggagagcuccucuaaggauuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaucagccugagcaacgaaucggacagugcacuggcugucaccuggaaugcaucaacgggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggacggcacugaauuuaccuucgaggguagcuguauguuuccagaugggugcgacgccguagauugcacauucuguaggaaguuucugaaaaauccccaaugcuauccggcuaagaaguggcuuuucauuaucauaguuauucuguugggcuacgccggacucaugcuguuaaccaacgugcugaaagcaaucggcaucuggggguccugggucauugcuccugugaagcucaucuuugccauuauaaagaaacuuacgcggacugucucaugucugaugggaaaauugauggaccguggucgccaggugauccaugaagagauuggcgaaaauagagaggggaaccaggaugacguuaggaucgagauggcgcggccccgacgcgugagacacuggauguauagcccaguaauccuaacaauucuggccauaggacucgcagaaucuugcgaugagaugguccaugcugacuccaagcuggugaguuguaggcagggcagcgguaauaugaaggaaugcguuaccacugggcgggcccuucugccugcugugaaccccggccaagaggccuguuugcacuucacagcaccaggaucucccgauuccaaaugccuccgcaucaaggucaaaagaauuaaucugaaguguaaaaagucaaguagcuacuuugugccugacgccagguaucguugcaccucgguacggcgauguagaugggcuggcgauugccaguccgggugcccaccgcauuucacgucuaacagcuuuucagacgacugggcgggaaagauggauagggcaggcuuagguuucaguggguguuccgacggaugcggcggugccgcuuguggcugcuuuaaugccgcacccucuuguaucuucuggcgcaaauggguggagaacccucacgggauuaucuggaagguuagcccaugcgccgcuuggguccccuccgccgugauagaacugaccaugccuucaggagaggugcggacauuccacccaaugagcggcauccccacucaggucuuuaaagggguuagugugaccuaccuaggaucugauauggaaguguccggccucacagaccugugugagauugaggaacuuaagagcaaaaaguuggcacuggcgccgugcaaccaggcugguauggggguagucggaaaagugggcgagauccaauguucgucagaagagucugccagaacuauuaagaaggaugguugcaucuggaaugcagaccucguuggcauagaacugaggguggaugacgccgucuguuauaguaaaauuaccuccguggaggcuguugccaacuacagcgcaaucccuacaaccauugggggacuucgcuucgaacgaucucaugauagccagggcaagaucuccgggucaccacuggacauaacugcuauccggggaaguuuuagcgugaauuaccguggcuugagacucucucuguccgagauuacggccacaugcaccggugagguaacuaacgucucagggugcuauaguuguaugaccggagcgaaagugagcaucaaguuacacuccucuaaaaauucgacagcccaugugaggugcaagggcgaugaaaccgcuuucagcguccuggaggguguucacucauacacugugucccuaaguuuugaccacgcaguaguggaugaacagugucagcucaacugcggcgggcaugagucucaagucacacugaagggaaaucuuauuuucuuggacgugcccaaauuuguugacggcagcuauaugcagacguaccacuccaccgugccuacuggggccaacauccccucaccaacagauuggcugaaugcucucuucggaaacggccugucucgcugggucuuaggugugauggggguucugcuuggaggcuuggcccucuuuuucaugauaaugagccuguuuaagcuaggcaccaaacagguguuccggaguagaacaaagcuggcauga

SEQ ID NO: 11604 - RNA, 3222 nt, Artificial Sequence
  derived and/or modified CDS sequence (opt3) from SFTSV/FTLSV(2012YSH105)__KF711944.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcaauagggucuuguggaucggggacguggcuugucagccaaugacgcccauuccugaagagaccuuccucgagcugaagucguuuucucaguccgaauuuccagauaucugcaaaauagacggaauuguauuuaaccagugugagggcgaaucacugccgcaacccuucgauguugccuggauggacgugggccacagucauaagaucauuaugcgggagcacaaaacaaaguggguccaggagagcuccucuaaggauuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaucagccugagcaacgaaucggacagugcacuggcugucaccuggaaugcaucaacgggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggacggcacugaauuuaccuucgaggguagcuguauguuuccagaugggugcgacgccguagauugcacauucuguagggaauuucugaagaauccccaaugcuauccggcuaaaaaguggcuuuucauuaucauaguuauucuguugggcuacgccggacucaugcuguuaaccaacgugcugaaggcaaucggcaucuggggguccugggucauugcuccugugaaacucaucuuugccauuauaaagaaacuuaugcggacggucucaugucugaugggaaaguugauggaccguggucgccaggugauccaugaggaaauuggcgagaauagagaggggaaccaggaugacguuaggaucgaaauggcgcggccccgacgcgugagacacuggauguauagcccaguaauccuaacuauucuggccauaggacucgcagagucuugcgaugaaaugguccaugcugacuccaaacuggugaguuguaggcagggcagcgguaauaugaaggagugcguuacaaccgggcgggcccuucugccugcugugaaccccggccaagaggccuguuugcacuucacugcaccaggaucucccgauuccaagugccuccgcaucaaagucaagagaauuaaucugaaauguaagaaaucaaguagcuacuuugugccugacgccaggucgcguugcacauccguacggcgauguagaugggcuggcgauugccagucugggugcccaccgcauuucaccagcaacucauuuaguggagacugggcgggcaagauggacagggcagguuuaggguucuccggauguucugauggcugcgguggcgccgcuugugggugcuuuaaugccgcacccagcuguaucuucuggcgcaaguggguggaaaacccucacggaauuaucuggaaaguuuccccaugcgccgcuuggguccccucagccgugauagagcugacgaugccuagcggcgaagugcggaccuuccacccaaugagugggauccccacacaggucuuuaagggaguuucugugacuuaucuaggcuccgacauggaggugagcggucucaccgaucugugugaaauugaggagcuuaaaucgaagaaauuggcacuggcgccgugcaaccaggcugggaugggaguagucggcaaggugggugaaauccaauguucaucugaggaaagugccagaacaauuaaaaaggacggcugcaucuggaaugcagaucucguugggauagagcugaggguggacgaugccgucuguuacuccaagauuacuagcguggaagcuguugccaacuauucugcaaucccuaccacaauuggaggccuucgcuucgagcgaagccaugacucccaggggaaaaucucaggaaguccacuggauauaaccgcuauccggggcagcuuuucugugaauuaccgugguuugagacucucccugucagagauuacugccacgugcacaggggaaguaaccaacgucaguggaugcuacagcuguaugacuggcgcgaagguguccaucaaauuacacucuucgaagaauagcaccgcccaugugaggugcaaaggugacgagacagcuuucucaguccuggaaggcguucacuccuauaccgugagucuaucuuuugaucacgcaguaguggacgagcagugucagcucaacugcgggggacaugaaagccaagucacucugaagggcaaucuuauuuucuuggaugugcccaaguuuguugacggguccuacaugcagacauaucacucaacggugccuaccggagccaacauccccucuccaacugacuggcugaaugcucucuucggcaacggucugagccgcuggauauuaggggucaugggagugcugcuuggcggcuuggcccucuuuuucaugauuaugagucuguuuaaacuagggacaaagcagguuuuccgguccagaaccaaacuggcauga

SEQ ID NO: 11605 - RNA, 3222 nt, Artificial Sequence
  derived and/or modified CDS sequence (opt3) from SFTSV/FTLSV(2012YSH107)__KF711942.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcaauagggucuuguggaucggggacguggcuugucagccaaugacgcccauuccugaagagaccuuccucgagcugaagucguuuucucaguccgaauuuccagauaucugcaaaauagacggaauuguauuuaaccagugugagggcgaaucacugccgcaacccuucgauguugccuggauggacgugggccacagucauaagaucauuaugcgggagcacaaaacaaaguggguccaggagagcuccucuaaggauuuugugugcuauaaagaagggacuggaccuuguagcgagucagaagagaagaccgguaaaacaaguggcuccugccgcggggacaugcaguucugcaagguggcaggaugugaacacggcgaggaggccagcgaagcuaaaugcagauguucucucguccauaagccaggugagguugugguaucauacgggggcaugagggugcggcccaaaugcuacggauuuagucgcaugauggcaaccuuagaagucaaucagccugagcaacgaaucggccaguguacugggugccaccuggaauguaucaacggaggugugagacuuauuacauugaccagcgagcugaaguccgccacgguuugcgcuucucauuucuguucgagcgccacuuccggcaagaaaucaaccgagauacaguuccacagugggucucuagugggaaagacagcgauccacgucaaaggcgcacucguggacgguacugaauuuaccuucgaggggagcugcauguuuccagauggcugugacgccguagauugcacauucugcagggaauuucugaagaauccccaauguuauccggcuaaaaaguggcuuuucauuaucauaguuauucuguugggauacgccggccucaugcuguuaaccaacgugcugaaggcaaucgggaucuggggauccugggucauugcuccugugaaacucaucuuugccauuauaaagaaacuuaugcggacggucucaugccugauggguaaguugauggaccguggccgccaggugauccaugaggaaauuggggagaauagagagggaaaccaggaugacguuaggaucgaaauggcgcggccccgacgcgugagacacuggauguauagcccaguaauccuaacuauucuggccauaggccucgcagagucuugugaugaaaugguccaugcugacuccaaacuggugaguugcaggcaggguagcgggaauaugaaggaguguguuacaaccggccgggcccuucugccugcugugaaccccggacaagaggccugcuugcacuucacugcaccaggcucucccgauuccaagugucuccgcaucaaagucaagagaauuaaucugaaaugcaagaaaucaaguagcuacuuugugccugacgccagguaucguuguacaucgguacggcgaugcagaugggcuggggauugucaguccggaugcccaccgcauuucaccucuaacagcuuuucagacgacugggcgggcaagauggauagggcagguuuaggguucaguggaugcuccgacggcugugguggcgccgcuugcggguguuuuaaugccgcacccucuugcaucuucuggcgcaaguggguggaaaacccucacggaauuaucuggaaaguuagcccaugugccgcuuggguccccuccgccgugauagagcugacgaugccuucaggcgaagugcggaccuuccacccaaugagcgggauccccacacaggucuuuaagggaguuagugugacuuaccuaggcucugauauggagguguccggucucaccgaccugugcgaaauugaggagcuuaaaagcaagaaauuggcacuggcgccguguaaccaggcugggaugggaguagucggcaaggugggugaaauccaaugcucgucagaggaaucugccagaacaauuaaaaaggauggcuguaucuggaaugcagaccucguugggauagagcugaggguggaugacgccgucugcuauaguaagauuacuuccguggaagcuguugccaacuacagcgcaaucccuaccacaauuggaggccuucgcuucgagcgaucucaugauagccaggggaaaaucuccggaucaccacuggacauaaccgcuauccggggcaguuuuagcgugaauuaccgugguuugagacucucucuguccgagauuacugccacguguacaggggaaguaaccaacgucucaggaugcuauaguugcaugacuggcgcgaaggugagcaucaaauuacacuccucuaaaaauucgaccgcccaugugagguguaagggugaugagacagcuuucagcguccuggaaggcguucacucauacaccgugucccuaaguuuugaccacgcaguaguggaugagcagugccagcucaacugugggggacaugaaucucaagucacucugaagggcaaucuuauuuucuuggacgugcccaaguuuguugacgggagcuauaugcagacauaccacuccacggugccuaccggagccaacauccccucaccaacugauuggcugaaugcucucuucggcaacggucugucucgcugggucuuaggggugaugggaguucugcuuggcggcuuggcccucuuuuucaugauaaugagccuguuuaaacuagggacaaaacagguguuccggaguagaaccaagcuggcauga

SEQ ID NO: 11606 - RNA, 3222 nt, Artificial Sequence
  derived and/or modified CDS sequence (opt3) from SFTSV/FTLSV(2012YSH14)__KF711938.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucauugggggagugagacuuauaacauugaccagcgagcugaaguccgccacgguuugugcuucucauuucugcucgagcgccacuuccgguaagaaaucaaccgagauccaguuccacaguggcucucuaguggggaagacagcgauucacgucaaaggagcacucguggauggcacugaauuuaccuucgaggguagcuguauguuuccagacgggugcgaugccguagacugcacauucuguagggaauuucugaagaauccccaaugcuauccggcuaaaaaguggcuuuucaucauaauuguuauccuguugggcuacgccggacucaugcuguuaaccaacgugcugaaggcaaucggcauuuggggguccugggucaucgcuccugugaaacucauuuuugccauaaucaagaaacuuaugcggacggucucaugucugaugggaaaguugauggaucguggucgccaggugauucaugaggaaaucggcgagaauagagaggggaaccaggacgauguuaggaucgaaauggcgcggccccgacgcgugagacacuggauguauagcccaguaauucuaacuauacuggccaucggacucgcagagucuugcgacgaaaugguccaugcugauuccaaacuggugaguuguaggcagggcagcgguaauaugaaggagugcguuacaaccgggcgggcccuucugccugcugugaaccccggccaagaggccuguuugcacuucacugcaccaggaucucccgacuccaagugccucaaaauuaaggucaaacgcaucaaucugaaguguaaaaagucaaguagcuacuuugugccugaugccagaucgaggugcacauccguacgucggugucgaugggcuggcgacugccagucugggugcccaccgcauuucaccagcaacucauuuagugacgauugggcgggaaagauggacagagcaggcuuagguuucuccggguguucugauggaugcggcggugccgcuuguggcugcuuuaaugccgcacccagcuguauuuucuggaggaaauggguggaaaacccucacgggaucauauggaagguuuccccaugcgccgcuuggguccccucagccgugaucgagcugacgaugccuagcggagaagugcgcaccuuccacccaaugaguggcauucccacacaggucuuuaaagggguuucugugacuuaucuaggauccgacauggaggugagcggccucaccgaucugugugaaaucgaggagcuuaagucgaaaaaguuggcacuggcgccgugcaaucaggcugguauggggguagucggaaaagugggcgaaauucaauguucaucugaggaaagugcccggacaaucaagaaggacgguugcauauggaacgcagaucucguuggcauugagcugagaguggacgaugccgucuguuacuccaaaaucacuagcguggaagcuguugccaacuauucugcaauuccuaccacaaucgggggacuuagguucgagcgcagccaugacucccagggcaagauaucagggaguccacuggauaucaccgcuauucgaggcagcuuuucugugaauuaccggggauugcgucucucccugucagagaucacugccacgugcacaggugaaguaaccaacgucagugggugcuacagcuguaugacuggagcgaaaguguccauuaaguuacacucuucgaaaaauagcaccgcccaugugagaugcaagggcgacgagacagcuuucucaguccuggaagguguucacuccuauaccgugagucuaucuuuugaucacgcaguaguggacgagcagugucagcucaacugcggcgggcaugaaagccaagucacucugaagggaaaucuuaucuucuuggacgugcccaaauuuguugauggcuccuacaugcagacauaucacucaacggugccuaccggggccaacauacccucuccaacugacuggcugaaugcucucuucggaaacggccugaguagguggauuuuaggugucaucggggugcugcuuggaggcuuggcccucuuuuucaugaucaugagccuguuuaagcuaggcacaaaacagguuuuccgcucccggaccaagcuggcauga

SEQ ID NO: 11607 - RNA, 3222 nt, Artificial Sequence
  derived and/or modified CDS sequence (opt3) from SFTSV/FTLSV(2012YSH16)__KF711934.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcggacggucucaugucugaugggaaaguugauggaucguggucgccaggugauccaugaggaaauuggcgagaacagagaggggaaucaggacgauguuaggaucgaaauggcgcggccccgacgcgugagacacuggauguauagcccaguaauccuaacuauucuggccauaggacucgcagagucuugcgacgaaaugguccaugcugauuccaaacuggugaguuguaggcagggcagcgguaacaugaaggagugcguuacaaccgggcgggcccuucugccugcugugaaucccggccaagaggccuguuugcacuucacugcaccaggaucucccgacuccaagugccucaaaaucaaggucaaacgcauuaaccugaaguguaaaaagucaaguagcuacuuugugccugaugccagauauaggugcacaucgguacgucggugucgaugggcuggcgacugccaguccgggugcccaccgcauuucaccucuaauagcuuuucagacgauugggcgggaaagauggacagagcaggcuuagguuucaguggguguuccgauggaugcggcggugccgcuuguggcugcuuuaacgccgcacccucuuguaucuucuggaggaaauggguggaaaauccucacgggauuaucuggaagguuagcccaugcgccgcuuggguccccuccgccgugauagagcugacgaugccuucaggagaagugcgcaccuuccacccaaugagcggcauccccacacaggucuuuaaagggguuagugugacuuaccuaggaucugacauggagguguccggccucaccgaucugugugaaauugaggagcuuaagagcaaaaaguuggcacuggcgccgugcaaccaggcugguauggggguagucggaaaagugggcgaaauccaauguucgucagaggaaucugcccggacaauuaagaaggacgguugcaucuggaacgcagaucucguuggcauagagcugagaguggacgaugccgucuguuauaguaaaauuacuuccguggaagcuguugccaauuacagcgcaaucccuaccacaauugggggacuuagguucgagcgcucucaugacagccagggcaagaucuccgggucaccacuggauauaaccgcuauccgaggaaguuuuagcgugaacuaccggggcuugcgucucucucuguccgagauuacugccacgugcacaggugaaguaaccaaugucucagggugcuauaguuguaugacuggagcgaaagugagcaucaaguuacacuccucuaaaaacucgaccgcccaugugagaugcaagggcgacgagacagcuuucagcguccuggaagguguucacucauacaccgugucccuaaguuuugaucacgcaguaguggacgagcagugucagcucaauugcggcgggcaugaaucucaagucacucugaagggaaaccuuauuuucuuggacgugcccaaauuuguugauggcagcuauaugcagacauaccacuccacggugccuaccggggccaauauccccucaccaacugacuggcugaacgcucucuucggaaauggccugucuagguggauauuaggugucauuggggugcugcuuggaggcuuggcccucuuuuucaugaucaugagccuguuuaagcuaggcacaaaacagguuuuccgcagucggaccaagcuggcauga

SEQ ID NO: 11608 - RNA, 3222 nt, Artificial Sequence
  derived and/or modified CDS sequence (opt3) from SFTSV/FTLSV(2012YSH6)__KF711921.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggaaugggcugcuaagccccugcgacgccgauuggcucggaaugcugguggucaaaaaggcgaaagaguccgacaugauugugccuggcccaucauauaagggcaagguuuucuuugaacgucccaccuucgauggguacgugggaugggguuguggcagugggaaaagcagaacagagucuggagaacuuugcuccucagacagcggcacuuccucuggucuguugccuuccgauaggguccucuggaucggggacguggcuugucagccaaugacgcccauuccugaggagaccuuucuggaacuuaagagcuucucgcagucugaguuuccagauaucugcaaaauagacggaauuguauucaaccagugugaaggcgagucccucccgcaacccuuugauguugccuggauggacgugggccacucacauaagaucauuaugcgggagcacaaaacaaaguggguccaggaaaguagcuccaaggauuucgugugcuauaaagaggggacuggaccuuguucugaaagcgaggaaaaggcaugcaaaaccucagguaguugccgcggcgacaugcaguuuuguaagguggccgggugcgagcacggagaggaggcuuccgaagcaaaauguagaugcagcuuaguccauaagccaggcgaaguugugguaucuuacggugggaugagggugcggcccaaauguuacggcuucucacgcaugauggccacacuggaggucaauccuccagaacagcgaaucggacaaugcaccggcugucaccuugagugcaucaacgggggagugagauugauuacucugacaagugagcuaaggagcgcuaccguuugugccucccauuuuuguucuucggcgacgagcgguaagaaguccacugaaauacacuuccacucaggcagucucguggggaaaaccgcaauccaugucaagggagcccugguggacggcacagaguucacuuuugaagguucuugcauguuccccgaugggugcgacgcuguagauugcaccuuuugucgggaguuccuuaaaaauccgcagugcuauccugccaagaaauggcuguuuauuaucauaguuauuuugcucggcuacgcaggacugauguuagugacaaacguccugaaggcuaucggcgugugggggagcugggucaucgcccccgugaagcucauguucgcgauuaucaaaaagcugaugcguaccguuuccugucuggugggaaaauugauggaccgcgguagacagguaauucacgaagagauaggcgagaauggggaaggaaaccaagaugacgucaggaucgagauggcccggccacgacgcgugagacauuggauguauucaccuguuauucuaacgauccuggcaaucggccucgcugaagguugcgaugagauggugcacgccgacagcaagcuggucucuuguaggcagggguccggcaauaugaaagagugcauuacuacaggacgggcccuucugcccgcugugaacccaggccaggaagcauguuugcauuuuaccgcccccgggaguccugauagcaagugccucaagauaaaaguaaagcgcaucaaucugaaauguaagaaaucuuccucauacuucgugccagacgcuagaaguaggugcacuagcguucgucggugucgaugggcgggagauugccagucgggcugcccgccccacuuuacauccaacucuuucagcgacgacugggcagguaagauggauagagccggguuaggauuuucaggcuguagugacgguugcggcggggcugccuguggaugcuucaaugcagccccuuccuguaucuuuuggaggaagugggucgagaacccacacggcauuauuuggaaagugucucccugcgcugccugggugccuagcgcagucaucgaacugaccaugccauccggggagguucgcacguuccaucccaugucaggaauaccgacccaaguguucaagggcgugagcguaacauaucuagguagugauauggaagucucugggcucacugaccugugugagaucgaggaacuuaaauccaagaaauuggcgcuggcuccuugcaaccaggccggaaugggcgugguugguaaggugggcgagauucaguguagcucggaagagucagcacggaccaucaaaaaggaugggugcauuuggaaugccgaccucgucggaaucgaacugagaguggaugacgcuguuuguuacucuaagauaacaaguguggaggccguagcaaacuauuccgcuauuccaacuaccaucggcgggcuuagguuugagcgcagccacgauucucagggaaaaauuagcggcaguccccuggacaucacagccauacgagguucauucagugucaauuaccggggguugcgucucagccugucugaaaucaccgcgacuugcacgggagaggugacaaacguguccggcugcuacucauguaugaccggugccaaggucaguauuaaauuacauagcuccaaaaauucuacugcucacguuagaugcaagggcgaugaaaccgcauuuucggugcuggaggggguacacagcuauaucgugucacuauccuucgaccaugccgucguggaugaacaaugucagcucaacugcggaggccacgagagucagguuacacugaaggggaaucuuaucuuuuuggacgugccuaaguucgucgacggaucuuacaugcagaccuaucauagcacugugcccacaggcgcuaacauuccauccccuacggauuggcugaaugcccucuuugguaacgggcugucaagguggauauuaggaguuauuggcgugcugcuuggcggguuggcacucuucuuucugaucauguuccuacugaaacucggaaccaagcaagucuuucgcucucggacuaaacuggcguga

SEQ ID NO: 11609 - RNA, 3222 nt, Artificial Sequence
  derived and/or modified CDS sequence (opt3) from SFTSV/FTLSV(2012YSH86)__KF711939.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaaugucacggcuuuagucgcaugauggcaaccuuagaagucaaccagccugagcaacgaaucggacagugcacuggcugucaucuggaaugcaucaaugggggagugagacuuauuacauugaccagcgagcugaaguccgccacgguuugugcuucucacuucugcucgagcgccacuuccgguaagaaaucaaccgagauacaguuccacaguggcucucuaguggggaagacagcgauccaugucaaaggagcacucguggauggcacugaauuuaccuucgaggguagcuguauguuuccagacgggugcgaugccguagacugcacauucuguagggaauuucugaagaacccccaaugcuacccggcuaaaaaguggcuuuucauuaucauaguuauucuguugggcuaugccggacucaugcuguuaaccaaugugcugaaggcaaucggcaucuggggguccugggucauugcuccugugaaacucauguuugccaucauuaagaaacuuaugcggacggucucaugucugaugggaaaguugauggaucguggucgccaggugauacacgaggaaaucggcgagaacagagaggggaaucaggacgauguuaggauugaaauggcgcggccccgacgcgugagacauuggauguacagcccaguaauccuaacuauccuggccauuggacucgcagagucuugcgacgaaaugguccacgcugauuccaaacuggugaguuguaggcagggcagcgguaacaugaaggagugcguuacaaccgggcgggcccuucugccugcugugaaucccggccaagaggccuguuugcauuucacugcaccaggaucucccgacuccaagugccucaaaauaaaggucaaacgcaucaaccugaaguguaaaaagucaaguagcuauuuugugccugaugccagaucgaggugcacauccguacgucggugucgaugggcuggcgacugccagucugggugcccaccgcacuucaccagcaauucauuuagugacgauugggcgggaaagauggacagagcaggcuuagguuucuccggguguucugauggaugcggcggugccgcuuguggcugcuuuaacgccgcacccagcuguauuuucuggaggaaauggguggaaaauccucacgggaucauuuggaagguuuccccaugcgccgcuuggguccccucagccgugaucgagcugacgaugccuagcggagaagugcgcaccuuccauccaaugaguggcauacccacacaggucuuuaaagggguuucugugacuuaccuaggauccgacauggaggugagcggccucaccgaucugugugaaaucgaggagcuuaagucgaaaaaguuggcacuggcgccgugcaaccaggcugguauggggguagucggaaaagugggcgaaauucaauguucaucugaggaaagugcccggacaaucaagaaggacgguugcauuuggaacgcagaucucguuggcaucgagcugagaguggacgaugccgucuguuauuccaaaauaacuagcguggaagcuguugccaauuacucugcaauuccuaccacaaucgggggacuuagguucgagcgcagccacgacucccagggcaagauuucagggaguccacuggauaucaccgcuauacgaggcagcuuuucugugaacuaucggggauugcgucucucccugucagagaucacugccacgugcacaggugaaguaaccaaugucagugggugcuacagcuguaugacuggagcgaaaguguccauuaaguuacauucuucgaaaaacagcaccgcccacgugagaugcaagggcgacgagacagcuuucucaguccuggaagguguucacuccuacaccgugagucuaucuuuugaucaugcaguaguggacgagcagugucagcucaauugcggcgggcacgaaagccaagucacucugaagggaaaccuuaucuucuuggacgugcccaaauuuguugauggcuccuauaugcagacauaccauucaacggugccuaccggggccaauauucccucuccaacugacuggcugaacgcucucuucggaaauggccugaguagguggaucuuaggugucauaggggugcugcuuggaggcuuggcccucuuuuucaugauuaugagccuguuuaagcuaggcacaaaacagguucugcgcucccggaccaagcucgcauga

SEQ ID NO: 11610 - RNA, 3222 nt, Artificial Sequence
  derived and/or modified CDS sequence (opt3) from SFTSV/FTLSV(2012YSH89)__KF711935.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcggacggucucaugucugaugggaaaguugauggaucguggucgccaggugauccaugaggaaauuggcgagaacagagaggggaaucaggacgauguuaggaucgaaauggcgcggccccgacgcgugagacacuggauguauagcccaguaauccuaacuauucuggccauaggacucgcagagucuugcgacgaaaugguccaugcugauuccaaacuggugaguuguaggcagggcagcgguaacaugaaggagugcguuacaaccgggcgggcccuucugccugcugugaaucccggccaagaggccuguuugcacuucacugcaccaggaucucccgacuccaagugccucaaaaucaaggucaaacgcauuaaccugaaguguaaaaagucaaguagcuacuuugugccugaugccagaucgaggugcacauccguacgucggugucgaugggcuggcgacugccagucugggugcccaccgcauuucaccagcaauucauuuagugacgauugggcgggaaagauggacagagcaggcuuagguuucuccggguguucugauggaugcggcggugccgcuuguggcugcuuuaacgccgcacccagcuguaucuucuggaggaaauggguggaaaauccucacgggauuaucuggaagguuuccccaugcgccgcuuggguccccucagccgugauagagcugacgaugccuagcggagaagugcgcaccuuccacccaaugaguggcauccccacacaggucuuuaaagggguuucugugacuuaucuaggauccgacauggaggugagcggccucaccgaucugugugaaauugaggagcuuaagucgaaaaaguuggcacuggcgccgugcaaccaggcugguauggggguagucggaaaagugggcgaaauccaauguucaucugaggaaagugcccggacaauuaagaaggacgguugcaucuggaacgcagaucucguuggcauagagcugagaguggacgaugccgucuguuacuccaaaauuacuagcguggaagcuguugccaauuauucugcaaucccuaccacaauugggggacuuagguucgagcgcagccaugacucccagggcaagaucucagggaguccacuggauauaaccgcuauccgaggcagcuuuucugugaacuaccggggauugcgucucucccugucagagauuacugccacgugcacaggugaaguaaccaaugucagugggugcuacagcuguaugacuggagcgaaaguguccaucaaguuacacucuucgaaaaacagcaccgcccaugugagaugcaagggcgacgaggcugcauucucaguccuggaagguguucacuccuauacagugagucuaucuuuugaucacgccguaguggacgagcagugucagcucaauugcggcgggcaugaaagccaagucacccugaagggaaaccuuauuuucuuggacgugcccaaauuuguugauggcuccuacaugcagacuuaucacucaacagugccuacgggggcuaauauccccucuccaaccgacuggcugaacgcccucuucggaaauggccugaguagguggauauuaggugucauuggggugcugcuuggaggcuuggcacucuuuuucaugaucaugagccuguuuaagcuaggcacuaaacagguuuuccgcucccggacaaagcuggcguga

SEQ ID NO: 11611 - RNA, 3222 nt, Artificial Sequence
  derived and/or modified CDS sequence (opt3) from SFTSV/FTLSV(2012YSH9)__KF711919.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucagauagauagauugauccacguuucuucgugguuaaggaaucauucacaguuucagggguaugugggacagcggggcggucgcagccgaguaaguuacuauccggcagaaaacuccuacucucguuggagcgggcugcuaucccccugcgacgccgauuggcucggaaugcugguggucaaaaaggcgaaagagucagacaugauugugccuggcccaaguuauaagggcaagguuuucuuugaaagacccaccuucgauggguacgugggaugggguuguggcagcgggaaaucuaggacagaguccggagaacuuugcucaagcgacaguggcacuucuuccggucuguugccuagcgaucggguccucuggaucggggacguggcuugucaaccaaugacgcccauuccugaggagaccuuucuggaacugaagucguucucucaguccgaguuuccagauaucugcaaaauagacggaauuguauucaaucagugugaaggcgagucacucccgcagcccuuugauguugccuggauggacgugggccacagucauaagaucauuaugcgcgagcacaaaacaaaguggguccaagaaagcuccucuaaggauuucgugugcuauaaagaggggacuggaccuuguagcgaaucagaggaaaaggcaugcaaaaccagugguuccugcagaggcgacaugcaguuuuguaagguggccgggugcgagcacggagaggaagcuagcgaggcaaaauguaggugcucuuuaguccauaagccaggcgaaguugugguaucauacggugggaugcgggugcgccccaaauguuacggcuucagucgaaugauggccacacuggaggucaacagaccugaacagaggaucggacagugcaccggcugucaccuugagugcaucaaugggggagugcgguugauuacucugacaagcgagcuacguuccgcuaccguuugugccucucauuuuugcucgagcgcgacguccgguaagaagaacacugaaauacacuuccacucaggcagucucguggggaaaaccgcaauccaugucaagggagcccugguggacggcacagaguucacuuuugaagguucuuguauguucccagaugggugcgacgcuguagauugcaccuuuugucgcgaguuccuuaaaaauccccaaugcuauccggccaagaaauggcuguuuauuaucauaguuauuuugcucggcuacgcaggacugauguuacugacaaacgugcucaaggcuaucggcgucugggggagcugggugaucgccccugucaaacuuauguucgcgauuaucaagaagcugaugagaaccguguccuguuugguuggaaaacuaauggacagggguagacaggugauucacgaagagauaggcgagaauggggaaggaaaccaggaugacguacgaaucgagauggcccgccccagaaggguccggcauuggauguauucaccagugauucugacgauccucgcaaucggccuggcugaagguugcgaugagaugguucacgccgacagcaaacuugugucuugucgccaaggguccggcaauaugaaggagugcauuacuacaggacgggcucuguugccugccgucaaccccggccaggaagcaugucuccauuuuaccgccccagggagucccgauagcaagugccugaagauaaaagugaagaggaucaauuuaaaauguaagaaaucuuccucauacuucguaccugacgcucguagucggugcacuagcgugcgaagauguaggugggcgggagauugccagucgggcugcccaccgcacuuuacauccaacucuuucagcgacgacugggcagguaagauggaucgcgccgggcugggauuuucaggcuguagugacgguugcggcggggcugccuguggaugcuucaaugcagcccccuccuguaucuuuuggcggaaguggguugagaacccucacggcauuauuuggaaagucucuccaugcgcugccugggugcccagcgcagugaucgaacuaaccaugccuuccggggaggucagaacguuccauccaaugucaggaauacccacccagguuuucaagggcgugagcgugacauaucucgguagugauauggaaguaucugggcugacugaccuuugugagaucgaggaauugaaauccaagaaacuggcgcucgcuccgugcaaccaagccggaaugggcgucguggguaagguuggcgagauucaguguagcucggaagagucagcaaggaccaucaaaaaggaugggugcauuuggaaugccgaccuggugggaaucgaacuucgcgucgaugacgcuguguguuacucuaagauaacaaguguugaggccguggcaaacuauuccgcuauuccuacuaccaucggcgggcugcgauuugagcggagccacgauucucagggaaaaauuagcggcuccccauuggacaucacagccauacgugguucauucaguguaaauuacagagggcucaggcugagcuuaucugaaaucaccgcgacuugcacgggagaggucacaaacguguccggcugcuacucauguaugaccggugccaaggugaguauuaaacugcauagcuccaaaaauucuacugcucacguccgcugcaagggcgaugaaaccgcauuuucgguucuagagggggugcacagcuauaucguaucacucuccuucgaccaugccguggucgaugaacagugucaacugaacugcggaggccacgagagucaggugacacuuaaggggaauuugauuuuucuggacguucccaaguucguggacggaucuuacaugcagaccuaucauagcacugucccuacaggcgcuaacauccccuccccaacggauuggcucaaugcccuguuugguaacggguuaucacgguggauacugggagugauuggcguucuuuugggcgggcucgcacuguucuuucuaaucauguuccugcucaaacugggaaccaagcaaguguuuagaucuaggacuaaacuugcguga

SEQ ID NO: 11612 - RNA, 3222 nt, Artificial Sequence
  derived and/or modified CDS sequence (opt3) from SFTSV/FTLSV(2012YSH91)__KF711920.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauucacgaggagaccuuucuggaacugaagucguucucucaguccgaguuuccugauaucugcaaaauagacggaauuguauucaaucagugugaaggcgagucacucccacaaccguuugauguugccuggauggacgugggccauagucacaagaucauuaugcgggagcacaaaacaaaguggguccaggaaagcuccucuaaggauuucgugugcuauaaagaggggacuggacccuguagcgaaucagaggaaaaggcaugcaaaaccagugguuccugccgcggcgacaugcaguuuuguaagguggccgggugcgagcauggagagaaagcuagcgaaacaaaguguagaugcucuuuaguccacaaaccuggcgagguugugguaucauacggugggaugagggugcggccaaaguguuacggcaucagucgcaugauggcaacccuggaagucaaucccccugagcagcgaaucggacaaugcacuggcugucaucuugaaugcauuaacgggggagugagauugauaacacugaccagcgagcuaagguccgccacgguuugugcuucucacuucugcucgagcgccuccucagguaagaaaaguacugagauccacuuucauucuggcagccucguggggaagaccgcgauucacgucaaaggagcacugguggacggcacagaguucacuuucgaagguuccuguauguuuccagaugggugcgacgccguagauugcaccuucugucgggaauuucuuaagaacccccagugcuauccggcuaaaaaguggcuguucaucauaauuguuaucuugcucggcuacgccggacugauguuacugacaaaugugcucaaggcaaucggcgucugggggucaugggugauugcuccugucaaacuuauguuugccaucauuaagaaacugaugcguaccgugagcuguuugguuggaaagcuaauggaccgcgguagacaggugauacaugaggaaaucggcgagaacggggagggaaaucaagaugacguaaggauugaaauggcgcggccccgacgcgucagacacuggauguauucuccagugauccugacgauccucgccauuggccuggcagaggguugcgaugaaaugguucaugcugacuccaaacuugugaguuguaggcaggggagcggcaacaugaaggagugcauaacuacaggacgggcccuguugccugcugucaaucccggccaggaggccugucuccacuucaccgcaccagggucucccgauuccaagugccugaaaaucaaggugaaacgcauuaacaucaaguguaaaaagucaaguagcuacuuuguaagagacgccaggucgcguugcacuuccgugcggcgauguagaugggcuggagauugccagucuggcugcccuccacacuucacaagcaauucauuuagugacgacugggcggguaagauggauagggcaggguuaggauucuccggcuguucugacgguugcggcggggccgcuuguggaugcuuuaacgccgcaccgagcuguauuuucuggcgcaaauggguugaaaauccccauggcaucauauggaaggucuccccuugcgccgcuugggugccaucagccgugaucgagcugaccaugcccagcggggaaguccggacguuucacccuaugaguggcauuccaacccaaguuuucaaaggagugucugugacauaucuagguuccgauauggagguaagcgggcucacugaccugugugaaaucgaggagcuuaagucgaaaaaguuggcacuggcgcccugcaaccaggcuggaaugggcgucguggguaaaguuggcgaaaagcaguguucaucugaggaaagugccagaaccauuaagaaagaugggugcaucuggaacgcagaccucgugggaauagagcugagggucgaugacgccguguguuacuccaagauuacaagcguugaagcuguggccaauuauucugcaaucccgacuaccauuggcgggcuucgcuucgagcgaagccaugauucccagggaaaaaucucaggcaguccucuggacauaacagcuauccgggguagcuuuucuguaaacuaccguggguugagacucucccugucagagauuaccgccacuugcacgggagaagucacaaaugugaguggcugcuacagcuguaugaccggugcgaagguguccaucaaauuacacucuucgaagaacagcacugcccacgucaggugcaagggcgaugagaccgcuuucucaguucuggaaggggugcauuccuauauuguaagucuaucuuuugaccacgcaguggucgaugagcaaugucagcucaauugcggaggccaugaaagccaggugacacugaaagggaaccuuaucuucuuggacguuccaaaguuuguggacggauccuacaugcagaccuaucacucaacuguccccacaggcgccaauauaccuucucccacggauuggcugaacgcucucuucgguaaugggcugagccgcuggauuuuaggagugaucggcguucugcuuggcggguuggcccucuuuuuccugaucauguuucuacugaaacucggaaccaagcaaguguuccggaguagaacuaaacuggcauga

SEQ ID NO: 11613 - RNA, 3222 nt, Artificial Sequence
  derived and/or modified CDS sequence (opt3) from SFTSV/FTLSV(2012YSH92)__KF711941.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacucccacucucgauggagcgguuuacugucccccugcgaugccgacuggcuagggaugcucguggucaaaaaggcgaaaggaucagauaugauugugccuggcccaaguuacaagggcaagguuuucuucgagcgucccaccuuugacggguaugugggaugggguuguggcagcgggaaaucuagaacagaauccggagagcugugcucaagcgauaguggcacuucuuccggucuucugccuagcaauagggucuuguggaucggggacguggcuugucagccaaugacgcccauuccugaagagaccuuccucgagcugaagucguuuucucaguccgaauuuccagauaucugcaaaauagacggaauuguauuuaaccagugugagggcgaaucacugccgcaacccuucgauguugccuggauggacgugggccauagucacaagaucauuaugcgggagcacaaaacaaaguggguccaggagagcuccucuaaggauuuugugugcuacaaagaagggacuggaccuuguagcgagucagaagagaagaccugcaaaacaagugguuccugccgcggcgacaugcaguucuguaagguggcagggugcgaacauggagaggaggccagcgaagcuaaauguagaugcucucucguccacaagccaggcgagguugugguaucauauggugggaugagggugcggcccaaauguuacggcuuuagucgcaugauggcaaccuuagaagucaaucagccugagcaacgaaucggacagugcacuggcugucaucuggaaugcaucaacgggggagugagacuuauuacauugaccagcgagcugaaguccgccacgguuugugcuucucacuucugcucgagcgccacuuccgguaagaaaucaaccgagauacaguuccacaguggcucucuaguggggaagacagcgauccaugucaaaggagcacucguggacggcacugaauuuaccuucgaggguagcuguauguuuccagaugggugcgacgccguagauugcacauucuguagggaauuucugaagaauccccaaugcuacccggcuaaaaaguggcuuuucauuaucauaguuauucuguugggcuaugccggacucaugcuguuaaccaacgugcugaaggcaaucggcaucuggggguccugggucauugcuccugugaaacucaucuuugccauuauaaagaaacuuaugcggacggucucaugucugaugggaaaguugauggaccguggucgccaggugauccacgaggaaauuggcgagaauagagaggggaaccaggaugacguuaggaucgaaauggcgcggccccgacgcgugagacauuggauguacagcccaguaauccuaacuauucuggccauaggacucgcagagucuugcgaugaaaugguccacgcugacuccaaacuggugaguuguaggcagggcagcgguaauaugaaggagugcguuacaaccgggcgggcccuucugccugcugugaaccccggccaagaggccuguuugcauuucacugcaccaggaucucccgauuccaagugccuccgcaucaaagucaagagaauuaaucugaaauguaagaaaucaaguagcuauuuugugccugacgccaggucgcguugcacauccguacggcgauguagaugggcuggcgauugccagucugggugcccaccgcacuucaccagcaacucauuuagugacgacugggcgggaaagauggauagggcaggcuuagguuucuccggguguucugacggaugcggcggugccgcuuguggcugcuuuaaugccgcacccagcuguaucuucuggcgcaaguggguggaaaacccucacgggauuaucuggaaaguuuccccaugcgccgcuuggguccccucagccgugauagagcugacgaugccuagcggagaagugcggaccuuccauccaaugaguggcauccccacacaggucuuuaaggggguuucugugacuuaccuaggauccgauauggaggugagcggccucaccgaccugugugaaauugaggagcuuaaaucgaagaaauuggcacuggcgccgugcaaccaggcugguauggggguagucggaaaggugggcgaaauccaauguucaucugaggaaagugccagaacaauuaaaaaggaugguugcaucuggaaugcagaccucguuggcauagagcugaggguggaugacgccgucuguuauuccaagauuacuagcguggaagcuguugccaacuacucugcaaucccuaccacaauugggggacuucgcuucgagcgaagccacgauucccagggcaaaaucucagggaguccacuggacauaaccgcuauccggggcagcuuuucugugaauuaucguggauugagacucucccugucagagauuacugccacgugcacaggugaaguaaccaacgucagugggugcuacagcuguaugacuggagcgaagguguccaucaaauuacauucuucgaagaauagcaccgcccacgugaggugcaaaggcgaugagacagcuuucucaguccuggaagguguucacuccuacaccgugagucuaucuuuugaccaugcaguaguggaugagcagugucagcucaacugcggcgggcacgaaagccaagucacucugaagggaaaucuuauuuucuuggacgugcccaaguuuguugacggcuccuauaugcagacauaccauucaacggugccuaccggggccaacauccccucuccaacugauuggcugaaugcucucuucggaaacggccugagccgcugggucuuaggugugauggggguucugcuuggaggcuuggcccucuuuuucaugauaaugagucuguuuaaacuaggcacaaaacagguguuccgguccagaaccaagcuggcauga

SEQ ID NO: 11614 - RNA, 3222 nt, Artificial Sequence
  derived and/or modified CDS sequence (opt3) from SFTSV/FTLSV(2012YSH93)__KF711946.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcaauagggucuuguggaucggggacguggcuugucagccaaugacgcccauuccugaagagaccuuccucgagcugaagucguuuucucaguccgaauuuccagauaucugcaaaauagacggaauuguauuuaaccagugugagggcgaaucacugccgcaacccuucgauguugccuggauggacgugggccacagucauaagaucauuaugcgggagcacaaaacaaaguggguccaggagagcuccucuaaggauuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaucagccugagcaacgaaucggacagugcacuggcugucaccuggaaugcaucaacgggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggacggcacugaauuuaccuucgaggguagcuguauguuuccagaugggugcgacgccguagauugcacauucuguagggaauuucugaagaauccccaaugcuauccggcuaaaaaguggcuuuucauuaucauaguuauucuguugggcuacgccggacucaugcuguuaaccaacgugcugaaggcaaucggcaucuggggguccugggucauugcuccugugaaacucaucuuugccauuauaaagaaacuuacgcggacugucucaugucugaugggaaaguugauggaccguggucgccaggugauccaugaggaaauuggcgagaauagagaggggaaccaggaugacguuaggaucgaaauggcgcggccccgacgcgugagacacuggauguauagcccaguaauccuaacaauucuggccauaggacucgcagagucuugcgaugaaaugguccaugcugacuccaaacuggugaguuguaggcagggcagcgguaauaugaaggagugcguuaccacugggcgggcccuucugccugcugugaaccccggccaagaggccuguuugcacuucacagcaccaggaucucccgauuccaagugccucaaaaucaaggucaaacgcauuaaucugaaguguaaaaagucaaguagcuacuuugugccugacgccagauauaggugcaccucgguacgucggugucgaugggcuggcgauugccaguccgggugcccaccgcauuucacgucuaacagcuuuucagacgacugggcgggaaagauggauagagcaggcuuagguuucaguggguguuccgacggaugcggcggugccgcuuguggcugcuuuaaugccgcacccucuuguaucuucuggaggaaauggguggaaaacccucacgggauuaucuggaagguuagcccaugcgccgcuuggguccccuccgccgugauagagcugaccaugccuucaggagaagugcgcacauuccacccaaugagcggcauccccacucaggucuuuaaagggguuagugugaccuaccuaggaucugauauggagguguccggccucacagaccugugugaaauugaggagcuuaagagcaaaaaguuggcacuggcgccgugcaaccaggcugguauggggguagucggaaaagugggcgaaauccaauguucgucagaggaaucugcccggacuauuaagaaggaugguugcaucuggaaugcagaccucguuggcauagagcugagaguggaugacgccgucuguuauaguaaaauuaccuccguggaagcuguugccaacuacagcgcaaucccuacaaccauugggggacuuagguucgagcgcucucaugauagccagggcaagaucuccgggucaccacuggacauaacugcuauccgaggaaguuuuagcgugaauuaccggggcuugcgucucucucuguccgagauuacggccacaugcaccggugaaguaacuaacgucucagggugcuauaguuguaugaccggagcgaaagugagcaucaaguuacacuccucuaaaaauucgacagcccaugugagaugcaagggcgaugagaccgcuuucagcguccuggaagguguucacucauacacugugucccuaaguuuugaccacgcaguaguggaugagcagugucagcucaacugcggcgggcaugaaucucaagucacacugaagggaaaucuuauuuucuuggacgugcccaaauuuguugacggcagcuauaugcagacguaccacuccaccgugccuacuggggccaacauccccucaccaacagauuggcugaaugcucucuucggaaacggccugucuaggugggucuuaggugugauggggguucugcuuggaggcuuggcccucuuuuucaugauaaugagccuguuuaagcuaggcaccaaacagguguuccgcagucggacaaagcuggcauga

SEQ ID NO: 11615 - RNA, 3222 nt, Artificial Sequence
  derived and/or modified CDS sequence (opt3) from SFTSV/FTLSV(YGS1)__KF356537.1__GP
augaugaaggugaucugguucagcucccuggucugccucguuauucaguguucuggcgacucagggcccauaaucugcgccggaccuauucacaguaacaaaagcgcugcaaucccacaucuucuggguuacuccgagaagauuugucaaaucgauagauugauacacgugucuucgugguuaaggaaucauucacaguuucagggcuauguagggcagcggggaggccgcagccaagugaguuacuauccggccgaaaacuccuacucucgauggagcggucugcuaucccccugcgacgcggauuggcucgggaugcuggucgugaaaaaggcuaaaggaucagacaugaucguuccuggcccaaguuauaagggcaagguguucuuugagcgucccaccuucgauggguacgucggaugggguuguggcagcgggaaaucuagaacagaauccggagagcuuugcucaagcgacaguggcacuucuuccggucuguugccuagcgauagggugcucuggauuggggacguagccugucagccaaugacgcccaucccugaagagaccuuucuggagcugaagucguucucucaguccgaauuuccagauauuugcaaaaucgacggaauaguuuucaaucagugugagggcgaaucacucccgcaacccuuugauguggcauggauggacgucggccacagucauaagauuaucaugcgggagcacaaaacaaagugggugcaggagagcuccucuaaggauuucgugugcuauaaagaagggacuggaccuuguagcgagucagaagagaaggccugcaaaaccagugguuccugccgcggcgacaugcaguuuuguaaggucgcugggugcgaacacggagaggaggcaagcgaagccaaauguagaugcucuuuaguucauaagccaggcgaggugguagugucauacggugggaugaggguccggcccaaauguuacggcuucagucgcaugauggcuacaauggaagugaacccuccagagcagcgaauuggacaaugcaccggcugucaccuggaaugcaucaaugggggaguuagacuuaucacuuugacaagcgagcugaaguccgccaccgugugugcgucucauuuuugcucgagcgcaacguccgguaagaaaucaacugagauucacuuccacaguggcucucuagucgggaagaccgccauacaugugaaaggagcucucguagacggcacagaauuuacuuuugaggguagcuguauguuccccgaugggugcaacgccguugacugcaccuuuuguagggaguuccugaagaauccgcagugcuauccugcuaaaaaguggcuuuuuaucauuaucgugauacuguugggcuacgcaggacucaugcuguuaacaaacguccugaaggccauuggcguguggggguccugggucaucgcgcccgugaaacucauguucgccaucaugaagaaacuuaugcggaccguuucaugucuggugggaaaguugauggaucguggucgccagguaauucacgaagaaaucggcgagaauggggagggaaaccaugacgaugucagaauugaaauggcaaggccacggcgagugcgccacuggauguauagcccuguuauacuaacgauccuggcuauuggccucgccgaggguugcgacgaaauggugcaugcugauucuaaacuggucuccuguagacaagggaguggcaauaugaaggagugcgugacuacaggaagggcccuucugcccagcguaaacccaggccaggaggcauguuugcacuuuaccgcccccgggucuccugacuccaagugccucaaaaucaaggugaaacggaucaaucugaaguguaaaaagucaaguagcuacuucguuccagaugcucgcucgagaugcacuuccgucaggcguugucggugggcgggagacugccagucuggcugcccgccccacuuuacaagcaacucauucagugaugacugggcagguaagauggaccgagccggguuaggauuuuccggcuguucugaugguugcggcggggcugccuguggaugcuucaaugcagccccuagcuguauuuucuggagaaaauggguggaaaacucccauggcauaaucuggaaggugucaccaugcgcugccuggguccccagcgcaguuauugagcugaccaugccuaguggggaagugaggacguuccacccaaugucuggaauccccacccagguguucaaaggcguauccgucacauaucuagguagcgacauggaggugucggggcucacugaucugugugaaauugaggagcuuaagagcaaaaaguuggcgcuggcuccgugcaaccaagccggaaugggcguuguggguaaagucggcgaaauccaguguucuagugaggaauccgcacgcaccauaaagaaggacgggugcaucuggaaugccgaucucgugggaauugagcugcggguugacgaugcuguguguuacagcaaaaucacaucuguagaagccgucgcaaacuauagcgcuauuccuacuaccaucggcgggcuuagauuugagaggucccaugacucacagggaaagauaaguggcagcccacuggauauuacagccauccgcgguucuuucuccgugaauuaccgaggguugcggcucucacugagugagauuaccgcgacuugcacgggagaagugacaaacgucagcggcugcuacuccuguaugaccggugccaaaguuucuaucaaguuacacucgagcaaaaauucaacugcucacgugcguugcaagggcgacgagaccgcauuuuccguacuggaaggggugcauaguuauacagucucucuaucauucgaucacgccgugguugacgagcagugucaacucaacugcggaggccaugaaucccaggugacccugaaggggaaucuuauauuuuuggauguccccaaauucguggacggaucauacaugcagacuuaucacucuacaguuccuacgggcgcuaacauccccagcccaaccgacuggcugaaugcccucuuugguaacgggcugaguagauggauuuuaggagugaucggcguccugcuuggcggguuggcacucuucuuucugauuauguuccuauuuaagcugggaacuaaacagguauucaggucccgcacaaagcucgcguga

SEQ ID NO: 11616 - RNA, 3222 nt, Artificial Sequence
  derived and/or modified CDS sequence (opt3) from SFTSV/FTLSV(YNY1)__KF356538.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguuuggcuacgccggauugaugcuccugaccaauguguuaaaggcaaucggcaucuggggguccugggucauugcuccugugaaacugaucuucgccauuauaaagaaacucaugcggacggucucaugucuuaugggaaagcugauggaucguggucgccaggugauccaugaggaaauuggcgagaacagagaggggaaucaggacgauguuaggaucgaaauggcgcggccccgacgcgugagacacuggauguauagcccaguaaucuugacuauucuagccauaggacuggcagagucuugcgacgaaaugguccaugcugauuccaaacucgugaguuguaggcagggcagcgguaacaugaaggagugcguuacaaccgggcgggcccugcuuccugcugugaaucccggccaagaggccugucugcacuuuacugcaccaggaucucccgacuccaagugcuugaaaaucaaggucaaacgcauuaaccucaaguguaaaaagucaaguagcuacuucgugccugaugccagaucgaggugcacauccguacgucggugucgaugggcuggcgacugccagucugggugcccaccgcauuuuaccagcaauucauucagugacgauugggcgggaaagauggacagagcaggccuggguuuuuccggguguucugauggaugcggcggugccgcuuguggcugcuucaacgccgcacccagcuguaucuucuggaggaaauggguggaaaauccucacgggauuaucuggaagguuuccccaugcgccgcuuggguccccucagccgugauagaguuaacgaugccuagcggagaagugcgcaccuuucacccaaugaguggcauccccacacaggucuucaaagggguuucugugacuuaucugggauccgacauggaggugagcggccuaaccgaucucugugaaauugaggagcugaagucgaaaaaguuggcacuugcgccgugcaaccaggcugguauggggguagucggaaaagugggcgaaauccaauguucaucugaggaaagugcccggacaauuaagaaggacgguugcaucuggaacgcagaucugguuggcauagagcucagaguggacgaugccgucuguuacuccaaaauuacuagcguggaagcuguugccaauuauucugcaaucccuaccacaauugggggacugagguuugagcgcagccaugacucccagggcaagaucucagggaguccacuugauauaaccgcuauccgaggcagcuucucugugaacuaccggggacugcguuugucccucucagagauuacugccacgugcacaggugaaguaaccaaugucagugggugcuacagcuguaugacuggagcgaaaguguccaucaagcugcacucuucgaaaaacagcaccgcccaugugagaugcaagggcgacgagacagcuuuuucagucuuagaagguguucacuccuauaccgugagucugucuuucgaucacgcaguaguggacgagcagugucagcuaaauugcggcgggcaugaaagccaagucacucucaagggaaaccugauuuuucuugacgugcccaaauucguugauggcuccuacaugcagacauaucacucaacggugccuaccggggccaauauccccucuccaacugacugguugaacgcucuguuuggaaauggccucaguagguggauacugggugucauggggguguuacugggaggccuugccuuguucuuuaugauuaugagccucuucaagcugggcacaaaacagguuuuucgcucccggaccaagcuagcauga

SEQ ID NO: 11617 - RNA, 3222 nt, Artificial Sequence
  derived and/or modified CDS sequence (opt3) from SFTSV/FTLSV(YPQ133)__KF356530.1__GP
augaugaaggugaucugguucagcucccugauuugcuuugucauacaguguucuggcgacucaagucccaucauuugcgccgggccuauccacagcaacaaauccgcugauauuccacaucuccuuggauacucugagaagaucugucaaauagacagacugauccacguuucgucaugguugaggaaucauagccaguuccaggguuaugugggccagcgcgggggacggagucaaguauccuacuauccggcagaaaacucuuacagccgaugguccggcuuacugucacccugcgaugccgacuggcuagguaugcucguggucaaaaaggcgaaagggagugauaugauugugccuggaccaagcuauaagggcaagguuuucuucgagcgucccaccuuugacggcuacgugggguggggaugugguucuggcaaauccagaacagaaucaggggagcugugcagcagugauucuggaacuuccagcggccuucugccuucggacagggucuuguggaucggugauguggcuugucagccaaugacgcccauuccugaagagaccuuccucgagcugaagucuuuuucccagucagaauuuccagacaucugcaaaauagaugggauuguauuuaaucagugugagggagaaagucugccgcaacccuucgacguugccuggauggaugugggccacagccagaagaucauuaugcgggagcauaaaacaaaguggguccaggaguccucuagcaaggacuuugugugcuauaaagaaggcacugggccuuguucagagagugaagagaagaccugcaaaacauccggaagcugccgcggugacaugcaguucuguaagguggcaggcugcgaacacggggaggaggccucugaagcuaaauguagaugcucacucguccacaagccaggagagguugugguaaguuacggcgguaugagggugcggcccaaauguuacggguuuagccgcaugauggcaaccuuagaagucaaccaaccugagcagcgaaucggccagugcacuggaugucaucuggaaugcaucaauggcggggugagacuuauuacauugaccuccgagcugaagucugccacgguuugugcuucgcacuucugcagcuccgccacuucaggaaagaaaaguaccgagauacaauuccauucugguagccuagugggcaagacagcgauccacgucaaaggggcacucguggauggaacugaauuuaccuucgagggcuccuguauguuuccagacgguugcgaugccguagacugcacauucuguagggaauuucugaagaacccccagugcuauccggcuaaaaaguggcuuuucauuaucauaguuauucuguugggguacgccggccucaugcuguuaaccaaugugcugaaggcaaucggaaucuggggcucaugggucauugcuccugugaaacucaucuuugccauuauaaagaaacuuaugcggacggucagcugucugauggggaaguugauggaucguggacgccaggugauccacgaggaaauuggugagaacagagagggcaaucaggacgauguuaggaucgaaauggcgcggccccgacgcgugagacauuggauguauucuccaguaauccuaacuauucuggccauagggcucgcagaguccugcgacgaaaugguccacgcugauaguaaacuggugagcuguaggcaaggaucuggcaacaugaaggagugcguuacaaccggucgggcccuucugccugcugugaaucccgggcaggaggccuguuugcauuucacugcaccaggcucccccgacucaaagugccucaaaaucaaggucaaacgcauuaaccugaaguguaaaaagaguagcucguacuuugugccugaugccagauccaggugcacaucuguacgucggugucgaugggcuggagacugccagagcggcugcccaccgcacuucaccucaaauaguuuuuccgacgauugggcggggaagauggacagagcaggauuaggcuucucugguuguagcgaugggugcggaggcgccgcuugugguugcuuuaacgccgcacccuccuguaucuucuggaggaaauggguggaaaauccucauggcguuauuuggaaggucucaccaugcgccgcuugggugcccagcgccgugaucgagcugacgaugccuaguggggaaguccgcaccuuccacccaaugucuggaauacccacacagguuuuuaaaggcguguccgugacuuaucuagggagcgacauggagguaucgggacucaccgaucugugugaaaucgaggagcuuaagagcaaaaaguuggcacuggcgccgugcaaccaagcuggcaugggugucguggggaaaguuggagaaauucaguguucuagugaggaauccgcccggacaaucaagaaggacggcugcauuuggaacgcagaucucguggguaucgagcugagagucgacgaugccguguguuacagcaaaauaacuucuguugaagcuguggccaauuauagcgcaauuccuaccacaaucggcgggcuuagguucgagcgcucccacgacucacagggaaagauuaguggcagcccacuggauaucaccgcuauacgagggucuuuuuccguaaacuaccggggauugcgucucucacugagugagaucacugccacgugcacaggcgaagucaccaaugugagcgguugcuacuccuguaugacuggggcgaaagugucuauuaaguuacauucgagcaaaaacucaaccgcccacgucagaugcaagggagacgagacagcuuucuccguucuggaaggcgugcauaguuauaccguaucucuaucauuugaucacgcaguggucgacgagcagugucaacucaauugcgguggccacgaaucccaggugacucugaaggggaaccuuaucuucuuggacguucccaaauuuguggauggaucauacaugcagacauaucauucuacggucccuaccggcgccaauauucccagcccaacugacuggcugaacgcucucuucgggaauggacugaguagguggaucuuaggcgugauggguguucugcuugggggauuggcccucuuuuucaugauaaugucccuguuuaagcuaggcacaaaacagguguuccgcagccggaccaagcuggcauga

SEQ ID NO: 11618 - RNA, 3222 nt, Artificial Sequence
  derived and/or modified CDS sequence (opt3) from SFTSV/FTLSV(YPQ2)__KF356531.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagaucgcgauucacgucaaaggagcacucguggauggcacagaauuuacuuucgaggguagcuguauguuuccagacgggugcgaugccguagacugcaccuucuguagggaauuucugaagaacccccaaugcuauccggcuaaaaaguggcuuuucaucauaauuguuauccuguugggcuacgccggacucaugcuguuaacaaaugugcugaaggcaaucggcauuuggggguccugggucaucgcuccugugaaacucauuuuugccauaaucaagaaacuuaugcggaccgucucaugucugaugggaaaguugauggaucguggucgccaggugauucaugaggaaaucggcgagaacagagaggggaaucaggacgauguuaggaucgaaauggcgcggccccgacgcgugagacacuggauguauagcccaguaauucuaacgauacuggccaucggacucgcagagucuugcgacgaaaugguccaugcugauuccaaacuggugaguuguaggcagggcagcgguaacaugaaggagugcguuacuacagggcgggcccuucugccugcugugaaucccggccaagaggccuguuugcacuucaccgcaccaggaucucccgacuccaagugccucaaaauuaaggucaaacgcaucaaccugaaguguaaaaagucaaguagcuacuuugugccuauggccagauucaggugcacuucgguacgucggugucgaugggcuggcgauugccaguccgggugcccaccgcauuuuacaucuaauagcuucucagacgacugggcgggaaagauggauagagcaggcuuagguuuuaguggguguuccgacggaugcggcggugccgcuuguggcugcuucaacgccgcacccucuuguauuuucuggaggaaauggguggaaaauccucacgggaucauauggaagguuagcccaugcgccgcuuggguccccuccgccgugaucgagcugaccaugccuucaggagaagugcgcacguuucacccaaugagcggcauucccacccaggucuucaaagggguuagugugacauaucuaggaucugauauggagguguccggccucacugaccugugugaaaucgaggagcuuaagagcaaaaaguuggcacuggcgccgugcaaccaggcugguauggggguagucggaaaagugggcgaaauucaauguucgucagaggaaucugcccggaccaucaagaaggaugguugcauauggaacgcagaccucguuggcauugagcugagaguggaugacgccgucuguuacaguaaaaucacauccguggaagcuguugccaauuauagcgcaauuccuacuaccaucgggggacuuagguuugagcgcucucaugauagccaggugaagauauccggcucaccacuggacaucacagcuaugcgagggaguuucagcguaaacuaccggggauugcgucucucucuguccgagauuaccgccacuugcacgggcgaagucacaaaugugucagguugcuacaguuguaugaccggggcgaaagugagcaucaaguuacacuccucuaaaaacucgacugcccaugucagaugcaagggagaugagaccgcuuuuagcguucuggaaggcgugcacucauauacaguaucccuaaguuucgaccacgcaguggucgaugagcagugucagcucaauugcgguggccaugaaucucaagugacccugaaggggaaccuuaucuuuuuggacguucccaaauucguggacggaagcuacaugcagacuuaucacuccacagucccuacgggcgccaauauucccucaccaaccgauuggcugaacgcucucuuugggaauggacugucuagguggauauuaggcgugauggguguucugcuugggggauuggcccucuucuuuaugauuaugagccuguucaagcuaggcacuaaacagguguuucgcagucggacaaagcuggcauga

SEQ ID NO: 11619 - RNA, 3222 nt, Artificial Sequence
  derived and/or modified CDS sequence (opt3) from SFTSV/FTLSV(YPQ5)__KF356532.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccgaguaaguuacuauccggcagaaaacuccuacucucguuggagcgguuuacugucccccugcgaugccgacuggcuagggaugcucguggucaaaaaggcgaaaggaucagauaugauugugccuggcccaaguuauaagggcaagguuuucuucgagagacccaccuuugacggguacgugggaugggguuguggcagcgggaaaucuaggacagaauccggagagcugugcucaagcgauaguggcacuucuuccggucuucugccuagcgaccgggucuuguggaucggggauguggcuugucaaccaaugacgcccauuccugaagagaccuuccucgagcugaagucguuuucucaguccgaauuuccagacaucugcaaaauagauggaauuguauuuaaucagugugagggcgaaucacugccgcagcccuucgacguugccuggauggaugugggccacagucauaagaucauuaugcgcgagcacaaaacaaaguggguccaagagagcuccucuaaggacuuugugugcuauaaagaagggacuggaccuuguagcgagucagaagagaagaccugcaaaacaagugguuccugcagaggcgacaugcaguucuguaagguggcagggugcgaacacggagaggaggccagcgaagcuaaauguaggugcucucucguccauaagccaggcgagguugugguaucauacggugggaugcgggugcgccccaaauguuacggcuuuagucgaaugauggcaaccuuagaagucaaccagccugagcagagaaucggacaaugcacuggcugucaccuggaaugcaucaaugggggagugaggcuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucugucgggaauuucugaagaacccccagugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcguacggucucaugucugaugggaaaguugauggaucgcgguagacaagugauccaugaggaaauuggcgagaacagggaggggaaucaggacgauguucggaucgaaauggcgcgaccccgcagagugaggcacuggauguauagcccaguaauccuaacuauucuggccauaggacucgcagagucuugcgacgaaaugguccaugcugauuccaaacuggugaguugucggcagggcagcgguaacaugaaggagugcguuacaaccgggcgcgcccuucugccugcugugaaucccggccaggaggccuguuugcacuucacugcaccaggaucucccgacuccaagugccucaaaaucaaggucaaaagaauuaaccugaaguguaaaaagucaaguagcuacuuugugccuguagccagguaucguugcacaucggugcggcgauguagaugggcuggcgauugccaauccgggugcccaccgcauuucaccucuaauagcuuuucaaacgacugggcgggaaagauggacagggcaggcuuagguuucaguggguguuccgauggaugcggcggugccgcuuguggcugcuuuaaugccgcacccucuuguaucuucuggcgcaaauggguugaaaacccucacgggauuaucuggaaggucagcccaugcgccgcuugggugcccuccgccgugauagagcugacgaugccuucaggagaaguccggaccuuccacccaaugagcggcauccccacacagguuuuuaaaggggugagugugacuuaccuaggaucuuauauggagguauccggccucaccgaccugugugaaauugaggagcuuagaagcaagaaauuggcacuggcgccgugcaaccaggcugguaugggggucgugggaaagguuggcgaaauccaguguucgucagaggaaucugccaggacaauuaaaaaggaugguugcaucuggaaugcagaccucgugggcauagagcugcgcgucgaugacgccguguguuacaguaagauuacuuccguugaagcuguggccaacuacagcgcaaucccuaccacaauugggggacuucgauucgagcggucucaugauagccaaggcaaaaucuccgggucaccacuggacauaaccgcuauccguggaaguuuuagcguaaauuauagaggcuugaggcucucucuguccgagauuacugccacgugcacaggugaagucaccaacgugucagggugcuacaguuguaugacuggagcgaaggugagcaucaaauuacacuccucuaaaaauucgaccgcccauguccgcugcaagggcgaugagacagcuuucagcguucuggaaggugugcacucauauaccguaucccuaaguuuugaccacgcaguggucgaugagcagugucagcucaacugcggcgggcaugaaucucaggugacucugaagggaaaucuuauuuucuuggacguucccaaguuuguggauggcagcuacaugcaaacauaucacuccacggucccuaccggggccaacauccccucaccaacugacuggcugaaugcucucuucggaaacggccugucucgguggauauuaggugugauggggguucugcuuggaggcuuggcccucuuuuucaugauuaugagccuguuuaaacuaggcacaaaacagguguucagaaguaggaccaagcuggcauga

SEQ ID NO: 11620 - RNA, 3222 nt, Artificial Sequence
  derived and/or modified CDS sequence (opt3) from SFTSV/FTLSV(YSC19)__KF356536.1__GP
augaugaaggugaucugguucagcucccuggucugccucguuauucaguguucuggcgacucagggcccauaaucugcgccggaccuauucacaguaacaaaagcgcugcaaucccacaucuucuggguuacuccgagaagauuugucaaaucgauagauugauacacgugucuucgugguuaaggaaucauucacaguuucagggcuauguagggcagcggggaggccgcagccaagugaguuacuauccggccgaaaacuccuacucucgauggagcggucugcuaucccccugcgacgcggauuggcucgggaugcuggucgugaaaaaggcuaaaggaucagacaugaucguuccuggcccaaguuauaagggcaagguguucuuugagcgucccaccuucgauggguacgucggaugggguuguggcagcgggaaaucuagaacagaauccggagagcuuugcucaagcgacaguggcacuucuuccggucuguugccuagcgauagggugcucuggauuggggacguagccugucagccaaugacgcccaucccugaagagaccuuucuggagcugaagucguucucucaguccgaauuuccagauauuugcaaaaucgacggaauaguuuucaaucagugugagggcgaaucacucccgcaacccuuugauguggcauggauggacgucggccacagucauaagauuaucaugcgggagcacaaaacaaagugggugcaggagagcuccucuaaggauuucgugugcuauaaagaagggacuggaccuuguagcgagucagaagagaaggccugcaaaaccagugguuccugccgcggcgacaugcaguuuuguaaggucgcugggugcgaacacggagaggaggcaagcgaagccaaauguagaugcucuuuaguucauaagccaggcgaggugguagugucauacggugggaugaggguccggcccaaauguuacggcuucagucgcaugauggcuacaauggaagugaacccuccagagcagcgaauuggacaaugcaccggcugucaccuggaaugcaucaaugggggaguuagacuuaucacuuugacaagcgagcugaaguccgccaccgugugugcgucucauuuuugcucgagcgcaacguccgguaagaaaucaacugagauucacuuccacaguggcucucuagucgggaagaccgccauacaugugaaaggagcucucguagacggcacagaguucacuuuugaagguagcuguauguuccccgaugggugcaacgccguugacugcaccuuuuguagggaguuccugaagaauccgcagugcuauccugcuaaaaaguggcuuuuuaucauuaucgugauacuguugggcuacgcaggacucaugcuguuaacaaacguccugaaggccauuggcguguggggguccugggucaucgcgcccgugaaacucauguucgccaucaugaagaaacuuaugcggaccguuucaugucuggugggaaaguugauggaucguggucgccagguaauucacgaagaaaucggcgagaauggggagggaaaccaugacgaugucagaauugaaauggcaaggccacggcgagugcgccacuggauguauagcccuguuauacuaacgauccuggcuauuggccucgccgaggguugcgacgaaauggugcaugcugauucuaaacuggucuccuguagacaagggaguggcaauaugaaggagugcgugacuacaggaagggcccuucugcccagcguaaacccaggccaggaggcauguuugcacuuuaccgcccccgggucuccugacuccaagugccucaaaaucaaggugaaacggaucaaucugaaguguaaaaagucaaguagcuacuucguuccaauugcucgcaacagaugcacuucggucaggcguugucggugggcgggagauugccaguccggcugcccgccccacuuuacaucuaauagcuucucagacgauugggcagguaagauggaccgagccggguuaggauuuaguggcuguuccgacgguugcggcggggcugccuguggaugcuucaacgcagccccuucuuguauauuuuggagaaaauggguggaaaacagccauggcaucauuuggaagguguccccaugcgcugccuggguccccucagcaguuaucgagcugaccaugccuagcggggaagugaggacguuccacccaaugaguggcauucccacccagguguucaaaggaguaucugucacauaucuagguuccgauauggaggugagcgggcucacugaccugugugaaaucgaggagcuuaagucgaaaaaguuggcgcuggcuccgugcaaucaagccggaaugggcguuguggguaaagucggcgaaauacaguguucaucugaggaaagugcacgcaccaucaagaaggaugggugcauuuggaacgccgaccucgugggaaucgagcugcggguugaugacgcuguguguuacuccaaaauuacaagcguagaagccgucgcaaauuauucugcuaucccuacuaccauaggcgggcuuagauuugagaggagccaugauucccagggaaagauuucaggcaguccacuggacaucacagccauucgcgguagcuucucugugaacuaccgaggguugcggcucucccugucagagaucaccgcgacuugcacgggagaagugacaaaugucaguggcugcuacagcuguaugaccggugccaaaguuuccauaaaguuacacucuucgaaaaacagcacugcucacgugcguugcaagggcgaugagaccgcauuuucaguacuggaaggggugcauuccuauacagucagucuaucuuucgaccacgccgugguugaugagcagugucaacucaauugcggaggccaugaaagccaggugacccugaaggggaaccuuaucuuuuuggacguccccaaauucguggauggauccuacaugcagacuuaucacucaacaguuccuacgggcgcuaauauucccucuccaaccgacuggcugaacgcccucuuugguaaugggcugagcagauggaucuuaggagugauuggcguccugcuuggcggguuggcacucuucuuucugaucauguuccuauuuaagcugggaacuaaacagguauucaggagucgcacaaagcucgcguga

SEQ ID NO: 11621 - RNA, 3222 nt, Artificial Sequence
  derived and/or modified CDS sequence (opt3) from SFTSV/FTLSV(YSC3)__KF356535.1__GP
augaugaaggugaucugguucagcucccuggucugccucguuauucaguguucuggcgacucagggcccauaaucugcgccggaccuauucacaguaacaaaagcgcugcaaucccacaucuucuggguuacuccgagaagauuugucaaaucgauagauugauacacgugucuucgugguuaaggaaucauucacaguuucagggcuauguagggcagcggggaggccgcagccaagugaguuacuauccggccgaaaacuccuacucucgauggagcggucugcuaucccccugcgacgcggauuggcucgggaugcuggucgugaaaaaggcuaaaggaucagacaugaucguuccuggcccaaguuauaagggcaagguguucuuugagcgucccaccuucgauggguacgucggaugggguuguggcagcgggaaaucuagaacagaauccggagagcuuugcucaagcgacaguggcacuucuuccggucuguugccuagcgauagggugcucuggauuggggacguagccugucagccaaugacgcccaucccugaagagaccuuucuggagcugaagucguucucucaguccgaauuuccagauauuugcaaaaucgacggaauaguuuucaaucagugugagggcgaaucacucccgcaacccuuugauguggcauggauggacgucggccacagucauaagauuaucaugcgggagcacaaaacaaagugggugcaggagagcuccucuaaggauuucgugugcuauaaagaagggacuggaccuuguagcgagucagaagagaagaccugcaaaacaagugguuccugccgcggcgacaugcaguuuuguaaggucgccgggugcgaacacggagaggaggcuagcgaagcaaaauguagaugcucuuuaguucauaagccaggcgaggugguagugucauacggugggaugaggguccggcccaaauguuacggcuucagucgcaugauggccacccuggaagugaaccagccugagcaacgaauuggacagugcacuggcugucaccuugaaugcaucaaugggggaguuagauugaucacacugaccagcgagcuaaaguccgcuacggugugugccucucauuuuugcucgagcgcgacuuccgguaagaaaucaaccgagauucaguuccacaguggcucucucgucgggaagacagcaauacacgugaaaggagcccugguagacggcacugaguucaccuuugaagguagcuguauguucccagaugggugcgacgcuguugauugcacauuuuguagggaguuccuuaagaacccccaaugcuauccggccaaaaaguggcuguuuaucauuaucgugauauugcucggcuacgcaggacugauguuacugaccaauguccucaaggcuauuggcaucuggggguccugggugaucgccccugucaaacuuauuuucgcgaucauuaagaaacugaugcggacggugucauguuugaugggaaagcuaauggaccguggucgccagguuauacaugaagaaaucggcgagaacagagaggggaaucaggaugacgugaggauugaaauggcccggccccgacgcaucagacacuggauguauagcccaguaauccugacuauucucgcaauaggacuggcugagucuugcgaugaaaugguccaugccgacuccaaacuugugaguuguaggcagggcagcgguaacaugaaggagugcguuacaaccgggcgggcucuguugccugccgugaaucccggccaagaggcaugucuccacuuuacugccccaggaucucccgauuccaagugccugaaaaucaaggucaaacgcauuaacuuaaaguguaaaaagucaaguagcuacuucgugccugacgcuagaucgaggugcacauccguacgucggugucgaugggcgggcgauugccagucugggugcccaccgcauuuuaccagcaauucauucagugacgacugggcaggaaagauggauagagccggccuggguuuuuccggguguucugacggaugcggcggugcugccuguggcugcuucaacgcagcccccagcuguaucuuuuggaggaaauggguggaaaauccucacgggauuaucuggaagguuuccccaugcgcugccuggguccccucagcagugauagagcuaacgaugccuagcggagaagugcgcaccuuccacccaaugaguggcauccccacacaggucuucaaagggguuucugugacuuaucucggauccgauauggaggugagcggccugaccgaccuuugugaaauugaggaguugaagucgaaaaagcuggcgcucgcuccgugcaaccaggccgguauggggguagucggaaaagugggcgaaauccaauguucaucugaggaaagugcacggacaauuaagaaggaugguugcaucuggaacgccgaccugguuggcauagagcuuagaguggaugacgcugucuguuacuccaaaauuacuagcguggaagccguugcaaauuauucugcuaucccuaccacaauugggggacugagguuugagcgcagcuacgauucccagggcaagaucucagggaguccauuggacauaaccgccauccgaggcagcuucucugugaacuaccggggacuccgucuguccuuaucagagauuacugcgacgugcacaggugaaguaaccaaugucagugggugcuauagcuguaugacuggagccaaaguguccaucaagcugcauucuucgaaaaacagcaccgcucacgugagaugcaagggcgaugagacagcauuuucaguccuagaagguguucauuccuacaccgugagucucucuuucgaccacgccguaguggaugagcagugucagcugaauugcggcgggcacgaaagccaagucacucuuaagggaaacuugauuuuucuggacgugcccaaauucguugacggcuccuauaugcagacauaccauucaacggugccuaccggggcuaauauccccucuccaacugauuggcucaacgcccuguuuggaaauggcuuaaguagguggauacugggugucauuggggugcuuuugggaggccucgcacuguucuuuaugaucaugagccuauucaagcugggcacaaaacagguuuuucgcucccggaccaagcucgcguga

SEQ ID NO: 11622 - RNA, 3222 nt, Artificial Sequence
  derived and/or modified CDS sequence (opt3) from SFTSV/FTLSV(YSH39)__KF356529.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuucauggagcucaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucugguccauaagccaggcgagguugugguaucauacggugggaugaggauccggcccaaauguuacggcuuuagucgcaugauggcaacccucgaagugaaccagccugagcaacgaaucggacagugcacuggcugucacuuagaaugcauuaaugggggagucagacugauaacacuuaccagcgaguugaaguccgccacggugugugcuucucauuucugcucgagcgccacuuccgguaagaaaucaaccgagauccaguuccacaguggcucucugguugggaagacagcgauucacgugaaaggagcacuugucgauggcacugaauuuaccuucgaggguagcuguauguuuccagacgggugcgaugccguggacugcacauucuguagggaauuucucaagaacccccaaugcuauccggcuaaaaaguggcuguucaucauaauuguaauccuucugggccaugccggauugaugcuccugaccaauguuuuaaaggcaaucggcauuuggggguccugggugaucgcuccugucaaacugauuuuugccauaaucaagaaacucaugcggacggugucaugucuuaugggaaagcugauggaucguggucgccaggucauucacgaggaaaucggcgagaacagagaggggaaucaggacgaugugaggaucgaaauggcgcggccccgacgcguuagacauuggauguacagcccagugauuuugacuauacuagccaucggacuggcagagucuugcgacgaaaugguacacgcugauuccaaacucgucaguuguaggcagggcagcgguaacaugaaggagugcgugacaaccgggcgggcccugcuuccugcuguuaaucccggccaagaggccugucugcauuucacugcaccaggaucucccgacuccaagugcuugaaaauuaaggugaaacgcaucaaccucaaguguaaaaagucaaguagcuauuuugucccugaugccagaucgaggugcacauccgugcgucggugucgaugggcuggcgacugccagucugggugcccaccgcacuucaccagcaauucauuuagugacgauugggcgggaaagauggacagagcaggccuggguuucuccggguguucugauggaugcggcggugccgcuuguggcugcuuuaacgccgcacccagcuguauuuucuggaggaaauggguagaaaauccucacgggaucauauggaagguguccccaugcgccgcuuggguucccucagccgucaucgaguuaacgaugccuagcggagaagugcgcaccuuccauccaaugaguggcauucccacacagguguuuaaaggggucucuguuacuuaccugggauccgacauggaggugagcggccuaaccgaucucugugaaaucgaggagcugaagucgaaaaagcuagcauuggcgccgugcaaccaggcugguaugggggugguaggaaaagucggcgaaauucaauguucaucugaggaaagugcccggacaaucaagaaggacgguugcauauggaacgcagaucuggugggcauugagcucagaguugacgaugccguguguuauuccaaaaucacuagcgucgaagcuguggccaauuacucugcaauuccuaccacaaucgggggacugagguucgagcgcagccacgacucccagggcaagauaucagggaguccacuugauaucaccgcuauucgaggcagcuuuucuguuaacuaucggggacugcguuugucccucucagagaucacugccacgugcacaggugaagugaccaauguaagugggugcuacagcuguaugacuggagcgaaagucuccauuaagcugcauucuucgaaaaacagcaccgcccacgugagaugcaagggcgacgagacagcuuucucaguguuagaagguguccacuccuacaccguuagucugucuuuugaucaugcagugguagacgagcagugucagcuaaauugcggcgggcacgaaagccaagugacucucaagggaaaccugaucuuccuugacguccccaaauuuguggauggcuccuauaugcagacauaccauucaacgguuccuaccggggccaauauacccucuccaacugacugguugaacgcucuguucggaaauggccucaguagguggauucugggugugaucggggucuuacugggaggccuugccuuguuuuucaugaucaugagccucuuuaagcugggcacaaaacagguguuccgcucccggaccaagcuagcauga

SEQ ID NO: 11623 - RNA, 3222 nt, Artificial Sequence
  derived and/or modified CDS sequence (opt3) from SFTSV/FTLSV(YSHX002)__KF356540.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggaaugggcugcuaagccccugcgacgccgauuggcucggaaugcugguggucaaaaaggcgaaagaguccgacaugauugugccuggcccaucauauaagggcaagguuuucuuugaacgucccaccuucgauggguacgugggaugggguuguggcagugggaaaagcagaacagagucuggagaacuuugcuccucagacagcggcacuuccucuggucuguugccuuccgauaggguccucuggaucggggacguggcuugucagccaaugacgcccauuccugaggagaccuuucuggaacuuaagagcuucucgcagucugaguuuccagauaucugcaaaauagacggaauuguauucaaccagugugaaggcgagucccucccgcaacccuuugauguugccuggauggacgugggccacucacauaagaucauuaugcgggagcacaaaacaaaguggguccaggaaaguagcuccaaggauuucgugugcuauaaagaggggacuggaccuuguucugaaagcgaggaaaaggcaugcaaaaccucagguaguugccgcggcgacaugcaguuuuguaagguggccgggugcgagcacggagaggaagcuagugaggcaaaauguagaugcagcuuaguccauaagccaggcgaaguugugguaucuuacggugggaugagggugcggcccaaauguuacggcuucucacgcaugauggccacacuggaggucaauccuccagaacagcgaaucggacaaugcaccggcugucaccuugagugcaucaacgggggagugagauugauuacucugacaagugagcuaaggagcgcuaccguuugugccucccauuuuugcuccucggcgacgagcgguaagaaguccacugaaauacacuuccacucaggcagucucguggggaaaaccgcaauccaugucaagggagcccugguggacggcacagaguucacuuuugaagguucuuguauguuccccgaugggugcgacgcuguagauugcaccuuuugucgggaguuccuuaaaaauccgcagugcuauccugccaagaaauggcuguuuauuaucauaguuauuuugcucggcuacgcaggacugauguuagugacaaacguccugaaggcuaucggcgugugggggagcugggucaucgcccccgugaagcucauguucgcgauuaucaaaaagcugaugcguaccguuuccugucuggugggaaaauugauggaccgcgguagacagguaauucacgaagagauaggcgagaauggggaaggaaaccaagaugacgucaggaucgagauggcccggccacgacgcgugagacauuggauguauucaccuguuauucuaacgauccuggcaaucggccucgcugaagguugcgaugagauggugcacgccgacagcaagcuggucucuuguaggcagggguccggcaauaugaaagagugcauuacuacaggacgggcccuucugcccgcugugaacccaggccaggaagcauguuugcauuuuaccgcccccgggaguccugauagcaagugccucaagauaaaaguaaagcgcaucaaucugaaauguaagaaaucuuccucauacuucgugccagacgcuagaaguaggugcacuagcguucgucggugucgaugggcgggagauugccagucgggcugcccgccccacuuuacauccaacucuuucagcgacgacugggcagguaagauggauagagccggguuaggauuuucaggcuguagugacgguugcggcggggcugccuguggaugcuucaaugcagccccuuccuguaucuuuuggaggaagugggucgagaacccacacggcauuauuuggaaagugucucccugcgcugccugggugccuagcgcagucaucgaacugaccaugccauccggggagguucgcacguuccaucccaugucaggaauaccgacccaaguguucaagggcgugagcguaacauaucuagguagugauauggaagucucugggcucacugaccugugugagaucgaggaacuuaaauccaagaaauuggcgcuggcuccuugcaaccaggccggaaugggcgugguugguaaggugggcgagaaacaguguagcucggaagagucagcacggaccauuaagaaggaugggugcaucuggaaugccgaccucgucggaauugaacugagaguggaugacgcuguuuguuacucuaaaaucacaaguguggaggccguagcaaacuauuccgcuauaccaacuaccauuggcgggcuuagguuugagcgcagccacgauucucagggaaagaucagcggcucuccccuggacauuacagccauccgagguucauucagugucaauuaccggggguugcgucucagccugucugaaauaaccgcgacuugcacgggagaggugacaaacguguccggcugcuacucauguaugaccggugccaaagucaguaucaaguuacauagcuccaaaaauucuacugcucacguuagaugcaagggcgaugaaaccgcauuuucggugcuggaggggguacacagcuauauugugucacuauccuucgaccaugccgucguggaugaacaaugucagcucaacugcggaggccacgagagucagguuacacugaaggggaaucuuaucuuuuuggacgugccuaaauucgucgacggaucuuacaugcagaccuaucauagcacugugcccacaggcgcuaacauuccauccccuacggauuggcugaaugcccucuuugguaacgggcugucaagguggaucuuaggaguuauaggcgugcugcuuggcggguuggcacucuucuuucugauuauguuccuacugaagcucggaaccaaacaagucuuucgcucucggacuaagcuggcguga

SEQ ID NO: 11624 - RNA, 3222 nt, Artificial Sequence
  derived and/or modified CDS sequence (opt3) from SFTSV/FTLSV(YXX2)__KF356534.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuugcaguuccgauucagguacgagcagugggcuguugccuucugacaggguccucuggaucggagauguggcuugucagccaaugacccccauuccugaagagacauuucuggagcugaaguccuucagccagucggaauuuccagacaucugcaaaauagauggcauuguauucaaucagugugagggcgaaucucucccgcaacccuuugacguugccuggauggauguggggcacucccauaagaucauuaugcgggagcacaaaacuaaguggguccaggagucaaguagcaaggacuucgugugcuauaaagaaggaaccgguccuuguuccgagucugaagagaagacaugcaaaaccagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacucuggaagucucacagccugagcaacgaaucggccagugcacagggugucaccuugaaugcaucaacggaggugugagauugauuacccugacgagugagcuaaagagcgccacuguuugugcuucccauuuuuguucuucggccaccagcggcaagaaauccacagagauacaguuccacucagggagucucgugggaaagacugcgauccacgucaaaggcgcacugguggaugguaccgaguucacauuugaagggucuugcauguucccagacggcugcgaugccguagacugcaccuuuuguagggaguuccuuaagaauccccaaugcuauccggcuaaaaaguggcuguuuauuaucauaguuauuuugcucggauacgccggccugauguuacugacgaacgugcucaaggcaaucggggucuggggaagcugggugaucgcuccugucaaacuuguguucgccauuaucaagaaacugaugcgggcgguuuccuguuugauggguaagcuaauggaucguggccgccaggugauucaugaagaaauaggggagaauagagagggaaaccaggacgauguaaggaucgaaauggcccggccccgacgcgucagacacuggauguauucaccagugauucugacuauccucgcaaucggccuggcugaggguugcgacgaaaugguucaugccgauagcaaacuugugucuuguaggcagggguccggcaauaugaaggagugcgucacaaccggacgggcucuguugccugccgugaaccccggccaagaggcaugucuccacuuuacugccccagggagucccgacagcaagugccugaaaauuaagguaaaacgcauaaauuuaaaguguaaaaagucuuccucauacuucgugccugaugcuagaaguaggugcacaagcguucgucggugucgaugggcgggagacugccagucgggcugcccaccgcauuuuaccuccaacucuuucagcgacgauugggcagguaagauggacagagccgggcugggauuuucaggcuguagugaugguugcggcggggcugccuguggaugcuucaaugcagcccccuccuguaucuuuuggaggaaaugggucgaaaacccucacggcauuaucuggaaggugucuccaugcgcugccugggugcccagcgcagucauugagcuaacgaugccuuccggggaaguucgcaccuuccacccaaugucaggaauccccacacagguguucaaaggcgugagcguaacuuaucucgguagugacauggaggucucugggcugaccgaucuuugugaaauagaggaguugaaguccaaaaagcuggcgcucgcuccgugcaaucaggccggaaugggcgugguugguaaagugggcgaaauccaauguagcucggaggaaucagcacggacaauuaagaaggacgggugcaucuggaacgccgaucuggucggaauugagcuuagaguggacgaugcuguuuguuacucuaaaaucacuucuguggaagccguagcaaacuauuccgcuauaccuaccacaauuggcgggcugagguuugagcgcagccaugacucucagggaaagaucagcggcuccccauuggauauuaccgccauccgagguucauucagugucaauuaccgggggcuccgucugagcuuaucugagauaacugcgacgugcacaggagaagugaccaacguguccggcugcuacucauguaugacuggugccaaagucaguaucaagcugcacagcuccaaaaauucuaccgcucauguuagaugcaagggcgacgagacagcauuuucggugcuagaagggguacacagcuauucagugucccucaguuucgauuacgccgucguggacgagcagugucagcugaacugcggaggccacgaaucucaaguuacccuuagggggaauuugauuuuucuggacgugcccaaguucgucgauggaagcuauaugcagacuuaccauuccacagugccuacgggcgcuaacauccccucaccaaccgacuggcucaaugcccuguuugguaacggguuaucucgcuggauucugggaguuaucggcgugcuuuugggcgggcucgcacuguucuuucuaauaaugagccuguucaaacucggaacuaagcagauuuuucggaguagaacaaaacuggcguga

SEQ ID NO: 11625 - RNA, 3222 nt, Artificial Sequence
  derived and/or modified CDS sequence (opt3) from SFTSV/Huaiyangshan virus(2010-FQM)__HQ419236.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuuguucuuccgauucagguacgagcagugggcuguugccuucugacaggguccucuggaucggagauguggcuugccagccaaugacccccauuccugaagagacauuucuggagcugaaguccuucagccagucggaauuuccagacaucugcaaaauagauggcauuguauucaaucagugugagggcgaaucucucccgcaacccuuugacguugccuggauggauguggggcacucccauaagaucauuaugcgggagcacaaaacuaaguggguccaggagucaaguagcaaggacuucgugugcuauaaagaaggaaccgguccuuguuccgagucugaagagaaggcaugcaaagccagcggcucaugccgcggggacaugcaguuuuguaagguggcuggaugcgaacacggcgaggaggcaagugaagccaaauguagaugcuccuuaguccauaagccaggugagguugugguaagcuacgggggcaugagggugcggcccaaauguuacggauucucucgcaugauggcuacacuggaagucucacagccugagcaacgaaucggccagugcaccgggugucaccuugaaugcaucaacggaggugugagauugauuacucugacaagugagcuaaagagcgccaccguuugugcgucccauuuuuguucuucggcaacgagcggcaagaaauccacugagauacaguuccacucagggagucucgugggaaagaccgccauccacgucaaaggcgcucugguggaugguacagaguucacuuuugaagggucuugcauguucccagacggcugcgaugccguagacugcaccuuuuguagggaguuccuuaagaauccccaaugcuauccggcuaaaaaguggcuguuuauuaucauaguuauuuugcucggauacgcaggccugauguuacugacaaacgugcucaaggccaucggggucuggggaagcugggugaucgcgccugucaaacuuguguucgccauuaucaagaaacugaugcgggcaguuuccuguuugauggguaagcuaauggaucguggccgccaggugauucaugaagaaauaggggagaauagagagggaaaccaggacgauguaaggaucgaaauggcucggccccgacgcgucagacacuggauguauucaccagugauucugaccauccucgccaucggccuggcugaggguugcgacgaaaugguucaugccgauagcaaacuugugucuuguaggcagggguccggcaauaugaaggagugcgucacgacuggacgggcacuguugccugccgugaaccccggccaagaggcuugucuccacuuuacagcgccagggagucccgacagcaagugccugaaaauuaagguaaaacgcauaaauuuaaaguguaaaaagucuuccucauacuucgugccugaugcaagaaguaggugcaccagcguucgucggugucgaugggccggagacugccagucgggcugcccaccgcauuuuacuuccaacucuuucagcgacgauugggcugguaagauggacagagccgggcugggauuuucaggcuguagugaugguugcggcggggcagccuguggaugcuucaaugcugcccccuccuguaucuuuuggaggaaaugggucgaaaacccucacggcauuaucuggaaggugucuccaugcgcagcgugggugcccagcgcugucauugagcuaacaaugccuuccggggaaguucgcaccuuccacccaaugucaggaauccccacccagguguucaaaggcgugagcguaacguaucucgguagugacauggaggucucugggcugacagaucuuugugaaauagaggaguugaaguccaaaaagcuggcccucgcaccgugcaaucaggccggaaugggcgugguugguaaagugggcgaaauccaauguagcucggaggaaucagcucggacuauuaagaaggacgggugcaucuggaacgccgaucuggucggaauugagcuuagaguggacgaugcaguuuguuacucuaaaaucaccaguguggaagcuguagccaacuauuccgcgauaccuacaacuauuggcgggcugagguuugagcgcagccaugacucucagggaaagaucagcggcuccccauuggauauuaccgccauccgagguucauucagugucaauuaccgggggcuccgucugagcuuaucugagauaacagcuaccugcacuggagaagugacgaacguguccggcugcuacucauguaugacaggugcaaaagucaguaucaagcugcacagcuccaaaaauucuaccgcccauguuagaugcaagggcgacgagacugcuuuuucggugcuagaagggguacacagcuauucagugucccucaguuucgaucacgccgucguggacgagcagugucagcugaacugcggaggccaugaaucucaaguuacccuuagggggaauuugauuuuucuggacgugcccaaguucgucgauggaagcuacaugcagacauaucacuccaccgugccuacuggcgcaaacauccccucaccaacagacuggcucaaugcgcuguuugguaacggguuaucucgcuggauucugggaguuaucggcgugcuuuugggcgggcucgcccuguucuuucuaauaauguuccuguuuaaacucggaacgaagcagauuuuccggagcagaaccaaacuggcuuga

SEQ ID NO: 11626 - RNA, 3222 nt, Artificial Sequence
  derived and/or modified CDS sequence (opt3) from SFTSV/Huaiyangshan virus(2010-LZR)__HQ419237.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuugcaguuccgauucagguacgagcagugggcuguugccuucugacaggguccucuggaucggagauguggcuugucagccaaugacccccauuccugaagagacauuucuggagcugaaguccuucagccagucggaauuuccagacaucugcaaaauagauggcauuguauucaaucagugugagggcgaaucucucccgcaacccuuugacguugccuggauggauguggggcacucccauaagaucauuaugcgggagcacaaaacuaaguggguccaggagucaaguagcaaggacuucgugugcuauaaagaaggaaccgguccuuguuccgagucugaagagaagacaugcaaaaccagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacucuggaagucucacagccugagcaacgaaucggccagugcacagggugucaccuugaaugcaucaacggaggugugagauugauuacccugacgagugagcuaaagagcgccacuguuugugcuucccauuuuuguucuucggccaccagcggcaagaaauccacagagauacaguuccacucagggagucucgugggaaagacugcgauccacgucaaaggcgcacugguggaugguaccgaguucacauuugaagggucuugcauguucccagacggcugcgaugccguagacugcaccuuuuguagggaguuccuuaagaauccccaaugcuauccggcuaaaaaguggcuguuuauuaucauaguuauuuugcucggauacgccggccugauguuacugacgaacgugcucaaggcaaucggggucuggggaagcugggugaucgcuccugucaaacuuguguucgccauuaucaagaaacugaugcgggcgguuuccuguuugauggguaagcuaauggaucguggccgccaggugauucaugaagaaauaggggagaauagagagggaaaccaggacgauguaaggaucgaaauggcccggccccgacgcgucagacacuggauguauucaccagugauucugacuauccucgcaaucggccuggcugaggguugcgacgaaaugguucaugccgauagcaaacuugugucuuguaggcagggguccggcaauaugaaggagugcgucacaaccggacgggcucuguugccugccgugaaccccggccaagaggcaugucuccacuuuacugccccagggagucccgacagcaagugccugaaaauuaagguaaaacgcauaaauuuaaaguguaaaaagucuuccucauacuucgugccugaugcuagaaguaggugcacaagcguucgucggugucgaugggcgggagacugccagucgggcugcccaccgcauuuuaccuccaacucuuucagcgacgauugggcagguaagauggacagagccgggcugggauuuucaggcuguagugaugguugcggcggggcugccuguggaugcuucaaugcagcccccuccuguaucuuuuggaggaaaugggucgaaaacccucacggcauuaucuggaaggugucuccaugcgcugccuggauucccagcgcagugaucgagcuaacgaugccuuccggggaaguccgcaccuuccacccaaugucaggaauacccacacagguuuucaaaggcgugagcgugacuuaucucgguagugacauggagguaucugggcugaccgaucuuugugaaaucgaggaguugaaguccaaaaagcuggcgcucgcuccgugcaaucaggccggaaugggcgucguggguaaaguuggcgaaauucaauguagcucggaggaaucagcacggacaaucaagaaggacgggugcauuuggaacgccgaucuggugggaaucgagcuuagagucgacgaugcuguguguuacucuaaaauaacuucuguugaagccguggcaaacuauuccgcuauuccuaccacaaucggcgggcugagguuugagcgcagccaugacucucagggaaagauuagcggcuccccauuggauaucaccgccauacgagguucauucaguguaaauuaccgggggcuccgucugagcuuaucugagaucacugcgacgugcacaggagaagucaccaacguguccggcugcuacucauguaugacuggugccaaagugaguauuaagcugcacagcuccaaaaauucuaccgcucaugucagaugcaagggcgacgagacagcauuuucgguucuagaaggggugcacagcuauucaguaucccucaguuucgaucacgccguggucgacgagcagugucagcugaacugcggaggccaugaaucucaagugacccuuagggggaauuugaucuuucuggacguucccaaguucguggauggaagcuacaugcagacuuaucacuccacagucccuacgggcgcuaacauucccucaccaaccgacuggcucaaugcccuguuugguaacggguuaucucgcuggauccugggagugauaggcguucuuuugggcgggcucgcacuguucuuucuaauuaugagccuguucaaacucggaacuaagcagaucuuucggaguagaacaaaacuggcguga

SEQ ID NO: 11627 - RNA, 3222 nt, Artificial Sequence
  derived and/or modified CDS sequence (opt3) from SFTSV/Huaiyangshan virus(2010-T112)__HQ419238.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugugcaacgaaucggacagugcacuggcugucaccuggagugcaucaaugggggaguuagacuuauuacauugaccagcgaacugaaguccgccacggugugugcuucucauuucugcucgagcgccacuuccgguaagaaaucaaccgagauacaguuccacaguggcucucuagucgggaagacagcgauccacgugaaaggagcacucguagauggcacugaguuuaccuucgaagguagcuguauguuuccagacgggugcgaugccguugacugcacauucuguagggaguuucugaagaacccccaaugcuauccggcuaaaaaguggcuuuucauuaucauagugauucuguugggcuacgccggacucaugcuguuaaccaauguccugaaggcaaucggcaucuggggguccugggugauugcuccugucaaacucaucuuugccauuauaaagaaacuuaugcggacggugucaugucugaugggaaaguugauggaucguggucgccagguuauccaugaagagauuggcgaaaacagagaggggaaucaggacgaugugaggaucgagauggcgcggccccgacgcguaagacacuggauguaugccccagucauccuaacuauucuggcaaugggacucgcugaaagcugcgacgagauggugcaugccgauucuaaacugguuuccuguaggcagggcagugguaacaugaaggaaugcgugacaaccgggcgggcccuucugccugcugucaaucccggccaagaggcauguuugcacuucacugccccaggaagccccgacucuaagugccucaaaauaaaggugaaacgcaucaaccugaaguguaaaaaguccucaaguuacuuuguaccugaugcuagaucgaggugcacaagcgugcgucggugucgaugggcgggcgacugccaguccgggugcccaccgcauuucaccucuaauagcuuuucagacgauugggcaggaaagauggacagagccggcuuagguuucaguggguguuccgauggaugcggcggugcugccuguggcugcuuuaacgcagcccccucuuguauuuucuggaggaaauggguugagaauccucacgggaucauuuggaaggucagcccaugcguggcuugggugcccuccgccgucaucgaacugacgaugccuucaggagagguucgcaccuuccacccaaugagcggcauacccacacagguguuuaaaggggugaguguaacuuaucuaggaucugacauggaagucuccggccucaccgaucugugugagaucgaggaacuuaagagcaaaaaguuggcacuggcgccgugcaaccaggcugguaugggggugguuggaaaagugggcgagauucaauguucgucagaagagucugcccggacaaucaagaaggacgguugcauuuggaacgcagaucucgucggcaucgaacugagaguggacgaugccguuuguuacaguaaaauaacuuccguggaggcuguagccaauuauagcgcaauuccuaccacaaucgggggacuuagguucgaacgcucucaugacagccagggcaagauuuccgggucaccacuggauaucaccgcuauacgaggaaguuuuagcgucaacuaccggggcuugcgucucucucuguccgagaucacugccacgugcacaggugaggugaccaaugugucagggugcuacaguuguaugacuggagcgaaagucagcauuaaguuacacuccucuaaaaacucgaccgcccauguuagaugcaagggcgacgaaacagcuuucagcgugcuggaggguguacacucauauaccgugucccuaaguuuugaucacgcagucguggacgaacagugucagcucaauugcggcgggcaugagucucaaguuacucugaagggaaaccuuaucuucuuggacgugcccaaauuugucgauggcagcuacaugcagacauaucacuccacggugccuaccggggccaauauucccucaccaacugacuggcugaacgcucucuucggaaauggccugucuagguggaucuuagguguuauaggggugcugcuuggaggcuuggcccucuuuuucaugauuaugagccuguuuaagcuaggcacaaaacaggucuuccgcagucggaccaagcuggcauga

SEQ ID NO: 11628 - RNA, 3222 nt, Artificial Sequence
  derived and/or modified CDS sequence (opt3) from SFTSV/Huaiyangshan virus(2010-WJ)__HQ419229.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggaaacggggaggccgcagccagguaaguuacuauuuagcagaaaacuccuacucucgauggagcggucugcuauccccgugcgaugccgacuggcucgggaugcugguggucaagaaagcgaagggaucagauaugauugugcccggcccuaguuauaagggcaaaguuuucuucgagcguccaaccuuugacggguacgugggaugggguuguggcagcgggaagucuagaacagaauccggagagcuuugcucaagcgauaguggcacuucuuccggucuguugcccagcgacaggguccucuggaucggggauguggcuugucaaccuaugacgccaauucccgaagagaccuuccuggagcugaaaucguuuucucaguccgaauuuccugacaucugcaagauagauggaauuguauuuaaucagugugagggcgaaucacucccacagccguucgacguugccuggauggaugugggccacagucauaaaaucauuaugcgggagcacaagacaaaguggguccaagagagcuccucuaaagacuuugugugcuauaaggaagggacuggacccuguagcgagucagaagagaaaaccugcaagacaagugguuccugccgcggcgacaugcaguucuguaaaguggcagggugcgaacacggagaggaggccagcgaagcuaaguguagaugcucuuuaguccauaaaccuggcgagguugugguaucauacggugggaugagggugcggccaaaguguuacggcuuuagucgcaugauggcaacccuggaagucaaccagcccgagcagcgaaucggacaaugcacuggcugucaccuugaaugcaucaaugggggagugagauugauuacacugaccagcgagcuaaaguccgccacgguuugugcuucucauuucugcucgagcgccacuuccgguaaaaagucaaccgagauacaguuccacaguggcucucucguggggaaaacagcgauccacgucaagggagcacugguggauggcacugaauuuaccuucgaggguagcuguauguuuccugacgggugcgaugccguagacugcacauucuguagggaauuucuuaaaaacccacagugcuaucccgcuaagaaguggcuguucauuaucauaguuauuuugcucggcuacgccggacugauguuacugaccaaugugcucaaagcaaucggcaucuggggguccugggucauugcuccggugaaacuuaucuuugccauuauaaagaagcugaugcggacggucucauguuugaugggaaaacuaauggaucguggucgccaagugauccaugaggaaauuggcgagaacagagaggggaaucaggacgauguuaggaucgaaauggcgcggccucgacgcgugagacacuggauguauagccccguaauccugacuauucucgccauaggacuggcagagucuugcgacgaaaugguccaugcugauuccaaacuugugaguuguaggcagggcagcgguaacaugaaggagugcguuacaaccgggcgggcccuguugccagcugugaauccuggccaggaggccugucuccacuucacugcacccggaucuccagacuccaagugccugaagaucaaagucaagcgcauuaacuuaaaauguaagaagucaaguagcuacuuugugcccgaugccagaucgaggugcacauccguacgucggugucgaugggcuggcgacugccaaucugggugcccuccacauuucaccccgaauagcuuuucagacgauugggcgggaaaaauggacagagcaggccuggguuucaguggguguuccgauggaugcggcggugccgcuuguggcugcuuuaacgccgcacccucuuguaucuucuggaggaaguggguggaaaauccucacgggauuaucuggaaaguuagcccaugcgccgcuuggguccccuccgccgugauagagcuaacgaugccuucaggagaagugcgcaccuuccacccaaugagcggcauccccacacaggucuuuaaggggguuagugugacuuaucucggaucugacauggagguguccggccugaccgaucuuugugaaauugaggaguugaaaagcaagaaacuggcacucgcgccgugcaaccaggcugguauggggguagucggaaaggugggcgaaauccaguguucgucagaggaaucugcccggacaauuaagaaagacgguugcaucuggaacgcagaucugguuggcauagagcuuagaguggacgaugccgucuguuacaguaagauuacuuccguggaagcuguugccaauuauagcgcaaucccuaccacaauugggggacugagguucgagcgcucucaugacagccaaggcaaaaucuccgggucaccauuggauauaaccgcuauccgaggaaguuuuagcgugaacuaccggggccuccgucugucuuuauccgagauuacugccacgugcacaggugaaguaaccaaugucucagggugcuacaguuguaugacuggagcgaaggugagcaucaaacugcacuccucuaagaacucgaccgcccaugugagaugcaagggcgacgagacagcuuucagcguccuagaagguguucacucauauaccgugucccucaguuuugaucacgcaguaguggacgagcagugucagcugaauugcggcgggcaugaaucucaggucacucuuaaaggaaacuugauuuuccuggacgugcccaaguuuguugauggcagcuacaugcaaacauaucacuccacggugccuaccggggccaauauccccucaccaacugacuggcucaacgcucuguucggaaauggcuuaucuagguggauacugggugucauuggggugcuuuugggaggccucgcccuguuuuucaugaucaugagccuauuuaaacugggcacaaagcagguuuuccgcagucggaccaaacucgcauga

SEQ ID NO: 11629 - RNA, 3222 nt, Artificial Sequence
  derived and/or modified CDS sequence (opt3) from SFTSV/Huaiyangshan virus(2010-WJQ)__HQ419230.1__GP
augaugaaggugaucugguucagcucccugauuugccucgucauacaguguggcggggacaccggacccaucauuugcgccgguccuacacacucuaacaaaucagcugauaucccacaucuucugggcuacagugagaagauuugucaaaucgacagauugauacacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugaucgugccuggcccauccuauaaggggaagguuuucuuugagcgucccacuuucgacggauacguggguuggggcugugggucaggaaaaaguagaacggaaagcggcgagcuuugcaguuccgauucagguaccagcagugggcuguugccuucugacaggguccucuggauuggagauguggcuugucagccaaugacacccaucccugaagagacuuuucuggagcugaaguccuucagccagucggaauuuccagacauuugcaaaaucgauggcauaguauucaaucagugugagggcgaaucucucccgcaacccuuugacguugccuggauggauguggggcacucccauaagauuaucaugcgggagcacaaaaccaaguggguccaggagucaaguagcaaggacuucgugugcuauaaagaaggaacagguccuuguuccgagucugaagagaagaccugcaaaacuagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacacuggaagucucacagccugagcaacgaauuggccagugcaccgggugucaccuugaaugcaucaacggaggugugagauugaucacgcugacuucugagcuaaagagcgccaccguuugugcuucccauuuuuguucuucggccacaagcggcaagaaauccacugagauucaguuccacucagggagucucgugggaaagaccgcgauacacgucaaaggcgcacugguggaugguacagaguucaccuuugaagggucuugcauguucccagacggcugcgaugccguagacugcacguuuuguagggaguuccuuaagaauccccaaugcuauccggcuaaaaaguggcuguuuaucauuaucguuauauugcucggauacgccggccugauguuacugacuaacgugcucaaggcaauuggggucuggggaagcugggugaucgcuccugucaaacuuguguucgccaucauuaagaaacugaugcgggcgguuuccuguuugauggguaagcuaauggaucguggccgccaggugauccaugaagaaauuggggagaauagagagggaaaccaggacgauguaaggauagaaauggcccggccccgacgcgucagacacuggauguauucaccagugauccugacaauucucgcaaucggccuggcugaggguugcgacgaaaugguucaugccgauagcaaacuugugucuuguaggcagggguccggcaauaugaaggagugcgucaccacuggacgggcucuguugccugccgugaaccccggccaagaggcaugucuccacuuuacagccccagggagucccgacagcaagugccugaaaaucaagguaaaacgcauuaauuuaaaguguaaaaagucuuccucauacuucgugccugaugcuagaaguggaugcaccagcguuaggcguugucggugggcgggcgacugccagucggguugcccaccgcauuuuacguccaacucuuucagcgacgauugggcagggaagauggaccgagccggacugggcuuuucagguuguagugauggcugcgggggagcugccuguggcugcuucaaugcagcccccuccuguauauuuuggagaaaaugggucgaaaacccucacgggaucauuuggaaggugucuccaugcgcugccugggugcccagcgcagucaucgagcuaaccaugccuuccggagaaguuaggacauuccacccaaugucaggcauucccacucagguguucaaaggugugagcguaaccuaucucgggagugacauggaggucucuggacugacagaucuuugugaaaucgaggaguugaaguccaaaaagcuggcgcucgcuccgugcaaucaggccggcaugggugugguuggcaaagugggggaaauacaauguagcucggaggaaucagcacgcacuaucaagaaggacggaugcauuuggaacgccgaucuggucggcaucgagcuucggguggacgaugcuguuuguuacucuaaaauuaccaguguggaagccguagcaaacuauuccgcuaucccuacaaccauagggggacugagauuugagaggagccaugacucucagggcaagauuagcgguuccccauuggauaucacugccauucgcgggucauucagugucaauuaccgaggacuccggcugagcuuaucugagaucacggcgacaugcaccggcgaagugacuaacguguccgguugcuacucauguaugaccggcgccaaagucaguauaaagcugcacagcuccaaaaauucuacagcucauguucguugcaagggggacgagaccgcauuuucggugcuagaaggaguacacagcuauucagugucccucaguuucgaucacgccgucguggacgagcagugucagcugaacugcggcgggcaugaaucucaaguuacucuuagaggaaauuugaucuuucuggacgugcccaaguucgucgauggcagcuacaugcagacauaucacuccacggugccuaccggugcuaacauucccucaccaacugacuggcucaaugcccuguuugggaacggauuaucuagguggauccugggcguuauuggcgugcuucucgggggauuggcacuguucuuucuaaucaugagccuguucaaacucgguacaaagcagauauuucgcagucggaccaaacuggcguga

SEQ ID NO: 11630 - RNA, 3222 nt, Artificial Sequence
  derived and/or modified CDS sequence (opt3) from SFTSV/Huaiyangshan virus(2010-WSQ)__HQ419235.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauguugccuggauggacgugggccacagucauaagaucauuaugcgggagcacaaaacaaaguggguccaggaaagcuccucuaaggauuucgugugcuauaaagaggggacuggaccuuguagcgaaucagaggaacgcgcaugcaagaccagugguuccugcagaggcgacaugcaguuuuguaaaguggccgggugcgagcacggagaggaagcuagcgaggcaaaguguaggugcucuuuaguccauaaaccaggcgaaguugugguaucauacggugggaugcgggugcgccccaaguguuacggcuucagucgaaugauggccacacuggaggucaacccuccagaacagagaaucggacaaugcaccggcugucaccuugagugcaucaaugggggagugagguugauuacucugacaagcgagcuacgguccgcuaccguuugugccucucauuuuugcucgagcgcgacguccgguaaaaagucaacugaaauacacuuccacaguggcucucucaucgggaagaccgcaauucaugugaaaggagcccuggucgacggcacagaguucacuuuugaagguagcuguauguuccccgaugggugcgacgcuguggauugcaccuuuugucgugaguuccuuaagaacccgcagugcuauccugccaaaaaguggcuguuuaucauaauuguaaucuugcucggcuacgcaggacugauguuacugacaaauguucucaaagcuaucggcguguggggguccugggucauugcccccgugaaguugauguucgcgaucauuaagaaacugaugcgcaccgucucauguuuggugggaaagcuaauggacagagguaggcagguuauacacgaagagaucggcgagaacggggaaggaaaucaagaugacgugcggauugagauggcccgaccacgcagaguaaggcauuggauguauagcccugucauccugacgauccucgcaauuggccuggcugaagauugcgacgagauggugcacgccgauucuaaacuuguuuccugucggcaggguagugggaacaugaaggagugcauaacuacaggccgcgcucuguugcccgccgugaauccaggacaggaagcaugucuccauuuuaccgcccccggcagcccugacucuaaaugccugaagaucaaggucaaaagaauuaacuuaaaguguaaaaaguccucaaguuacuucgugccagaugcuaggagccguugcacuucgguacggcgauguagaugggcgggggacugccaguccggaugcccgccccacuuuacaucuaauagcuucucagacgauugggcaggcaaaauggacagggccggucugggguuuaguggauguuccgauggcugcgguggcgcugccugugggugcuucaacgcagccccuucuuguaucuuuuggcgcaaguggguggagaauccacacggaauuaucuggaagguuagccccugcgcugccugggucccuuccgcagugauagaacuaaccaugccaucaggcgaggugcggacguuccaucccaugagcgggaucccgacccaagucuucaaaggaguuagugugacauaucucggcucugacauggaaguguccggucugacugaucuuugugagauugaggaacuuaagagcaaaaagcuggcgcucgcuccuugcaaccaggccgggaugggaguagucggcaaagugggugagauccaguguucgucagaagagucugcaagaaccauuaagaaagacggcugcaucuggaacgccgaucugguugggauagaacuuaggguggacgaugcugucuguuacaguaagauuacauccguggaggccguugcaaauuauagcgcuaucccaacuaccauuggaggccugcgcuuugagaagucucacgacagccaggggaaaaucuccggaucacccuuggauauaacagccauccgaggcaguuucagcgugaacuaccggggucuccgucugucuuuauccgaaauuaccgcgacuugcacgggggagguaacaaaugucucaggaugcuacaguuguaugaccggcgccaaggugagcaucaaacugcauuccucuaagaacucgacugcucacgugagaugcaaaggugacgaaaccgcauuuagcguccuagagggcguucacucauauauugugucccucaguuucgaucaugccguaguggacgaacaaugucagcugaauugcgggggacacgagucucaggucacacuuaagggcaacuugaucuuucuggacgugccuaaguucguugaugggagcuacaugcagaccuaucauuccacugugcccacaggagcuaauauaccaucaccuacggacuggcucaacgcccuguuuggcaaugguuuaucuagguggauucugggggucaucggagugcuuuugggcggccucgcacuguucuuucuaaucauguuccugcucaaacuggggaccaagcaaguuuuucgcagccggacuaaacuugcguga

SEQ ID NO: 11631 - RNA, 3222 nt, Artificial Sequence
  derived and/or modified CDS sequence (opt3) from SFTSV/Huaiyangshan virus(2010-WWG)__HQ419231.1__GP
augaugaaggugaucugguucagcacccugauuugcuuugucauacaguguuccggcgacucugggcccaucauuugcgccggaccuauccacucaaacaaaagugcugauauuccacaucuccuugguuacagcgagaagaucugucaaauagacagacugauccacguuuccucuugguugaggaaucauucgcaguuccagggcuauguggggcagcggggaggccgcucacaaguaagcuacuauccggcagaaaacaguuacucccgauggucugguuuacugagccccugcgaugccgacuggcuagggaugcucguggucaaaaaggcgaaaggauccgauaugauugugccuggcccaucauauaagggcaagguuuucuucgagcgucccacauuugacggguacgugggaugggguuguggcagugggaaaagcagaacugaaucuggagagcugugcuccucagauagcggcacgaguucuggucuucugccuuccgacagggucuuguggaucggggauguggcuugucagccaaugacccccauuccugaagagacauuccucgagcuuaagagcuuuucgcagucugaauuuccagacaucugcaaaauagauggaauuguauuuaaucagugugagggcgaaucccugccgcaacccuucgacguugccuggauggaugugggccacucacauaagaucauuaugcgggagcacaaaacuaaguggguccaggagaguagcuccaaggacuuugugugcuauaaagaagggaccggaccuuguucugagagcgaagagaagacaugcaaaaccucagguaguugccgcggcgacaugcaguucuguaagguggcagggugcgaacacggagaggaggccuccgaagcuaaauguagaugcagccucguccauaagccaggcgagguugugguaucuuacggugggaugagggugcggcccaaauguuacggcuuuccucgcaugauggcaacuuuagaagucaaccagccagagcaacgaaucggacagugcacaggcugucaccuggaaugcaucaaugggggagugagacuuauuaccuugacgucagagcugaggagugccacuguuugugcuagccauuucugcuccucugccaccucggguaaaaagagcacagagauacaguuccacuccggcagucuaguggggaaaacugcgauccacgucaagggagcacucguggauggcaccgaauuuacauucgaggguaguuguauguuucccgacgggugcgaugccguagacugcaccuucugucgggaauuucugaaaaacccgcaaugcuauccugcuaagaaauggcuucugauuaucauaguuauuuugcucggcuacgccggacugauguuacugacgaaugugcucaaggcaaucggcaucugggggucuugggucauugcucccgugaagcugaucuucgccauuauaaagaagcugaugcgugcggucagcuguuugaugggaaaacuaauggaucgcgguagacaggugauccaugagggcauuggggaaaacagggagggaaaucaggacgauguucggaucgagauggcccgaccacgcagagugaggcacuggauguauuccccuguaauccugacuauucucgcaauaggccuggcugaaucaugcgacgagaugguccaugccgauagcaaacuugugucuugucggcaggguuccgggaacaugaaggaaugcguuacaaccggccgcgcucuguugcccgccgugaauccaggacaagaggcaugucuccacuuuacugcccccggcaguccugacagcaagugccugaagaucaaagucaagagaauuaacuuaaaauguaagaaaucuuccucauacuucgugccagaugcuaggagucguugcacaagcguacggcgauguagaugggcgggggacugccagucgggaugcccgccccauuuuaccuccaauucuuucagcgacgauugggcaggcaagauggacagggccggucugggguuuucaggauguagugauggcugcgguggcgcugccugugggugcuucaacgcagccccuuccuguaucuuuuggcgcaaguggguggagaauccacacggaauuaucuggaaaguuucucccugcgcugccugggucccuagcgcagugauagaacuaacgaugccauccggcgaggugcggaccuuccaccccaugucagggaucccgacacaggucuucaagggaguuagcgugacuuaucucggcagugacauggaagugucuggucugaccgaucuuugugagauugaagaguugaaauccaagaaacuggcgcucgcuccuugcaaccaggccgggaugggaguagucggcaaggugggugagauccaauguagcucggaagagucagcaagaacaauuaaaaaggacggcugcaucuggaacgccgaucugguugggauagaacuuaggguggacgaugcugucuguuacucuaagauuacuucaguggaggccguugcaaauuauuccgcuaucccaaccacaauuggaggccugcgcuuugaacgaagccaugacucucaggggaaaaucagcggaucccccuuggauauaaccgccauccggggcucauucagugugaacuaccguggucucagacugagcuuaucugagauuacugcgacgugcacaggggagguaaccaaugucuccggaugcuacucauguaugacuggcgccaaggugaguaucaaacugcacagcuccaagaacucuaccgcucaugugaggugcaaaggugacgaaacagcauuuucgguccuagagggcguucacagcuauaccgugucacucuccuucgaucacgccguaguggacgaacagugucagcugaauugcgggggacaugagagucaagucacucuuaagggcaacuugauuuuucuggacgugccuaaguucguugaugggucuuacaugcagacauaucacagcacggugcccaccggagcuaauaucccauccccuacugacuggcucaacgcccuguuuggcaaugguuuaucacgcuggauacugggggucauuggagugcuuuugggcggccucgcacuguucuuuaugaucaugucucuauucaaacuggggacaaagcagguuuuucggagcagaaccaaacucgcguga

SEQ ID NO: 11632 - RNA, 3222 nt, Artificial Sequence
  derived and/or modified CDS sequence (opt3) from SFTSV/Huaiyangshan virus(2010-WWX)__HQ419232.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucugcuugaaugcaucaaugggggagugagauugauuacacugaccagcgagcuaaaguccgccacgguuugugcuucucacuucugcucgagcgccacuuccgguaagaaaucaaccgagauacaguuccauaguggcucucucguggggaagacagcgauccacgucaaaggagcacugauugauggcacugaauuuaccuucgaggguagcuguauguuuccagacgggugcgaugccguggacugcacauucuguagggaauuucuuaagaacccccaaugcuauccggcuaaaaaguggcuguucaucauaauuguaaucuugcucggcuacgccggacugauguuacugaccaauguucucaaggcaaucggcauuuggggguccugggugaucgcuccugucaaacuuauuuuugccauaaucaagaaacugaugcggacggugucauguuugaugggaaagcuaauggaucguggucgccaggucauucacgaggaaaucggcgagaacagagaggggaaucaggacgaugugaggaucgaaauggcgcggccccgacgcguuagacauuggauguauagcccagugauucugacuauacucgccaucggacuggcagagucuugcgacgaaaugguacacgcugauuccaaacuugucaguuguaggcagggcagcgguaacaugaaggagugcgugacaaccgggcgggcccuguugccugcuguuaaucccggccaagaggccugucuccauuucacugcaccaggaucucccgacuccaagugccugaaaauuaaggugaaacgcaucaacuuaaaguguaaaaagucaaguagcuacuuugucccugaugccagaucgaggugcacauccgugcgucggugucgaugggcuggcgacugccagucugggugcccaccgcacuucaccagcaauucauuuagugacgauugggcgggaaagauggacagagcaggccuggguuucuccggguguucugauggaugcggcggugccgcuuguggcugcuuuaacgccgcacccagcuguauuuucuggaggaaauggguagaaaauccucaugggaucauauggaagguguccccaugcgccgcuuggguucccucagccgucaucgagcuaacgaugccuagcggagaagugcgcaccuuccacccaaugaguggcauucccacacagguguuuaaaggggucucuguuacuuaucucggauccgacauggaggugagcggccugaccgaucuuugugaaaucgaggaguugaagucgaaaaagcuggcacucgcgccgugcaaccaggcugguaugggggugguaggaaaagucggcgaaauucaauguucaucugaggaaagugcccggacaaucaagaaggacgguugcauauggaacgcagaucuggugggcauugagcuuagaguugacgaugccguguguuacuccaaaaucacuagcgucgaagcuguggccaauuauucugcaauuccuaccacaaucgggggacugagguucgagcgcagccacgacucccagggcaagauaucagggaguccauuggauaucaccgcuauucgaggcagcuuuucuguuaacuaccggggacuccgucuguccuuaucagagaucacugccacgugcacaggugaagugaccaauguaagugggugcuacagcuguaugacuggagcgaaagucuccauuaagcugcauucuucgaaaaacagcaccgcccacgugagaugcaagggcgacgagacagcuuucucagugcuagaagguguccauuccuauaccguuagucucucuuuugaucacgcagugguagacgagcagugucagcugaauugcggcgggcacgaaagccaagugacucuuaagggaaacuugaucuuccuggacguccccaaauuuguggauggcuccuacaugcagacauaucauucaacgguuccuaccggggccaauauacccucuccaacugacuggcucaacgcucuguucggaaauggcuuaaguagguggauucugggugugaucgggguccuuuugggaggccucgcccuguuuuucaugaucaugagccuauuuaagcugggcacaaaacagguguuccgcucccggaccaagcucgcauga

SEQ ID NO: 11633 - RNA, 3222 nt, Artificial Sequence
  derived and/or modified CDS sequence (opt3) from SFTSV/Huaiyangshan virus(2010-ZGQ)__HQ419233.1__GP
augaugaaggugaucugguucagcucccugauuugccucgucauacaguguggcggggacaccggacccaucauuugcgccgguccuacacacucuaacaaaucagcugauaucccacaucuucugggcuacagugagaagauuugucaaaucgacagauugauacacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugaucgugccuggcccauccuauaaggggaagguuuucuuugagcgucccacuuucgacggauacguggguuggggcugugggucaggaaaaaguagaacggaaagcggcgagcuuugcaguuccgauucagguaccagcagugggcuguugccuucugacaggguccucuggauuggagauguggcuugucagccaaugacacccaucccugaagagacuuuucuggagcugaaguccuucagccagucggaauuuccagacauuugcaaaaucgauggcauaguauucaaucagugugagggcgaaucucucccgcaacccuuugacguugccuggauggauguggggcacucccauaagauuaucaugcgggagcacaaaaccaaguggguccaggagucaaguagcaaggacuucgugugcuauaaagaaggaacagguccuuguuccgagucugaagagaagaccugcaaaacuagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacacuggaagucucacagccugagcaacgaauuggccagugcaccgggugucaccuugaaugcaucaacggaggugugagauugaucacgcugacuucugagcuaaagagcgccaccguuugugcuucccauuuuuguucuucggccacaagcggcaagaaauccacugagauucaguuccacucagggagucucgugggaaagaccgcgauacacgucaaaggcgcacugguggaugguacagaauuuaccuuugaggggucuugcauguucccagacggcugcgaugccguagacugcacguuuuguagggaguuccuuaagaauccccaaugcuauccggcuaaaaaguggcuguuuaucauuguugugaucuugcucggauacgccggccugauguuacugacuaacguccucaaggcaauagggguguggggaagcugggucauugcuccugugaaacuuguuuucgccaucaucaagaaacugaugcgggcgguguccuguuugauggguaagcuaauggaucguggccgccagguaauucaugaagaaaucggggagaauagagagggaaaccaggacgaugucaggauugaaauggcccggccccgacgcgugagacacuggauguauucaccaguuauacugacaauccucgcaauuggccuggcugaggguugcgacgaaauggugcaugccgauagcaaacuugucucuuguaggcagggguccggcaauaugaaggagugcgugaccacuggacgggcucuguugccugccguaaaccccggccaagaggcaugucuccacuuuacagccccagggagucccgacagcaagugccugaaaaucaaggugaaacgcaucaauuuaaaguguaaaaagucuuccucauacuucguuccugaugcuagaaguaggugcaccagcguccgucggugucgaugggcgggagacugccagucgggcugcccaccgcauuuuacguccaacucuuucagcgacgauugggcagguaagauggacagagccgggcugggauuuucaggcuguagugaugguugcggcggggcugccuguggaugcuucaaugcagcccccuccuguauuuucuggaggaaauggguggaaaacccucacggcauaaucuggaaggugucuccaugcgcugccuggguccccagcgcaguuauugagcuaaccaugccuuccggggaagugcgcacauuccacccaaugucaggaauccccacucagguguucaaaggcguaagcgucaccuaucucgguagugacauggaggugucugggcugacagaucuuugugaaauugaggaguugaaguccaaaaagcuggcgcucgcuccgugcaaucaggccggaaugggcguuguggguaaagucggcgaaauccaauguagcucggaggaaucagcacggacuauaaagaaggacgggugcaucuggaacgccgaucuggugggaauugagcuuagaguugacgaugcuguguguuacucuaaaaucaccaguguagaagccgucgcaaacuauuccgcuauuccuacaaccaucggcgggcugagguuugagcgcagccaugacucucagggaaagauaagcggcuccccauuggauauuacugccauccgagguucauucagugugaauuaccgggggcuccgucugagcuuaucugagauuacggcgacaugcaccggagaagugacuaacgucuccggcugcuacucauguaugaccggugccaaaguuaguaucaagcugcacagcuccaaaaauucuacagcucaugugagaugcaagggcgacgagaccgcauuuucgguacuagaaggggugcacagcuauucagucucccucaguuucgaucacgccgugguugacgagcagugucagcugaacugcggaggccaugaaucucaagugacucuuagggggaauuugauauuucuggacguccccaaguucguggauggaagcuacaugcagacauaucacuccacgguuccuaccggcgcuaacauccccucaccaacugacuggcucaaugcccuguuugguaacggguuaucucgcuggauucugggagugaucggcguccuuuugggcgggcucgcacuguucuuucuaauuaugagccuguucaaacucggaacaaagcagaucuuucggaguagaaccaaacuggcguga

SEQ ID NO: 11634 - RNA, 3222 nt, Artificial Sequence
  derived and/or modified CDS sequence (opt3) from SFTSV/Huaiyangshan virus(M-HZM)__JF951393.1__GP
augaugaaggugaucugguucagcucccugaccugccucgucauucaguguucuggcgacucagggcccauaaucugcgccggaccuauucacaguaacaaaagcgcugguaucccacaucuucugggcuacuccgagaagauuugucaaaucgauagauugauacacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugaucgugccuggcccaaguuauaagggcaagguuuucuuugaacgucccacauucgauggguacgugggaugggguuguggcagcgggaaaucuagaacugaguccggagaacuuugcucaagcgacaguggcacgucuuccggucuguugccuagcgauaggguccucuggauuggggacguggcuugucagccaaugacccccaucccugaggagacauuucuggaacugaagucguucucucaguccgaguuuccagauauuugcaaaaucgacggaauaguauucaaucagugugaaggcgagucacucccgcaacccuuugauguugccuggauggacgugggccacagucauaagauuaucaugcgggagcacaaaacuaaguggguccaggaaagcuccucuaaggauuucgugugcuauaaagaggggaccggaccuuguagcgaaucagaggaaaaggcaugcaaaacaagugguuccugccgcggcgacaugcaguuuuguaagguggccgggugcgagcacggagaggaagcuagcgaggcaaaauguagaugcucuuuaguccauaagccaggcgaaguugugguaucauacggugggaugagggugcggcccaaauguuacggcuucagucgcaugauggccacccuggaggucaacccuccagaacagcgaauuggacaaugcacuggcugucaccuugagugcaucaaugggggagugagauugaucacacugaccagcgagcuaagguccgcuacgguuugugccucucauuuuugcucgagcgcgacuuccgguaagaagaacaccgaaauucacuuccacucaggcagucucguggggaaaacagcaauacaugucaagggagcccugguggacggcacugaguucaccuuugaagguucuuguauguuccccgaugggugcgacgcuguagauugcacauuuugucgggaguuccuuaaaaauccgcagugcuauccugccaagaaauggcuguuuaucauuaucguuauauugcucggcuacgcaggacugauguuacugaccaacgugcucaaggcuauuggcgucugggggagcugggugaucgcccccgucaaacuuauguucgcgaucauuaagaagcugaugcguacgguguccuguuugguuggaaaacuaauggaccgcgguagacaggugauccacgaagagauuggcgagaauggggaaggaaaccaagaugacguaaggauagagauggcccggccacgacgcgucagacauuggauguauucaccugugauccugacuauucucgcaaucggccuggcugaagguugcgaugagaugguucacgccgacagcaaacuugugucuuguaggcagggguccggcaauaugaaggagugcaucacaaccggacgggcucuguugcccgccgucaacccaggccaggaagcaugucuccauuuuacugcccccgggaguccugauagcaagugccugaagauuaaagugaagcgcauaaauuuaaaauguaagaaaucuuccucauacuucguaccagacgcuagaaguaggugcacaagcgugcgucggugucgaugggcgggagauugccagucgggcugcccgccccacuuuaccuccaacucuuucagcgacgacugggcagguaagauggauagagccgggcugggauuuucaggcuguagugacgguugcggcggggcugccuguggaugcuucaaugcagccccuuccuguaucuuuuggaggaaguggguugagaacccacacggcauuaucuggaaagucucucccugcgcugccugggugccuagcgcagugauugaacuaacgaugccauccggggagguccgcaccuuccaucccaugucaggaaucccgacacaaguuuucaagggcgugagcgugacuuaucucgguagugauauggaaguaucugggcugaccgaccuuugugagauagaggaauugaaauccaagaaacuggcgcucgcuccuugcaaccaggccggaaugggcgucguggguaagguuggcgagauccaguguagcucggaagagucagcacggacaauuaaaaaggaugggugcaucuggaaugccgaccuggugggaauugaacuuagagucgaugacgcuguguguuacucuaagaucacuucuguugaggccguggcaaacuauuccgcuauaccaaccacaauuggcgggcugagguuugagcgcagccacgauucucagggaaaaaucagcggcucccccuuggacauuaccgccauccgagguucauucaguguaaaucuccgggggcugcguuuaagccugucugaaauaacugcgacgugcacaggagaggucaccaacguguccggcugcuacucauguaugacuggugccaaggugaguaucaaacuacauagcuccaagaauaguaccgcucacgucagaugcaaaggcgaugaaacagcauuuucgguucucgagggggugcacagcuacauuguaucacuguccuucgaccaugccguggucgaugaacaaugucagcuuaacugcggaggccacgagagucaggugaccuugaaggggaaucugaucuuucucgacguuccuaaguucguggacggaucuuauaugcagacuuaccauagcacaguccccacgggcgcuaacauuccauccccuaccgauuggcugaaugccuuauuugguaacgggcugucaagguggauccuuggagugauaggcguuuugcucggcgggcuggcacuauucuuucugauuauguuccuccugaaacuuggaacuaagcaaguguuucgcucucggacaaaauuggcguga

SEQ ID NO: 11635 - RNA, 3222 nt, Artificial Sequence
  derived and/or modified CDS sequence (opt3) from SFTSV/Phlebovirus(AH15/China/2010 strain AH15)__HQ141593.1__GP
augaugaaggugaucugguucuuuagccugauuugccucgucauacaguguggcggggacaccggacccaucauuugcgccgguccuauccacuccaacaaaucugcugauauuccacaucuucugggcuacucagagaagaucugucaaauagacagauugauccacguuaguagcugguuaaggaaucauucccaguuccagggguaugugggacagcggggcggucgcucucaaguaucguacuauccggcagaaaacucauacagccgauggagugggcugcuaucccccugcgaugccgacuggcucggaaugcugguggucaaaaaggcgaaaggcucugauaugauugugccuggcccaagcuauaaggggaagguuuucuucgagcgucccacauuugacggauacguggguuggggcuguggguccggaaaaucaagaacugaaaguggcgagcuuugcagcucugauuccgguacgucaagcgggcuguugccuagugacaggguccucuggaucggagauguggcuugucagccaaugacccccauuccugaagagacauuccuggagcugaagucuuuuucccagagcgaauuuccagacaucugcaaaauagauggcauuguauuuaaucagugugagggcgaaucgcucccgcaacccuucgacguugccuggaugggggugggacacucucauaagaucauuaugcgggagcacaaaacuaaguggguccaggaguccucaaguaaggauuuugugugcuauaaagaagguaccggcccuuguagcgaguccgaagagaagacaugcaaaaccucugggagcugccgcggagacaugcaguucuguaagguggcaggcugcgaacacggugaggaggccucagaagcuaaauguagaugcaguuuaguccauaagccaggggagguugugguauccuacggcggaaugagggugcggcccaaauguuacggcuuuagccgcaugauggcaacucuggaagucaacgagccugaacagcgaaucgggcaaugcacaggaugucaccuugagugcaucaaugguggcgugagauugauuacccugacgucugagcuaaagucagccacuguuugugcuagucauuucugcagcuccgccaccucugggaagaaaucgacagaaauacaguuccacagcggaucccucgugggcaagacugcgauccacgucaaaggugcacugguggacgggaccgaguuuacauucgaaggcucauguauguuuccagauggaugcgacgccguagauugcaccuucuguagggaguuucuuaagaacccccagugcuauccggcuaaaaaguggcuguucauuaucauaguuauuuugcucggcuacgccgggcugauguuacugacgaaugugcucaaggcaaucggagucugggguaguugggugaucgcuccugucaaacuuguguuugccauuaucaagaaacugaugcgggcgguuucuuguuugaugggcaagcuaauggaccgugggcgccaagugauucaugaagagauaggagagaacagagaaggcaaucaggaugacguaaggaucgagauggcccggccccgacgcgucagacacuggauguauagcccagugauucugacuauccucgcaaugggucuggcugaagggugcgaugagaugguucaugccgacuccaaacuugugucauguaggcagggcagcggaaacaugaaggagugcgucacaaccggccgggcucuguugccugccgugaaucccgggcaggaagcaugucuccacuucacugccccaggaucucccgauuccaagugccugaaaaucaagguaaaacgcauuaacuuaaaguguaaaaagaguagcucuuacuuugugccugacgcuagauccaggugcacaucaguucgucggugucgaugggcgggcgauugccaaagugguugcccaccgcauuucaccagcaauucguuuuccgacgacugggcagggaagauggauagagccggacugggcuucucugguuguagcgacggcugcgggggagcugccuguggcugcuuuaacgcagcccccucauguauauucuggaggaaaugggucgagaauccucacgggaucauuuggaaggugaguccaugcgcugccugggugcccuccgcagucaucgaacuaacgaugccuucuggagagguucgcaccuuccacccaaugagcggcauucccacacagguguuuaaagguguguccguaacuuaucucgggucagauauggaagucagcggacugaccgaccuuugugagaucgaggaauugaagaguaaaaagcuggcgcucgcuccgugcaaccaggccggcaugggugugguuggcaaagugggggagauacaguguucuuccgaagagagcgcacggacaaucaagaaggauggaugcauuuggaacgccgaccuggucggcaucgaacuuagaguggaugacgcuguuuguuacucgaaaauuacuucaguggaggccguagcaaauuauucugcuaucccuaccacaauagggggacugagguucgagcgcagucaugauucccaaggcaagauuagcgguucuccauuggacaucaccgccauucgagggagcuuuuccaucaacuaccggggacuccgucugucauuaacugaaauaacggcgacaugcaccggcgaggucacuaaugugagugguugcuacagcuguaugaccggcgccaaagugucuaucaagcugcacuccucaaagaacaguacagcucaugucagaugcaagggggaugaaaccgcauucagcguucuagagggagugcacuccuauucuguaucgcucagcuuugaccacgccguggucgaugaacagugucagcugaauugcggcgggcaugagucacaggugacucuuaggggaaacuugauuuuccuggacguucccaaguuuguggacggcuccuacaugcaaacauaucacaguacggucccuaccggugcuaauauccccucuccaacugauuggcucaacgcccuguucgggaauggauuaagccgcuggauucugggcgugaucggcguucuucucgggggauuggcacuguuuuuccuaauaaugucccuguuuaaacucgguacaaaacagguguuccggucaagaaccaaacuggcguga

SEQ ID NO: 11636 - RNA, 3222 nt, Artificial Sequence
  derived and/or modified CDS sequence (opt3) from SFTSV/Phlebovirus(HN6/China/2010 strain HN6)__HQ141596.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcgaugccguagacugcacauucuguagggaauuucugaagaacccccaaugcuauccggcuaaaaaguggcuuuucauuaucauaguuauucuguugggcuacgccggacucaugcuguuaaccaaugugcugaaggcaaucggcaucuggggguccugggucauugcuccugugaaacucaucuuugccauuauaaagaaacuuaugcggacggucucaugucuggugggaaaguugauggaucguggucgccagguuauccaugaggaaauuggcgagaacagagaggggaaucaggacgaugugaggaucgaaauggcgcggccccgacgcguaagacacuggauguauagcccagucauccuaacuauucuggccauaggacucgcagagucuugcgacgaaauggugcaugcugauuccaaacugguuaguuguaggcagggcagcgguaacaugaaggagugcgugacaaccgggcgggcccuucugccugcugucaaucccggccaagaggccuguuugcacuucacugcaccaggaucucccgacuccaagugccucaaaaucaaggugaaacgcauuaaccugaaguguaaaaagucaaguagcuacuuuguaccugaugccagaucgaggugcacauccgugcgucggugucgaugggcuggcgacugccagucugggugcccaccgcauuucaccagcaauucauuuagugacgauugggcgggaaagauggacagagcaggcuuagguuucuccggguguucugauggaugcggcggugccgcuuguggcugcuuuaacgccgcacccagcuguaucuucuggaggaaauggguugaaaauccucacgggauuaucuggaaggucuccccaugcgccgcuugggugcccucagccgugauagagcugacgaugccuagcggagaaaugcgcaccuuccacccaaugaguggcauccccacacaggucuuuaaagggguuucugugacuuaucuaggauccgacauggaggugagcggccucaccgaucugugugaaauugaggagcuuaagucgaaaaaguuggcacuggcgccgugcaaccaggcugguauggggguagucggaaaagugggcgaaauccaauguucaucugaggaaagugcccggacaauuaagaaggacgguugcaucuggaacgcagaucucguuggcauagagcugagaguggacgaugccgucuguuacuccaaaauuacuagcguggaagcuguugccaauuauucugcaaucccuaccacaauugggggacuuagguucgagcgcagccaugacucccagggcaagaucucagggaguccacuggauauaaccgcuauccgaggcagcuuuucugugaacuaccggggauugcgucucucccugucagagauuacugccacgugcacaggugaaguaaccaaugucagugggugcuacagcuguaugacuggagcgaccguguccaucaaauuacacucuucgaagaacagcacagcccaugugagaugcaaaggcgacgagaccgcuuucucaguccuggaagguguucacuccuauacugugagucuaucuuuugaucacgcaguaguggacgagcagugucagcucaauugcggcgggcaugaaagccaagucacacugaagggaaaccuuauuuucuuggacgugcccaaguuuguugauggcuccuacaugcagacguaucacucaaccgugccuacuggggccaauauccccucuccaacagacuggcugaacgcucucuucggaaauggccugaguagguggauauuaggugucauuggggugcugcuuggaggcuuggcccucuuuuucaugaucaugagccuguuuaaacuaggcaccaagcagguuuuccgcucccggacaaaacuggcauga

SEQ ID NO: 11637 - RNA, 3222 nt, Artificial Sequence
  derived and/or modified CDS sequence (opt3) from SFTSV/Phlebovirus(JN1/China/2010)__JN258706.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccaaauaucugcaaaauagauggaauuguauucaaccagugugaaggcgagucacucccgcaacccuuugacguugccuggauggaugugggccacagucauaagaucauuaugcgggagcacaaaacaaaguggguccaggaaagcuccucuaaggacuucgugugcuauaaagaggggacuggaccuuguagcgaaucagaggaaaaggcaugcaaaaccagugguuccugccgcggcgauaugcaguuuuguaagguggccgggugcgagcacggagaggaagcuagcgaggcaaaauguagaugcucuuuaguccauaagccaggcgaaguugugguaucauacggugggaugagggugcggcccaaauguuacggcuucagucgcaugauggccacacuggaggucaauccuccagaacagcgaaucggacaaugcaccggcugucaccuugagugcaucaacgggggagugagauugguuacucugacaagcgagcuaagguccgcuaccgugugugccucucauuuuugcucgagcgcgacguccgguaagaagucaacugaaauucacuuccacaguggcucucucgucgggaaaaccgcaauacaugugaagggagcccugguagacggcacagaguucacuuuugaagguagcuguauguuccccgacgggugcgaugcuguugacugcaccuuuugucgggaguuccuuaaaaauccgcagugcuauccugccaagaaauggcuguuuaucauuaucgugauauugcucggcuacgcaggacugauguuacugacaaacguccucaaggcuauuggcguguggggguccugggucaucgcccccgugaaacuuauguucgcgaucauuaagaagcugaugcguaccguuucauguuuggugggaaaacuaauggaucgcgguagacagguaauccacgaagagauuggcgagaauggggaaggaaaccaagacgaugucaggauagagauggcccggccacgacgcgugagacauuggauguauagcccuguuauccugacgauucucgcaaucggccuggcugaagguugcgacgagauggugcacgccgauucuaaacuugucuccuguaggcaggggaguggcaauaugaaggagugcaucacuacaggacgggcucuguugcccgccgugaacccaggccaggaagcaugucuccauuuuaccgcccccgggagcccugacucuaagugccugaagauuaaaguaaagcgcauaaauuuaaaauguaagaaauccucaaguuacuucgugccagaugcuagaucgaggugcacuucgguucgucggugucgaugggcgggagacugccaguccggcugcccgccccacuuuacaucuaacagcuucucagaugacugggcagguaagauggacagagccgggcugggauuuaguggcuguuccgaugguugcggcggggcugccuguggaugcuucaaugcagccccuucuuguaucuuuuggaggaagugggucgagaacccacacggcauuaucuggaaagugagccccugcgcugccugggugccuuccgcagucauugaacuaaccaugccaucaggggagguucgcacguuccaucccaugagcggaaucccgacccaaguguucaagggcgugaguguaacauaucucgguucugacauggaagucuccgggcugacugaucuuugugagauagaggaauugaaaagcaagaaacuggcgcucgcuccuugcaaccaggccggaaugggcgugguugguaaggugggcgagauccaguguucgucagaagagucugcacggaccauuaaaaaggacgggugcaucuggaaugccgaucuggucggaauugaacuuagaguggacgaugcuguuuguuacaguaagaucacauccguggaggccguagcaaacuauagcgcuauaccaacuaccauuggcgggcugagguuugagcgcucucacgacagccagggaaaaaucuccggcucacccuuggauauuacagccauccgagguaguuucagcgucaauuaccgggggcuccgucugucuuuauccgaaauaaccgcgacuugcacgggagaggugacaaacgugucaggcugcuacaguuguaugaccggugccaaggucagcaucaaacugcauuccucuaagaauagcacugcucacguuagaugcaaaggcgacgaaaccgcauuuagcgugcuaaaggggguacacucauauauugugucccucaguuucgaucaugccgucguggacgagcaaugucagcugaacugcggaggccacgaaucucagguuacacuuaaggggaauuugaucuuucuggaugugccuauuuucgucgacggaagcuacaugcagaccuaucauuccacugugcccacaggcgcuaacaucccaucaccuacggacuggcucaaugcccuguuugguaacggguuaucuagguggauacugggaguuauuggcgugcuuuugggcgggcucgcacuguucuuucuaaucauguuccugcucaaacugggaaccaagcaagucuuucgcagccggacuaaacuugcguga

SEQ ID NO: 11638 - RNA, 3222 nt, Artificial Sequence
  derived and/or modified CDS sequence (opt3) from SFTSV/Phlebovirus(JS2010-014)__JQ317170.1__GP
augaugaaggugaucugguucagcuaccugauuugcuuugucauacaguguuccggcgacucugggcccaucauuugggccggaccuauccacucaaacaaaagugcugauauuccacaucuccuugguuauagcgagaagaucugccaaauagacagacugauccacguuuccucuugguugaggaaucauucgcaguuccagggcuacguggggcagcggggaggccgcucacaaguaagcuauuacccggcagaaaacaguuauucccgauggucugguuuacugagccccugugaugccgacuggcuagggaugcucguggucaaaaaggcgaaaggauccgauaugauugugccuggcccaucauacaagggcaagguuuucuucgagcgucccaccuuugacggguaugugggaugggguugcggcagugggaaaagcagaacagaaucuggagagcuguguuccucagauagcggcacuagcucuggucuucugccuuccgacagggucuuguggaucggggauguggcuugccagccaaugacgcccauuccugaagagaccuuccucgagcugaagaguuuuucgcagucugaauuuccagacaucuguaaaauagauggaauuguauuuaaucagugcgagggcgaaucccugccgcaacccuucgacguugccuggauggaugugggccacucacauaagaucauuaugcgggagcacaaaacaaaguggguccaggagaguagcuccaaggacuuuguguguuacaaagaagggacuggaccuugcucugagagcgaagagaagaccuguaaaacaucagguaguugccgcggcgacaugcaguucugcaagguggcagggugugaacacggagaggaggccuccgaagcuaaaugcagauguagccucguccauaagccaggcgagguugugguaucuuacggugggaugaggauccggcccaaaugcuauggcuuuucacgcaugauggcaaccuuagaagugagucagccugagcaacgacugggacaguguacuggcugccaccuugaauguaucaacgggggagucagauugauuacacugaccagcgagcuaaaguccgccacggugugcgcuucucauuucuguucgagcgccacuuccgguaagaaaucaaccgagauacaguuccacaguggcucucucguugggaagacagcgauccacgugaaaggagcacuggucgauggcacugaauuuaccuucgaggguagcugcauguuuccagacgggugugaugccguggacugcacauucugcagggaauuucuuaagaauccccaauguuacccggcuaaaaaguggcuguucauuaucauaguaauuuugcucggcuaugccggacugauguuacugaccaacguucucaaggcaaucggcaucuggggguccugggugauugcuccugucaaacuuauguuugccaucauuaagaaacugaugcggacggugucaugcuugaugcguaagcuaauggaucgcggaagacaggucauacaugaggaaaucggugagaauagggugggcaaccaggacgauguucggauugagauggcgcgaccccgcagagugaggcacuggauguacagcccaguaauccugacuauccucgccauugggcuggcagaaucuugugacgagaugguccaugcugauuccaaacuugugaguugccggcagggaagcggcaauaugaaggaauguguuacaaccggucgcgcccuguugccugcugugaaccccgggcaagaggccugccuccacuucacugcaccaggcucucccgacuccaagugucugaaaauaaaggucaaaagaaucaauuuaaagugcaaaaagucaaguagcuauuuugugccugaugccaggucgcguuguacauccguacggcgaugcagaugggcuggagacugucagucuggcugcccaccgcauuucaccagcaacucauuuagugacgauugggcggggaagauggacagggcaggacugggcuucuccgguugcucugauggguguggaggcgccgcuugcgguuguuuuaaugccgcacccagcugcauuuucuggcgcaaauggguggagaacccucacggcaucauuuggaagguuuccccaugugccgcuuggguccccucagccgugaucgaacuaacgaugccuagcggggaggugcggaccuuccacccaaugaguggaauacccacacaggucuuuaaaggcguuucugugacuuaccucggguccgacauggaagugagcggacugaccgaucuuugcgagaucgaagaguugaagucgaaaaagcuggcacucgcgccguguaaucaggcuggcauggguguagucgggaaagugggagagauucaaugcucaucugaagagagugccagaacaaucaagaaggacggcuguauuuggaacgcagaucugguugguaucgaacuuaggguggacgaugccgucugcuauuccaaaauaacuagcguggaggcuguugccaacuacucugcaauuccuaccacaaucggcgggcugcgcuucgaacgaagccaugacucccagggaaagauuucaggcaguccauuggauaucaccgcuauacgggggagcuuuucugugaauuaccguggacucagacuguccuuaucagagaucacugccacguguacaggcgagguaaccaacgucagugguugcuauagcugcaugacuggggcgaaaguguccauuaagcugcacucuucgaaaaauagcaccgcccaugugagguguaagggagacgaaacagcuuucucaguccuagagggcguucacuccuacaccgugagucucucuuuugaucacgcaguaguggacgaacagugccagcugaacugugguggccaugagagccaagucacucuuaaggggaauuugaucuuccuggacgugcccaaauuuguugauggauccuauaugcagacauaccacucaacggugccuaccggcgccaacauucccucuccaacugacuggcucaaugcucuguucgggaacggauuaagccgcuggauccugggcgucauaggugugcuucucgggggauuggcccuguuuuucaugauuaugagucuauuuaagcugggcacaaaacagguuuuccgguccagaaccaagcucgcauga

SEQ ID NO: 11639 - RNA, 3222 nt, Artificial Sequence
  derived and/or modified CDS sequence (opt3) from SFTSV/Phlebovirus(JS2010-015)__JQ317173.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaaccagccugagcaacgaaucggacagugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuuccagacgggugcaacgccguagauugcacauucuguagggaauuucugaagaauccccaaugcuauccggcuaaaaaguggcuuuucauuaucauaguuauucuguugggcuacgccggacucaugcuguuaaccaacgugcugaaggcaaucggcaucuggggguccugggucauugcuccugugaaacucauguuugccaucauuaagaaacuuaugcggacggucucaugucugaugggaaaguugauggaccguggucgccaggugauacaugaggaaaucggcgagaauagagaggggaaccaggaugacguuaggauugaaauggcgcggccccgacgcgugagacacuggauguauagcccaguaauccuaacuuuccuggccaucggacucgcagagucuugcgaugaaaugguccaugcugacuccaaacuggugaguuguaggcagggcagcgguaauaugaaggagugcguuacaaccgggcgggcccuucugccugcugugaaccccggccaagaggccuguuugcacuuuacugcaccaggaucucccgauuccaagugccucaaaauuaaggucaaacgcauaaaucugaaguguaaaaagucaaguagcuacuucgugccugacgccagaucgaggugcacauccguacgucggugucgaugggcuggcgauugccagucugggugcccaccgcauuuuaccagcaacucauucagugacgacugggcgggaaagauggauagagcaggcuuagguuuuuccggguguucugacggaugcggcggugccgcuuguggcugcuucaaugccgcacccagcuguaucuucuggaggaaauggguggaaaacccucacgggauuaucuggaagguuuccccaugcgccgcuuggguccccucagccgugauugagcugacgaugccuagcggagaagugcgcaccuuucacccaaugaguggcauccccacacaggucuucaaagggguuucugugacuuaucuaggauccgauauggaggugagcggccucaccgaccugugugaaauagaggagcuuaagucgaaaaaguuggcacuggcgccgugcaaccaggcugguauggggguagucggaaaagugggcgaaauccaauguucaucugaggaaagugcccggacaauuaagaaggaugguugcaucuggaaugcagaccucguuggcauugagcugagaguggaugacgccgucuguuacuccaaaaucacuagcguggaagcuguugccaacuauucugcaauaccuaccacaauugggggacuuagguuugagcgcagccaugauucccagggcaagaucucagggaguccacuggacauuaccgcuauccgaggcagcuucucugugaauuaccggggauugcgucucucccugucagagauaacugccacgugcacaggugaaguaaccaacgucagugggugcuacagcuguaugacuggagcgaaaguguccaucaaguuacacucuucgaaaaauagcaccgcccaugugagaugcaagggcgaugagacagcuuuuucaguccuggaagguguucacuccuauaccgugagucuaucuuucgaccacgcaguaguggaugagcagugucagcucaacugcggcgggcaugaaagccaagucacucugaagggaaaucuuaucuuuuuggacgugcccaaauucguugacggcuccuacaugcagacauaucacucaacggugccuaccggggccaacauucccucuccaacugauuggcugaaugcucucuuuggaaacggccugaguagguggauuuuaggugucaucggggugcugcuuggaggcuuggcccucuucuuuaugauaaugagccuguucaagcuaggcacaaaacagguuuuucgcucccggaccaagcuggcauga

SEQ ID NO: 11640 - RNA, 3222 nt, Artificial Sequence
  derived and/or modified CDS sequence (opt3) from SFTSV/Phlebovirus(JS2010-019)__JQ317179.1__GP
augaugaaggugaucugguucagcucccugaccugcuuugucauucaguguucuggcgacucagggcccauaaucugcgccggaccuauucacaguaacaaaagcgcugauaucccacaucuccuugguuacuccgagaagauuugucaaaucgacagacugauacacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugaucgugccuggcccaaguuauaagggcaagguuuucuucgagcgucccacauuugacggguacgugggaugggguuguggcagcgggaaaucuagaacugaauccggagagcugugcucaagcgauaguggcacgucuuccggucuucugccuagcgacagggucuuguggauuggggauguggcuugucagccaaugacccccaucccugaagagacauuccucgagcugaagucguuuucucaguccgaauuuccagacauuugcaaaaucgauggaauaguauuuaaucagugugagggcgaaucacugccgcaacccuucgacguugccuggauggaugugggccacagucauaagauuaucaugcgggagcacaaaacuaaguggguccaggagagcuccucuaaggacuuugugugcuauaaagaagggaccggaccuuguagcgagucagaagagaagacaugcaaaaccagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaacuuuagaagucaaccagccugagcaacgacugggacagugcacaggcugucaccuugaaugcauuaaugggggagugagauugaucacccugacgagcgagcuaaaguccgccacuguuugugcuucucauuucugcucgagcgccaccuccgguaagaaaucaacagagauccaguuccacaguggcucucucguggggaagacugcgauucacgucaaaggagcacugguggauggcaccgaauuuacauucgaggguagcuguauguuuccagacgggugcgaugccguagacugcaccuucuguagggaauuucuuaagaacccccaaugcuauccggcuaaaaaguggcuguucauaaucauuguuaucuugcucggcuacgccggacugauguuacugacgaaugugcucaaggcaauaggcauuuggggguccugggucaucgcuccugugaaacuuauguuugccaucauuaagaaacugaugcggacugucucauguuugaugcguaagcuaauggaucgcggaagacaggugauccaugaggaaauuggugagaacagggagggcaaucaggacgauguucggauagaaauggcgcgaccccgcagagugaggcacuggauguauagcccaguaauccugacaauucucgccaucgggcuggcagagucuugcgacgaaaugguccaugcugauuccaaacuugugaguugucggcagggaagcggcaacaugaaggagugcguuaccacuggucgcgcccuguugucugcugugaauccugggcaagaggccugucuccacuucacagcacccggcuccccagacucaaagugccugaaaaucaaggucaaaagaauuaacuuaaaguguaaaaagaguagcucguacuuugugcccgaugccaggucccguugcaccucuguacggcgauguagaugggcuggagacugccagagcggcugcccuccacauuucacgucaaauaguuuuuccgacgauugggcggggaagauggacagggcaggacugggcuucucugguuguagcgaugggugcggaggcgccgcuugugguugcuuuaacgccgcaccguccuguauauucuggcgcaaauggguggaaaauccccacggcaucauuuggaagguuucaccuugcgccgcuugggucccaagcgccgugaucgagcuaaccaugcccaguggggaagugcggacauuccacccuaugucuggcauuccaacucaggucuuuaaaggaguuuccgugaccuaucucgggagcgacauggaggugucgggacugacagaucuuugugaaaucgaggaguugaagucuaaaaagcuggcacucgcgcccugcaaccaggcuggcauggguguagucgggaaagugggagaaauacaauguucaagugaggaauccgccagaacuaucaagaaggacggcugcauuuggaacgcagaucugguugguaucgagcuuaggguggacgaugccgucuguuacagcaaaauuaccucuguggaagcuguugccaauuauagcgcaaucccgacaaccauaggcgggcugcgcuucgagcgaucccaugacucacagggaaagauuaguggcagcccuuuggauaucacugcuauucgggggucuuuuuccgugaacuaccguggacucagacugucauuaagugagaucacggccacaugcaccggcgaaguaacuaaugucagcgguugcuacuccuguaugaccggggcgaaagugucuauaaagcugcacucgagcaaaaacucaacagcccaugugaggugcaagggagacgagaccgcuuucuccguccuagaaggcggucacaguuauacuguuucucucagcuuugaucacgcagugguagacgagcagugucagcugaauugcggcgggcaugaaucccaagugacacuuaagggaaacuugaucuuccuggacgucccaaaauuuguggauggcucauacaugcagacguaucacucuaccguucccacuggggccaauauuccuagccccacagacuggcucaacgcucuguucggaaauggcuuaagucgcuggauccugggugugauugggguccuuuugggaggccucgcccuguuuuucaugaucaugucccuauuuaagcugggcaccaaacagguguuccggagcagaacaaagcucgcauga

SEQ ID NO: 11641 - RNA, 3222 nt, Artificial Sequence
  derived and/or modified CDS sequence (opt3) from SFTSV/Phlebovirus(JS24)__HQ830164.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuuguucuuccgauucagguacgagcagugggcuguugccuucugacaggguccucuggaucggagauguggcuugccagccaaugacccccauuccugaagagacauuucuggagcugaaguccuucagccagucggaauuuccagacaucugcaaaauagauggcauuguauucaaucaguguggcggggagucucucccgcaacccuuugacguugccuggauggaugugggacacucccauaagaucauuaugcgggaacacaaaacuaaguggguccaggagucaaguagcaaggacuucgugugcuauaaagaggguaccggcccuuguuccgaaucugaggaaaagacaugcaaaaccagcgggucaugccgcggagacaugcaguuuuguaagguggcaggcugcgagcacggugaagaggccagugaggcuaaauguagaugcuccuuaguccauaagccaggggaaguugugguaagcuacggcggaaugagggugcggcccaaauguuacggcuucucucgcaugauggcaacucuggaggucaaccagccugaacaacgaaucgggcagugcacaggaugucaccuugagugcaucaaugguggcgugagauugauuacccugacgucagaacuaaagagugccacuguuugugcuagccauuuuugcuccucugccaccucggggaagaaaagcacagagauacaguuccacuccggaucacucgugggcaagacugcgauccacgucaaaggugcacugguggaugggaccgaguucacauuugaaggcaguuguauguucccagacggaugcgaugccguagacugcaccuuuuguagggaguuccuuaagaacccccaaugcuauccggcuaaaaaguggcuguuuauuaucauaguuauuuugcucggcuacgccgggcugauguuacugacgaaugugcucaaggcaaucggagucugggguucuugggugaucgcuccugucaaacuuguguucgccauuaucaagaaacugaugcgggcgguuagcuguuugaugggcaagcuaauggaucgugggcgccaggugauucaugaagagauaggagaaaacagagagggcaaucaggacgauguaaggaucgagauggcccggccccgacgcgucagacacuggauguauuccccagugauucugacuauccucgcaaucggucuggcugaagggugcgacgagaugguucaugccgauucaaaacuugugagcuguaggcagggcucuggaaacaugaaggaaugcgucacaaccggccgggcucuguugccugccgugaaucccgggcaagaggcaugucuccacuuuacugccccaggaucccccgacaguaagugccugaaaauuaaggugaaaaagauaaacuuaaaauguaagaagucgucuuccuacuucguaccugaugcucgcucaagaugcacaaguguuaggcguugucggugggcgggcgacugccagagcgguugcccaccgcauuuuaccagcaauuccuucucugacgauugggcagggaaaauggaccgagccggacugggcuuuagcgguuguucagauggcugcgggggagcugccuguggcugcuucaacgcagcccccaguuguaucuuuuggagaaagugggucgagaauccucacgggauuaucuggaaaguguccccaugcgcugccugggugcccucugcagucauugaacuaacgaugccuagcggagagguuaggaccuuccacccaauguccggcauccccacacagguguucaagggugugucaguaacuuaucucgggagcgacauggaagucaguggacugaccgaucuuugugagauagaagaguugaaaucuaagaaacuggcgcucgcuccgugcaaccaggccggcaugggugugguuggcaaggugggggagauccaauguuccagcgaagagucggcacgcacaauuaagaaagacggaugcaucuggaacgccgaucuggucggcauugaacuucggguggacgaugcuguuuguuacucaaagaucacuucuguggaggccguagcaaauuauagugcuauaccuaccacaauugggggacugagauuugaaaggucccaugacagccagggcaaaaucucugguagcccauuggauauuaccgccauccgcggguccuucucagucaacuaccgaggacuccggcugaguuuaagcgagauaacugcgacgugcacaggcgaggugaccaaugugucugguugcuacuccuguaugacuggcgccaaggucucaaucaaacugcacaguagcaagaacuccaccgcucauguucguugcaagggggacgaaacagcauuuucugugcuagagggaguacacucguauagcgugucacucuccuucgaucacgccgucguggacgaacagugucagcugaauugcggcgggcaugagagucacguuacccuuaaaggaaacuugauuuuucuggacgugcccaaguucgucgauggcucuuacaugcaaacuuaucauagcacagugccuacgggugcuaauauccccuccccaaccgacuggcucaacgcccuguuugggaauggauuaucaagauggauucugggcguuaucggcgugcuucucgggggauuggcacuguucuuucuaauaaugucucuguucaaacucgguacuaagcaggucuuuaggagccgcacaaaacuggcguga

SEQ ID NO: 11642 - RNA, 3222 nt, Artificial Sequence
  derived and/or modified CDS sequence (opt3) from SFTSV/Phlebovirus(JS4/China/2010 strain JS4)__HQ141605.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaacccuccagagcagcgaaucggacaaugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuucccgacgggugcgaugccguagacugcacauucuguagggaauuucugaagaacccgcagugcuauccugcuaaaaaguggcuuuucauuaucauaguuauucuguugggcuacgccggacucaugcuguuaaccaaugugcugaaggcaaucggcgucuggggguccugggugaucgcucccgucaaacuccuuuuugccauuaucaagaaacugaugcggacggugucauguuugaugggaaagcuaauggaucguggucgccaaguuauucaugaggaaauaggcgagaacagagaggggaaucaggacgaugugaggaucgaaauggcgcggccacgacgcguaagacacuggauguauagcccugucauucugacuauccucgccaucggacuggcagagggcugcgacgaaauggugcaugcugauucuaaacuuguuuccuguaggcaggguagugagaacaugaaggagugcgugacaaccgggcgggcccuguugcccgcugucaauccaggccaggaagccugucuccacuucacugcacccggaagcccugacucuaagugccugaaaauuaaggugaaacgcauaaacuuaaaguguaaaaaguccucaaguuacuuuguaccagaugccagaucgaggugcacaagcgugcgucggugucgaugggcuggcgacugccaauccgggugcccgccccauuucaccucuaauagcuuuucagacgauugggcgggaaagauggacagagcaggccuggguuucaguggguguuccgauggaugcggcggugccgcuuguggcugcuuuaacgccgcaccuucuuguaucuucuggaggaaauggguugagaauccacacgggauuaucuggaaggucagccccugcgccgcuugggugccuuccgccgugauugaacuaacgaugccaucaggagagguccgcaccuuccaccccaugagcggcaucccgacacagguuuuuaaaggggugagugugacuuaucucggaucugacauggaaguauccggccugaccgaucuuugugagauagaggaauugaaaagcaagaagcuggcacucgcgccuugcaaccaggcugguaugggggucgugggaaaaguuggcgagauccaguguucgucagaagagucugcccggacaauuaagaaggacgguugcaucuggaacgcagaucuggugggcauugaacuuagagucgacgaugccguguguuacaguaaaaucacuuccguugaggcuguggccaauuauagcgcaauaccaaccacaauugggggacugagguucgagcgcucucaugacagccaaggcaagaucuccgggucacccuuggauauuaccgcuauccgaggaaguuuuagcguaaacuaccggggccuccgucugucuuuauccgaaauaacugccacgugcacaggugaggucaccaaugugucagggugcuacaguuguaugacuggagcgaaagugagcaucaagcugcacuccucuaaaaacucgaccgcccaugucagaugcaagggcgacgaaacagcuuucagcguucuagagggugugcacucauauaccguaucccucaguuuugaucacgcaguggucgacgaacagugucagcugaauugcggcgggcaugagucucaggugacucuuaagggaaacuugauuuuccuggacguuccuaaauuuguggauggcagcuacaugcaaacauaucacuccacgguccccaccggggccaauaucccaucaccuacugacuggcucaacgcucuguucggaaauggcuuaucuagguggauucugggugugaucgggguucuuuugggaggccucgcccuguuuuuccuaauaaugagccuguuuaagcucggcacaaaacagguguuccgcagucggaccaagcuggcauga

SEQ ID NO: 11643 - RNA, 3222 nt, Artificial Sequence
  derived and/or modified CDS sequence (opt3) from SFTSV/Phlebovirus(JS6)__HQ830170.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuuguucuuccgauucagguacgagcagugggcuguugccuucugacaggguccucuggaucggagauguggcuugccagccaaugacccccauuccugaagagacauuucuggagcugaaguccuucagccagucggaauuuccagacaucugcaaaauagauggcauuguauucaaucagugugagggcgaaucucucccgcaacccuuugacguugccuggauggauguggggcacucccauaagaucauuaugcgggagcacaaaacuaaguggguccaggagucaaguagcaaggacuucgugugcuauaaagaaggaaccgguccuuguuccgagucugaagagaagacaugcaaaaccagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacucuggaagucaacgagccugaacagcgaaucggccaaugcacagggugucagcuugagugcaucaauggaggugugagauugauuacccugacgucagagcuaaagagugccacuguuugugcuagccacuuuugcuccucugccaccucgggcaagaaaagcacagaaauacaguuccauuccgggucacucgugggaaagacugcgauccacgucaaaggcgcacugguggaugguaccgaguucacauuugaagggaguuguauguucccagacggcugcgaugccguagacugcaccuuuuguagggaguuccuuaagaacccccaaugcuauccggcuaaaaaguggcuguuuauuaucauaguuauuuugcucggauacgccggccugauguuacugacgaaugugcucaaggcaaucggggucuggggaucuugggugaucgcuccugucaaacuuguguucgccauuaucaagaaacugaugcgggcgguuagcuguuugauggguaagcuaauggaucguggccgccaggugauucacgaagagauaggggagaacagagaaggaaaucaggacgauguaaggaucgagauggcccggccccgacgcgucagacauuggauguauuccccagugauucugacuauccucgcaaugggccuggcugaagguugcgacgagaugguucacgccgauucaaaacuugugagcuguaggcaggggucuggcaacaugaaggagugcgucacaaccggacgggcucuguugccugccgugaaucccggccaagaagcaugucuccauuuuacugccccagggucccccgacaguaagugccugaaaaucaagguaaaacgcauuaacuuaaaguguaaaaagucgucuuccuacuucgugccugaugcuagaucaaggugcacaaguguucgucggugucgaugggcgggagacugccagagcggcugcccaccgcacuuuaccagcaauuccuucucugacgauugggcagguaagauggacagagccgggcugggauuuagcggcuguucagaugguugcggcggggcugccuguggaugcuucaacgcagcccccaguuguauauuuuggaggaaaugggucgagaauccucauggcaucauuuggaagguguccccaugcgcugccugggugcccucugcagucaucgaacuaacgaugccuagcggggagguucgcaccuuccacccaauguccggcauucccacacagguguucaaaggagugucaguaacuuaucucgguagcgacauggaagucagugggcugaccgaucuuugugagaucgaggaauugaagucuaaaaagcuggcgcucgcuccgugcaaccaggccggaaugggcgugguugguaaagugggcgagauacaauguuccagcgaagagucggcacggacaaucaagaaggacgggugcauuuggaacgccgaucuggucggaaucgaacuuagaguggacgaugcuguuuguuacucaaaaauuacuucuguggaggccguagcaaauuauagugcuaucccuaccacaauaggcgggcugagguuugagcgcucccacgacagccagggaaagauuucuggcagcccauuggauaucaccgccauucgagguuccuucucaaucaacuaccgggggcuccgucugaguuuaagcgaaauaacugcgacgugcacaggagaggucaccaaugugucuggcugcuacuccuguaugacuggugccaaagugucaaucaagcugcauaguagcaaaaacuccaccgcucacgucagaugcaagggcgacgaaacagcauuuucuguucuagagggggugcauucguauagcguaucacucuccuucgaucacgccguggucgacgaacagugucagcugaauugcggaggccacgagagucaagugacccuuagggggaacuugauuuuucuggacguucccaaguucguggauggaucuuacaugcagacuuaucauagcacagucccuacgggcgcuaauauccccuccccaaccgacuggcucaacgcccuguuugguaauggguuaucacgcuggauucugggagugaucggcguucuuuugggcgggcucgcacuguucuuucuaauaaugucucuguucaaacucggaacuaaacagguguuucggagcagaacaaagcuggcguga

SEQ ID NO: 11644 - RNA, 3222 nt, Artificial Sequence
  derived and/or modified CDS sequence (opt3) from SFTSV/Phlebovirus(JSD1)__JF267784.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacucccacucucgauggagcgguuuacugucccccugcgaugccgacuggcuagggaugcucguggucaaaaaggcgaaaggaucagauaugauugugccuggcccaaguuacaagggcaagguuuucuucgagcgucccaccuuugacggguaugugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccauagucacaagaucauuaugcgggagcacaaaacaaaguggguccaggagagcuccucuaaggacuuugugugcuacaaagaagggacuggaccuuguagcgagucagaagagaagaccugcaaaacaagugguuccugccgcggcgacaugcaguucuguaagguggcagggugcgaacauggagaggaggccagcgaagcuaaauguagaugcucucucguccacaagccaggcgagguugugguaucauauggugggaugagggugcggcccaaauguuacggcuuuagucgcaugauggcaaccuuagaagucaaccagccugagcaacgaaucggacagugcacuggcugucaucuggaaugcaucaaugggggagugagacuuauuacauugaccagcgagcugaaguccgccacgguuugugcuucucacuucugcucgagcgccacuuccgguaagaaaucaaccgagauacaguuccacaguggcucucuaguggggaagacagcgauccaugucaaaggagcacucguggauggcacugaauuuaccuucgaggguagcuguauguuuccagacgggugcaacgccguagauugcacauucuguagggaauuucugaagaauccccaaugcuacccggcuaaaaaguggcuuuucauuaucauaguuauucuguugggcuaugccggacucaugcuguuaaccaacgugcugaaggcaaucggcaucuggggguccugggucauugcuccugugaaacucauguuugccaucauuaagaaacuuaugcggacggucucaugucugaugggaaaguugauggaccguggucgccaggugauacacgaggaaaucggcgagaauagagaggggaaccaggaugacguuaggauugaaauggcgcggccccgacgcgugagacauuggauguacagcccaguaauccuaacuuuccuggccaucggacucgcagagucuugcgaugaaaugguccacgcugacuccaaacuggugaguuguaggcagggcagcgguaauaugaaggagugcguuacaaccgggcgggcccuucugccugcugugaaccccggccaagaggccuguuugcauuuuacugcaccaggaucucccgauuccaagugccucaaaauuaaggucaaacgcauaaaucugaaguguaaaaagucaaguagcuauuucgugccugacgccagaucgaggugcacauccguacgucggugucgaugggcuggcgauugccagucugggugcccaccgcacuuuaccagcaacucauucagugacgacugggcgggaaagauggauagagcaggcuuagguuuuuccggguguucugacggaugcggcggugccgcuuguggcugcuucaaugccgcacccagcuguaucuucuggaggaaauggguggaaaacccucacgggauuaucuggaagguuuccccaugcgccgcuuggguccccucagccgugauugagcugacgaugccuagcggagaagugcgcaccuuucauccaaugaguggcauccccacacaggucuucaaagggguuucugugacuuaccuaggauccgauauggaggugagcggccucaccgaccugugugaaauagaggagcuuaagucgaaaaaguuggcacuggcgccgugcaaccaggcugguauggggguagucggaaaagugggcgaaauccaauguucaucugaggaaagugcccggacaauuaagaaggaugguugcaucuggaaugcagaccucguuggcauugagcugagaguggaugacgccgucuguuauuccaaaaucacuagcguggaagcuguugccaacuacucugcaauaccuaccacaauugggggacuuagguuugagcgcagccacgauucccagggcaagaucucagggaguccacuggacauuaccgcuauccgaggcagcuucucugugaauuaucggggauugcgucucucccugucagagauaacugccacgugcacaggugaaguaaccaacgucagugggugcuacagcuguaugacuggagcgaaaguguccaucaaguuacauucuucgaaaaauagcaccgcccacgugagaugcaagggcgaugagacagcuuuuucaguccuggaagguguucacuccuacaccgugagucuaucuuucgaccaugcaguaguggaugagcagugucagcucaacugcggcgggcacgaaagccaagucacucugaagggaaaucuuaucuuuuuggacgugcccaaauucguugacggcuccuauaugcagacauaccauucaacggugccuaccggggccaacauucccucuccaacugauuggcugaaugcucucuuuggaaacggccugaguagguggauuuuaggugucaucggggugcugcuuggaggcuuggcccucuucuuuaugauaaugagccuguucaagcuaggcacaaaacagguuuuucgcucccggaccaagcuggcauga

SEQ ID NO: 11645 - RNA, 3222 nt, Artificial Sequence
  derived and/or modified CDS sequence (opt3) from SFTSV/Phlebovirus(LN2/China/2010 strain LN2)__HQ141608.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugccggauagauggaauuguauuuaaucagugugagggcgaaucacugccgcaacccuucgacguugccuggauggaugugggccacagucauaaaaucauuaugcgcgagcacaagacaaaauggguccaggagagcuccucuaaggacuuugugugcuauaaggaagggacuggaccuuguagcgagucagaagagaaaaccugcaagacaagugguuccugcagaggcgacaugcaguucuguaaaguggcagggugcgaacacggagaggaggccagcgaagcuaaguguaggugcucucucguccauaaaccaggcgagguugugguaucauacggugggaugcgggugcgccccaaguguuacggcuuuagucgaaugauggcaaccuuagaagucaaccagccugugcaaagaaucggacagugcacuggcugucaccuggagugcaucaaugggggaguuaggcuuauuacauugaccagcgaacugaaauccgccacggugugugcuucucauuucugcucgagcgccacuuccgguaagaagucaaccgagauacaguuccacaguggcucucuagucgggaaaacagcgauccacgugaagggagcacucguagauggcacugaguuuaccuucgaagguagcuguauguuuccagacgggugcgaugccguugacugcacauucugucgggaguuucugaaaaacccccaaugcuauccggcuaagaaauggcuuuucauuaucauagugauucuguugggcuacgccggacucaugcuguuaaccaauguccugaaggcaaucggcaucuggggguccugggugauugcuccugucaagcucaucuuugccauuauaaagaaacuuaugcguacggugucaugucugaugggaaaauugauggaucgcgguagacagguuauccaugaagagauuggcgaaaacagggaggggaaucaggacgaugugcggaucgagauggcgcgaccccgcagaguaaggcacuggauguaugccccagucauccuaacuauucuggcaaugggacucgcugaaagcugcgacgagauggugcaugccgauucuaagcugguuuccugucggcagggcagugguaacaugaaagaaugcgugacaaccgggcgcgcccuucugccugcugucaaucccggccaagaggcauguuugcacuucacugccccaggaagccccgacucuaagugccucaagauaaaagugaagagaaucaaccugaaauguaagaaauccucaaguuacuuuguaccugaugcuaggagccguugcacaucggugcggcgauguagaugggcgggcgacugccaguccgggugcccaccgcauuucaccucuaauagcuuuucagacgauugggcaggaaagauggacagggccggcuuagguuucaguggguguuccgauggaugcggcggugcugccuguggcugcuuuaacgcagcccccucuuguauuuucuggcgcaaguggguugagaauccucacgggaucauuuggaaagucagcccaugcgcugccugggugcccuccgcagugaucgaacugacgaugccuucaggagagguccggaccuuccacccaaugagcggcauacccacacagguuuuuaagggggugagugugacuuaucuaggaucugacauggaaguauccggccucaccgaucugugugagaucgaggaacuuaaaagcaagaaauuggcgcuggcuccgugcaaccaggccgguaugggggucgugggaaagguuggcgagauucaauguucgucagaagagucugcaagaacaaucaaaaaggacgguugcauuuggaacgccgaucucgugggcaucgaacugagggucgacgaugcuguguguuacaguaagauaacuuccguugaggccguggcaaauuauagcgcuauuccuaccacaaucgggggacuucgcuucgaacgaucucaugacagccagggcaaaauuuccgggucaccacuggauaucaccgccauacggggaaguuuuagcguaaacuaccguggcuugagacucucucuguccgagaucacugcgacgugcacaggugaggucaccaaugugucagggugcuacaguuguaugacuggagccaaggugagcauuaaauuacacuccucuaagaacucgaccgcucaugucaggugcaaaggcgacgaaacagcauucagcguucuggagggugugcacucauauaccguaucccuaaguuuugaucacgccguggucgacgaacagugucagcucaauugcggcgggcaugagucucaagugacucugaagggaaaccuuaucuucuuggacguucccaaguuuguggauggcagcuacaugcagacauaucacuccacggucccuaccggggcuaauauucccucaccaacugacuggcugaacgcccucuucggaaauggccugucucgcuggaucuuaggugugauagggguucugcuuggaggcuuggcacucuuuuucaugauuaugagccuguuuaaacuaggcacaaaacagguguuccggaguagaaccaagcuggcguga

SEQ ID NO: 11646 - RNA, 3222 nt, Artificial Sequence
  derived and/or modified CDS sequence (opt3) from SFTSV/Phlebovirus(LN3/China/2010 strain LN3)__HQ141611.1__GP
augaugaaggugaucugguucagcucccugauuugccucgucauacaguguggcggggacaccggacccaucauuugcgccgguccuauccacucuaacaaaucagcugauauuccacaucuucugggcuacagugagaagaucugucaaauagacagauugauccacguuagcuccugguuaaggaaucauucucaguuucagggguaugugggacagcggggcggucgcucgcaaguaucauacuauccggcagaaaacagcuacagucgaugguccgggcugcuaucucccugcgaugccgacuggcucggaaugcugguggucaaaaaggcgaaaggcagcgauaugauugugccuggcccauccuauaaggggaagguuuucuuugagcgucccacauucgacggauacguggguuggggcugugggucaggaaaaaguagaacugaaagcggcgagcuuuguucuuccgauucagguacgagcagugggcuguugccuucugacaggguccucuggaucggagauguggcuugccagccaaugacccccauuccugaagagacauuucuggagcugaaguccuucagccagucggaauuuccagacaucugcaaaauagauggcauuguauucaaucagugugagggcgaaucucucccgcaacccuuugacguugccuggauggauguggggcacucccauaagaucauuaugcgggagcacaaaacuaaguggguccaggagucaaguagcaaggacuucgugugcuauaaagaaggaaccgguccuuguuccgagucugaagagaagacaugcaaaaccagcggcucaugccgcggggacaugcaguuuuguaagguggcaggaugcgaacacggcgaggaggccagugaagcuaaauguagaugcuccuuaguccauaagccaggugagguugugguaagcuacgggggcaugagggugcggcccaaauguuacggauucucucgcaugauggcaacucuggaagucaaccagccugagcaacgaaucggccagugcacagggugucaccuugaaugcaucaauggaggugugagauugauuacccugacgucagagcuaaagagugccacuguuugugcuagccauuuuugcuccucugccaccucgggcaagaaaagcacagagauacaguuccacuccgggucacucgugggaaagacugcgauccacgucaaaggcgcacugguggaugguaccgaguucacauuugaagggaguuguauguucccagacggcugcgaugccguagacugcaccuuuuguagggaguuccuuaagaacccccaaugcuauccggcuaaaaaguggcuguuuauuaucauaguuauuuugcucggauacgccggccugauguuacugacgaaugugcucaaggcaaucggggucuggggaucuugggugaucgcuccugucaaacuuguguucgccauuaucaagaaacugaugcgggcgguuagcuguuugauggguaagcuaauggaucguggccgccaggugauucaugaagaaauaggggagaacagagagggaaaucaggacgauguaaggaucgaaauggcccggccccgacgcgucagacacuggauguauuccccagugauucugacuauccucgcaaucggccuggcugaggguugcgacgaaaugguucaugccgauucaaggcuugugagcugucggcaggggucuggcaacaugaaagagugcgucacaaccggacgcgcucuguugccugccgugaaucccggccaagaggcaugucuccacuuuacugccccagggucccccgacaguaagugccugaagauuaaaguaaagagaauaaacuuaaaauguaagaaaucgucuuccuacuucgugccugaugcuaggucacguugcacaaguguucggcgauguagaugggcgggagacugccagagcggcugcccaccgcauuuuaccagcaauuccuucucugacgauugggcagguaagauggacagggccgggcugggauuuagcggcuguucagaugguugcggcggggcugccuguggaugcuucaacgcagcccccaguuguaucuuuuggcgcaagugggucgaaaauccucacggcauuaucuggaaaguguccccaugcgcugccugggugcccucugcagucauugagcuaacgaugccuagcggggaaguucggaccuuccacccaauguccggaauccccacacagguguucaagggcgugucaguaacuuaucucgguagcgacauggaggucagugggcugaccgaucuuugugaaauagaggaguugaaaucuaagaaacuggcgcucgcuccgugcaaccaggccggaaugggcgugguugguaaggugggcgaaauccaauguuccagcgaggaaucggcaagaacaauuaaaaaggacgggugcaucuggaacgccgaucuggucggaauugagcuuaggguggacgaugcuguuuguuacucaaagaucacuucuguggaagccguagcaaauuauagugcuauaccuaccacaauuggcgggcugcgcuuugagcgaucccaugacagccagggaaaaaucucuggcagcccauuggauauuaccgccauccgggguuccuucucagucaacuaccgugggcucagacugaguuuaagcgagauaacugcgacgugcacaggagaagugaccaaugugucuggcugcuacuccuguaugacuggugccaaggucucaaucaaacugcacaguagcaagaacuccaccgcucauguuaggugcaaaggcgacgagacagcauuuucugugcuagaagggguacacucguauagcgugucacucuccuucgaucacgccgucguggacgagcagugucagcugaauugcggaggccaugaaagucacguuacccuucgcgggaacuugauuuuucuggacgugcccaaguucgucgauggaucuuacaugcaaacuuaucauagcacagugccuacgggcgcuaauauccccuccccaaccgacuggcucaacgcccuguuugguaauggguuaucacgguggauucugggaguuaucggcgugcuuuugggcgggcucgcacuguucuuucuaauaaugucucuguucaagcucggaacuaaacaggucuuuagaagcaggacaaagcuggcguga

SEQ ID NO: 11647 - RNA, 3222 nt, Artificial Sequence
  derived and/or modified CDS sequence (opt3) from SFTSV/Phlebovirus(SD24/China/2010 strain SD24)__HM802201.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauaucgccuggauggacguuggccacagucauaagauuaucaugcgggagcacaaaacaaagugggugcaggaaagcuccucuaaggauuucgucugcuauaaagaggggacuggaccuuguagcgaaucagaggaaaaggcaugcaaaaccagugguuccugccgcggcgacaugcaguuuuguaagguggccgggugcgagcacggagaggaagcuagcgaggcaaaauguagaugcucuuuagugcauaagccaggcgaagucguugugucauacggugggaugaggguacggcccaaauguuacggcuucagucgcaugauggccacacuggaggugaacccuccagaacagcgaaucggacaaugcaccggcugucaccuugagugcauuaaugggggagucagauugauaacucugacaagcgagcuaagguccgcuaccgugugugccucucauuuuugcucgagcgcgacguccgguaagaagucaacugaaauccacuuccacaguggcucucucguugggaaaaccgcaauucaugugaagggagcccuggucgacggcacagaguucacuuuugaagguagcuguauguuccccgaugggugcgacgcuguggauugcaccuuuugucgggaguuccuuaaaaacccgcagugcuauccugccaagaaauggcuguuuaucauaauuguaaucuugcucggcuacgcaggacugauguuacugacaaauguucucaaggcuaucggcguguggggguccugggucauugcccccgugaaacuuauguucgcgaucauuaagaagcugaugcguaccgucucauguuuggugggaaaacuaauggaccgcgguagacagguuauacacgaagagaucggcgagaacggggaaggaaaucaagaugacgugaggauugagauggcccggccacgacgcguaagacauuggauguauagcccugucauccugacgauccucgcaauuggccuggcugaagguugcgaugagauggugcacgccgacucuaaacuuguuuccuguaggcaggggaguggcaacaugaaggagugcauaacuacaggacgggcucuguugcccgccgugaauccaggccaggaagcaugucuccauuuuaccgcccccgggagcccugauucuaagugccugaagaucaaagucaagcgcauuaacuuaaaauguaagaaauccucaaguuacuucgugccagacgcuagaucgaggugcacuagcguacgucggugucgaugggcgggagauugccaguccggcugcccgccccacuuuacaucuaauagcuucucagacgacugggcagguaagauggauagagccgggcugggauuuaguggcuguuccgacgguugcggcggggcugccuguggaugcuucaacgcagccccuucuuguaucuuuuggaggaaguggguggagaauccacacggcauuaucuggaaaguuagccccugcgcugccugggucccuuccgcagugauagaacuaaccaugccaucaggggaggugcgcacguuccaucccaugagcggaaucccgacccaagucuucaagggcguuagugugacauaucucgguucugauauggaaguguccgggcugacugaccuuugugagauugaggaauugaaaagcaagaaacuggcgcucgcuccuugcaaccaggccggaaugggcguagucgguaaggugggcgagauccaguguucgucagaagagucugcacggaccauuaaaaaggaugggugcaucuggaacgccgaccugguuggaauagaacuuagaguggaugacgcugucuguuacaguaagauuacauccguggaggccguugcaaauuauagcgcuaucccaacuaccauuggcgggcugagguuugagcgcucucacgauagccagggaaaaaucuccggcucacccuuggacauaacagccauccgagguaguuucagcgugaacuaccgggggcuccgucugucuuuauccgaaauuaccgcgacuugcacgggagagguaacaaaugucucaggcugcuacaguuguaugaccggugccaaggugagcaucaaacugcauuccucuaagaacucgacugcucacgugagaugcaaaggcgaugaaaccgcauuuagcguccuagaggggguucacucauauauugugucccucaguuucgaccaugccguaguggaugaacaaugucagcugaauugcggaggccacgagucucaggucacacuuaaggggaacuugaucuuucuggacgugccuaaguucguugacggaagcuacaugcagaccuaucauuccacugugcccacaggcgcuaauauaccaucaccuacggauuggcucaacgcccuguuugguaauggguuaucuagguggauucugggagucaucggcgugcuuuugggcgggcucgcacuguucuuucuaaucauguuccugcucaaacugggaaccaagcaaguuuuucgcagccggacuaaacuugcguga

SEQ ID NO: 11648 - RNA, 3222 nt, Artificial Sequence
  derived and/or modified CDS sequence (opt3) from SFTSV/Phlebovirus(SD4/China/2010 strain SD4)__HM802203.1__GP
augaugaaggugaucugguucagcucccugauuugcuuugucauacaguguucuggcgacucagggcccaucauuugcgccggaccuauccacaguaacaaaagcgcugauauuccacaucuccuugguuacuccgagaagaucugucaaauagacagacugauccacguuucuucgugguugaggaaucauucacaguuccagggcuauguggggcagcggggaggccgcagccaaguaaguuacuauccggcagaaaacuccuacucucgauggagcgguuuacugucccccugcgaugccgacuggcuagggaugcucguggucaaaaaggcgaaaggaucagauaugauugugccuggcccaaguuauaagggcaagguuuucuucgagcgucccaccuuugacggguacgugggaugggguuguggcagcgggaaaucuagaacagaauccggagagcugugcucaagcgauaguggcacuucuuccggucuucugccuagcgacagggucuuguggaucggggauguggcuugucagccaaugacgcccauuccugaagagaccuuccucgagcugaagucguuuucucaguccgaauuuccagacaucugcaaaauagauggaauuguauuuaaucagugugagggcgaaucacugccgcaacccuucgacguugccuggauggaugugggccacagucauaagaucauuaugcgggagcacaaaacaaaguggguccaggagagcuccucuaaggacuuugugugcuauaaagaagggacuggaccuuguagcgagucagaagagaagaccugcaaaacaagugguuccugccgcggcgacaugcaguucuguaagguggcagggugcgaacacggagaggaggccagcgaagcuaaauguagaugcucucucguccauaagccaggcgagguugugguaucauacggugggaugagggugcggcccaaauguuacggcuuuagucgcaugauggcaaccuuagaagucaacccuccagagcagcgaaucggacaaugcacuggcugucaccuggaaugcaucaaugggggagugagacuuauuacauugaccagcgagcugaaguccgccacgguuugugcuucucauuucugcucgagcgccacuuccgguaagaaaucaaccgagauacaguuccacaguggcucucuaguggggaagacagcgauccacgucaaaggagcacucguggauggcacugaauuuaccuucgaggguagcuguauguuucccgacgggugcgaugccguagacugcacauucuguagggaauuucugaagaacccgcagugcuauccugcuaaaaaguggcuuuucauuaucauaguuauucuguugggcuacgccggacucaugcuguuaaccaaugugcugaaggcaaucggcgucuggggguccugggugaucgcucccgucaaacuccuuuuugccauuaucaagaaacugaugcggacggugucauguuugaugggaaagcuaauggaucguggucgccaaguuauucaugaggaaauaggcgagaacagagaggggaaucaggacgaugugaggaucgaaauggcgcggccacgacgcguaagacacuggauguauagcccugucauucugacuauccucgccacaggacuggcagagggcugcgacgaaauggugcaugcugauucuaaacuuguuuccuguaggcaggguagugggaacaugaaggagugcgugaccacuggccgggcccuguugcccgcugucaauccaggacaggaggccugucuccacuucacagcacccggcagcccugacucuaagugccugaaaaucaaggugaaacgcauuaacuuaaaguguaaaaaguccucaaguuacuuuguaccagaugccagaucgaggugcaccagcgugcgucggugucgaugggcuggggacugccaauccggaugcccgccccauuucacgucuaauagcuuuucagacgauugggcgggcaagauggacagagcaggucugggguucaguggauguuccgauggcugcgguggcgccgcuugugggugcuuuaacgccgcaccuucuuguauauucuggaggaaauggguugaaaauccacacggaaucauuuggaaggucagccccugcgccaccugggugccuuccgcugugaucgagcuaacaaugccaucaggcgaaguccgcacuuuccaccccaugagcgggauuccgacccagguuuuuaaaggagugagugugacauaucucggcucugacauggagguauccggucugacugaucuuugugaaaucgaggaguugaaaagcaagaagcuggcccucgcaccuugcaaccaggcggggaugggagucauaggcaaagugggugaaauccaguguucgucagaggaaucugcucggaccauuaagaaggacggcugcaucuggaacgccgaucugguugggauugagcuuagaguggacgaugcagucuguuacaguaaaaucacauccguggaagccguugcuaauuauagcgccauaccaaccacuauuggaggccugagguucgagcgcucucaugacagccaagggaagaucuccggaucacccuuggauauuacggcaauccgaggcaguuuuagcgugaacuaccggggucuccgucugucuuuauccgagauaacagcuaccugcacuggggaaguaaccaaugucucaggaugcuacaguuguaugacaggcgccaaagugagcaucaagcugcacuccucuaaaaacucgaccgcgcaugugagaugcaagggugacgagacugccuucagcguccuagaaggcguucacucauauacagugucccucaguuuugaucacgcuguaguggacgagcagugucagcugaauugcgggggacaugaaucucaggucacgcuuaagggcaacuugauuuuccuggacgugccuaaauuuguugaugggagcuacaugcaaaccuaucacuccacugugcccacaggagcaaauaucccaucaccuaccgacuggcucaacgcccuguucggcaaugguuuaucuagguggauucugggggucaucggagugcuuuugggcggccucgcucuguuuuuccuaauaaugagccuguuuaagcucgggacaaaacagguuuuccgcagucggacuaagcuggccuga

SEQ ID NO: 11649 - RNA, 3222 nt, Artificial Sequence
  derived and/or modified CDS sequence (opt3) from SFTSV/Phlebovirus(SDYY104/China/2011)__KU239112.1__GP
augaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacuuaauucguucucucaguccgaguuuccagauaucugcaagauagacggaauuguauucaaccagugugaaggcgagucacucccgcaacccuuugauguugccuggauggacgugggccacagucauaaaaucauuaugcgggagcacaagacaaaauggguccaggaaagcuccucuaaggauuucgugugcuauaaggaggggacuggaccuuguagcgaaucagaggaaaaagcaugcaagaccagugguuccugccgcggcgacaugcaguuuuguaaaguggccgggugcgagcacggagaggaagcuagcgaggcaaaguguagaugcucuuuaguccauaaaccaggcgaaguugugguaucauacggugggaugagggugcggcccaaguguuacggcuucagucgcaugauggccacacuggaggucaauccuccagaacagcgaaucggacaaugcaccggcugucaccuugagugcaucaacgggggagugagauugauuacucugacaagcgagcuaagguccgcuaccguuugugccucucauuuuugcucgagcgcgacguccgguaaaaagucaacugaaauacacuuccacaguggcucucucguggggaagaccgcaauccaugucaaaggagcccugguggacggcacagaguucacuuuugaagguagcuguauguuccccgaugggugcgacgcuguagauugcaccuuuugucgggaguuccuuaagaauccgcagugcuauccugccaaaaaguggcuguuuauuaucauaguuauuuugcucggcuacgcaggacugauguuacugacaaacgugcucaaagcuaucggcgucuggggguccugggugaucgcccccgucaagcugauguucgcgauuaucaagaaacugaugcguaccgugucauguuugguuggaaagcuaauggaccgcgguagacaggugauucacgaagagauaggcgagaauggggaaggaaaccaagaugacguaaggaucgagauggcccggccacgacgcgucagacauuggauguauagcccugugauucugacgauccucgcaaucggccuggcugaagguugcgaugagaugguucacgccgacucuaaacuuguguccuguaggcaggggaguggcaauaugaaggagugcauuacuacaggacgggcucuguugcccgccgucaacccaggccaggaagcaugucuccauuuuaccgcccccgggagcccugauucuaaaugccugaagauaaaggugaaacgcaucaauuuaaaguguaaaaaguccucaaguuacuucguaccagacgcuagaucgaggugcacuagcgugcgucggugucgaugggcgggagauugccaguccggcugcccgccccacuuuacaucuaacagcuucucagacgacugggcagguaaaauggauagagccgggcugggauuuaguggcuguuccgacgguugcggcggggcugccuguggaugcuucaaugcagccccuucuuguaucuuuuggaggaaguggguugagaacccacacggcauuauuuggaaggucagccccugcgcugccugggugccuuccgcagugaucgaacuaaccaugccaucaggggagguccgcacguuccaucccaugagcggaauaccgacccaaguuuucaaaggcgugagugugacauaucucgguucugauauggaaguauccgggcugacugaccuuugugagaucgaggaacuuaagagcaaaaagcuggcgcucgcuccuugcaaccaggccggaaugggcgucguggguaaaguuggcgagauucaguguucgucagaagagucugcacggaccaucaagaaagaugggugcauuuggaaugccgaccuggugggaaucgaacuuagagucgaugacgcuguguguuacaguaagauaacauccguugaggccguggcaaacuauagcgcuauuccaacuaccaucggcgggcugagguuugagcgcucucacgauagccagggaaagauuuccggcucacccuuggacaucacagccauacgagguaguuucagcguaaauuaccgggggcuccgucugucuuuauccgaaaucaccgcgacuugcacgggagaggucacaaacgugucaggcugcuacaguuguaugaccggugccaaagugagcauuaagcugcauuccucuaaaaauucgacugcucacgucagaugcaagggcgaugaaaccgcauuuagcguucuagagggggugcacucauauaucguaucccucaguuucgaccaugccguggucgaugaacaaugucagcugaacugcggaggccacgagucucaggugacacuuaaagggaauuugauuuuucuggacguuccuaaguucguggacggaagcuacaugcagaccuaucauuccacuguccccacaggcgcuaacaucccaucaccuacggauuggcucaaugcccuguuugguaacggguuaucuagguggauacugggagugauuggcguucuuuugggcgggcucgcacuguucuuucuaaucguguuccugcucaagcugggaaccaaacaagcguuucgcagccggacuaaguuggccuga

SEQ ID NO: 11650 - RNA, 3417 nt, Artificial Sequence
  derived and/or modified CDS sequence (opt1) from ANDV(Chile-9717869)__AF291703.2__GP
auggagggcugguaccuggugguccucggggugugcuacacccugacccuggccaugcccaagacgaucuacgagcucaagauggagugcccgcacaccgugggccuggggcagggcuacaucaucgggagcaccgagcugggccucaucuccaucgaggccgccagcgacaucaagcuggaguccagcugcaacuucgaccugcacaccacguccauggcccagaaguccuucacccaggucgaguggcgcaagaaguccgacaccaccgacacgaccaacgccgccagcaccaccuucgaggcccagacgaagaccgugaaccuccgggggaccugcauccuggcgcccgagcuguacgacacccucaagaaggugaagaagacgguccugugcuacgaccugaccugcaaccagacccacugccagcccaccguguaccucaucgcccccgugcugacgugcaugagcauccgcagcugcauggccuccgucuucaccagccggauccaggugaucuacgagaagacccacugcgugaccgggcagcugaucgagggccagugcuucaacccggcccacacgcucacccugucccagcccgcgcacaccuacgacaccgucacgcugcccaucagcugcuucuucacccccaagaaguccgagcagcucaaggugaucaagaccuucgaggggauccugaccaagacgggcugcaccgagaacgcccugcagggguacuacgugugcuuccucggcagccacuccgagccgcugaucguccccagccuggaggacauccgcuccgccgagguggugagccggaugcucguccacccccgcggcgaggaccacgacgccauccagaacagccagucccaccuccggaucguggggcccaucaccgccaaggugccgagcaccuccagcacggacacccugaagggcaccgcguucgccgggguccccauguacuccagccuguccacccuggugcgcaacgccgaccccgaguucguguucagccccggcaucgucccggaguccaaccacagcacgugcgacaagaagaccgugcccaucaccuggaccggcuaccugcccaucuccggggagauggagaaggucaccggcugcacgguguucugcacccucgccgggcccggcgccagcugcgaggcguacuccgagaacgggaucuucaacaucagcuccccgaccugccuggugaacaagguccagcgguuccgcggcagcgagcagaagaucaacuucaucugccagcggguggaccaggacguggucguguacugcaacggccagaagaaggugauccugaccaagacgcucgucaucgggcagugcaucuacaccuucaccucccuguucagccugaugcccgacguggcccacucccucgccguggagcugugcguccccggccugcacgggugggccaccgugaugcuccugagcacguucugcuucggcugggugcugauccccgccgucacccucaucauccugaagugccugcgcgugcucaccuucagcugcucccacuacaccaacgagagcaaguucaaguucauccuggagaaggugaagaucgaguaccagaagacgaugggguccauggucugcgacgugugccaccacgagugcgagaccgcgaaggagcuggagagccaccggcaguccugcaucaacggccagugcccguacugcaugaccaucaccgaggccacggagagcgcccugcaggcccacuacuccaucugcaagcucaccggccgcuuccaggaggcccugaagaagucccugaagaagcccgaggugaagaaggggugcuaccggacccucggcgucuuccgcuacaagagccggugcuacguggggcugguguggugccugcuccugaccugcgagaucgucaucugggcggccagcgccgagacgccccugauggaguccggcuggagcgacaccgcccacggggugggcgagauccccaugaagaccgaccucgagcuggacuucucccugccgagcuccagcuccuacagcuaccgccggaagcucaccaaccccgcgaacaaggaggagagcauccccuuccacuuccagauggagaagcaggucauccacgccgagauccagccgcugggccacuggauggacgccacguucaacaucaagaccgccuuccacugcuacggggccugccagaaguacuccuaccccuggcagaccagcaagugcuucuucgagaaggacuaccaguacgagaccggcugggggugcaaccccggcgacugccccggcguggggacgggcugcaccgcgugcgggguguaccuggacaagcucaaguccgugggcaaggccuacaagaucaucagccugaaguacacccgcaaggucugcauccagcuggggaccgagcagacgugcaagcacaucgacgccaacgacugccucgugaccccguccgugaaggucugcaucgugggcaccgugagcaagcugcagcccuccgacacccuccuguuccugggcccccuggagcagggcggcaucauccucaagcaguggugcaccacgagcugcgccuucggggaccccggcgacaucauguccaccccgagcgggaugcggugccccgagcacaccggcuccuuccgcaagaucugcggcuucgccaccacgcccgucugcgaguaccaggggaacaccaucagcggcuacaagcgcaugauggcgaccaaggacuccuuccagagcuucaaccugaccgagccccacaucacgaccaacaagcuggaguggaucgacccggacgggaacacccgggaccacgugaaccucgugcugaaccgcgacgucuccuuccaggaccugagcgacaaccccugcaagguggaccuccacacccaggccaucgagggcgccuggggguccggcgugggcuucacgcugaccugcaccgucgggcugaccgagugccccagcuucaugacguccaucaaggccugcgaccucgccaugugcuacggcagcaccgugaccaaccuggcgcgggggagcaacaccgugaaggucgugggcaagggcgggcacuccggcagcuccuucaagugcugccacgacacggacugcagcuccgaggggcugcucgccagcgcgccccaccuggagcgcgugaccggcuucaaccagaucgacuccgacaaggucuacgacgacggggccccgcccugcaccuucaagugcugguucaccaagagcggcgaguggcugcucggcauccugaacgggaacuggaucgugguggucgugcuggucgugauccucauccuguccaucaucauguucagcgugcugugcccccggcgcggccacaagaagacggucuga

SEQ ID NO: 11651 - RNA, 3417 nt, Artificial Sequence
  derived and/or modified CDS sequence (opt1) from ANDV(AH-1)__AF324901.2__GP
auggagggcugguaccugguggcccucggggucugcuacacccugacccuggccaugcccaagacgaucuacgagcucaagauggagugcccgcacaccgugggccuggggcagggcuacaucaucgggagcaccgagcugggccucaucuccaucgaggcggccagcgacaucaagcuggaguccagcugcaacuucgaccugcacaccacguccauggcccagaaguccuucacccagguggaguggcgcaagaaguccgacaccaccgacacgaccaacgccgccagcaccaccuucgaggcgcagacgaagaccgucaaccuccgggggaccugcauccuggcccccgagcuguacgacacccucaagaaggugaagaagacggugcugugcuacgaccugaccugcaaccagacccacugccagcccaccgucuaccucaucgcccccgugcugacgugcaugagcauccgcagcugcauggccuccguguucaccagccggauccaggucaucuacgagaagacccacugcgugaccgggcagcugaucgagggccagugcuucaacccggcgcacacgcucacccugucccagcccgcccacaccuacgacaccgugacgcugcccaucagcugcuucuucacccccaagaaguccgagcagcucaaggucaucaagaccuucgaggggauccugaccaagacgggcugcaccgagaacgcccugcagggguacuacgugugcuuccucggcagccacuccgagccgcugaucgugcccagccuggaggacauccgcuccgccgaggucgugagccggaugcucgugcaccccaucggcgaggaccacgacgccauccagaacagccaguccuaccugcgcaucgucgggcccaucaccgcgaaggugccgagcaccuccagcacggacacccugaagggcaucgccuucgccggggugcccauguacuccagcuucuccacccucguccggaacgccgaccccgaguucguguucagccccggcaucaucccggaguccaaccacagcgugugcgacaagaagaccguccccaucaccuggacgggcuaccugcccaucuccggggagauggagaaggugaccggcugcaccgucuucugcacccuggccgggcccggcgcgagcugcgaggccuacuccgagaacgggaucuucaacaucagcuccccgacgugccucgugaacaaggugcagcgcuuccggggcagcgagcagaagaucaacuucaucugccagcgcgucgaccaggacgugguggucuacugcaacggccagaagaaggugauccugaccaagacccuggugaucgggcagugcaucuacaccuucacgucccucuucagccugaugcccgacgucgcccacucccuggccguggagcucugcgugcccggccugcacgggugggccaccgucaugcugcucagcaccuucugcuucggcugggugcugauccccgcggugacccugaucauccucaagugccugcggguccugacguucagcugcucccacuacaccaacgagagcaaguucaaguucauccucgagaaggugaagguggaguaccagaagaccaugggguccauggucugcgacgugugccaccacgagugcgagaccgccaaggagcuggagagccaccgccaguccugcaucaacggccagugcccguacugcaugacgaucaccgaggccaccgagagcgcccugcaggcccacuacuccaucugcaagcugaccggccgguuccaggaggcgcucaagaagucccugaagaagcccgaggugaagaaggggugcuaccgcacgcugggcgucuuccgguacaagagccgcugcuacguggggcucguguggugccugcugcugaccugcgagaucgucaucugggccgccagcgccgagacgccccucauggaguccggcuggagcgacaccgcgcacggggugggcgagauccccaugaagacggaccuggagcucgacuucucccugccgagcuccagcuccuacagcuaccggcgcaagcugaccaaccccgccaacaaggaggagagcauccccuuccacuuccagauggagaagcaggucauccacgccgagauccagccgcucggccacuggauggacgccaccuucaacaucaagaccgccuuccacugcuacggggcgugccagaaguacuccuaccccuggcagacgagcaagugcuucuucgagaaggacuaccaguacgagaccggcugggggugcaaccccggcgacugccccggcguggggaccggcugcaccgccugcgggguguaccuggacaagcugaaguccgugggcaaggccuacaagaucaucagccucaaguacacgcggaaggucugcauccagcuggggaccgagcagaccugcaagcacaucgacgccaacgacugccuggugaccccguccgugaaggucugcaucgugggcacggugagcaagcuccagcccuccgacacccugcuguuccucggcccccuggagcagggcggcaucauccugaagcaguggugcaccaccagcugcgccuucggggaccccggcgacaucauguccaccccgagcgggaugcgcugccccgagcacacgggcuccuuccggaagaucugcggcuucgcgaccacccccgucugcgaguaccaggggaacaccgugagcggcuacaagcgcaugauggccacgaaggacuccuuccagagcuucaaccucaccgagccccacaucaccaccaacaagcuggaguggaucgacccggacgggaacacgcgcgaccacgugaaccugguccucaaccgggacguguccuuccaggaccugagcgacaaccccugcaagguggaccugcacacccaggccaucgagggcgccuggggguccggcgucggcuucacccugaccugcacgguggggcucaccgagugccccagcuucaugaccuccaucaaggccugcgaccuggcgaugugcuacggcagcaccguggccaaccucgcccgcgggagcaacacggucaagguggugggcaagggcgggcacuccggcagcuccuucaagugcugccacgacaccgacugcagcuccgaggggcugcuggccagcgcgccccaccucgagcgggucaccggcuucaaccagaucgacuccgacaagguguacgacgacggggccccgcccugcaccuucaagugcugguucaccaagagcggcgaguggcugcugggcauccucaacgggaacuggaucguggucgugguccugguggugauccugauccucuccaucaucauguucagcguccugugcccccgccggggccacaagaagaccguguga

SEQ ID NO: 11652 - RNA, 3417 nt, Artificial Sequence
  derived and/or modified CDS sequence (opt1) from ANDV(CHI-7913)__AY228238.1__GP
auggagggcugguaccugguggcccucgggaucugcuacacccugacccuggccaugcccaagacgaccuacgagcucaagauggagugcccgcacaccgucggccuggggcagggcuacaucaucgggagcaccgagcugggccucaucuccaucgaggccgccagcgacaucaagcuggaguccagcugcaacuucgaccugcacacgaccuccauggcccagaaguccuucacccagguggaguggcgcaagaaguccgacaccacggacaccaccaacgccgccagcaccacguucgaggcccagaccaagaccgugaaccuccgggggaccugcauccuggcccccgagcuguacgacacgcucaagaaggucaagaagaccgugcugugcuacgaccugaccugcaaccagacccacugccagcccacgguguaccucaucgcccccguccugaccugcaugagcauccgcagcugcauggcccggguguucaccucccgcauccaggugaucuacgagaagacccacugcgucacggggcagcugaucgagggccagugcuucaacccggcgcacacccucacccugagccagcccgcccacaccuacgacacggugacccugcccaucuccugcuucuucacccccaaggagagcgagcagcucaaggugaucaagaccuucgaggggauccugacgaagaccggcugcaccgagaacgcccugcagggguacuacgucugcuuccucggcucccacagcgagccgcugaucgugcccucccuggaggacauccggagcgccgagguggucucccgcaugcucgugcacccccggggcgaggaccacgacgccauccagaacagccagagccaccuccgcaucguggggcccaucaccgcgaaggucccguccacgagcuccaccgacacccugaagggcaccgccuucgccggggugcccauguacagcucccugagcacccuggugaagaacgccgaccccgaguucgucuucucccccggcaucaucccggagagcaaccacuccgugugcgacaagaagacggugcccaucaccuggaccggcuaccugcccaucagcggggagauggagaaggucaccggcugcacgguguucugcacccucgccgggcccggcgcguccugcgaggccuacagcgagaacgggaucuucaacaucuccagcccgaccugccuggucaacaaggugcagcgguuccgcggcuccgagcagaagaucaacuucaucugccagcggguggaccaggacgucgugguguacugcaacggccagaagaaggucauccugaccaagacgcucgugaucgggcagugcaucuacaccuucaccagccuguucucccugaugcccgacguggcccacagccucgccgucgagcugugcgugcccggccugcacgggugggccaccgugaugcuccuguccacguucugcuucggcuggguccugauccccgcggugacccucaucauccugaagugccugcgcgugcucaccuucagcugcagccacuacaccaacgaguccaaguucaaguucauccuggagaaggucaagguggaguaccagaagacgauggggagcauggugugcgacgucugccaccacgagugcgagaccgccaaggagcuggagucccaccggcagagcugcaucaacggccagugcccguacugcaugaccaucaccgaggccacggaguccgcccugcaggcccacuacagcaucugcaagcucaccggccgcuuccaggaggcgcugaagaagucccugaagaagcccgaggugaagaaggggugcuaccggacccucggcguguuccgcuacaagagccggugcuacgucgggcugguguggugccugcuccugaccugcgagaucgugaucugggccgccuccgccgagacgccccugauggagagcggcugguccgacaccgcgcacggggucggcgagauccccaugaagaccgaccucgagcuggacuucagccugccguccagcuccagcuacuccuaccgccggaagcucaccaaccccgccaacaaggaggagagcaucagcuuccacuuccagauggagaagcaggucauccacgccgagauccagccccugggccacuggauggacgccacguucaacaccaagaccgccuuccacugcuacggggcgugccagaaguacuccuacccguggcagaccagcaagugcuucuucgagaaggacuaccaguacgagacgggcugggggugcaaccccggcgacugccccggcguggggaccggcugcaccgccugcgggguguaccuggacaagcucaaguccgugggcaaggccuacaagaucaucagccugaaguacacccgcaaggugugcauccagcuggggacggagcagaccugcaagcacaucgacgccaacgacugccucgucacccccuccgugaaggugugcaucgucggcaccgugagcaagcugcagccguccgacacccuccuguuccugggcccccuggagcagggcggcgugauccucaagcaguggugcacgaccagcugcgccuucggggaccccggcgacaucauguccacccccagcgggaugcggugcccggagcacaccggcuccuuccgcaagaucugcggcuucgcgacgacccccgucugcgaguaccaggggaacaccaucagcggcuacaagcgcaugauggccaccaaggacuccuuccagagcuucaaccugacggagccccacaucaccgccaacaagcuggaguggaucgaccccgacgggaacacccgggaccacgugaaccucgugcugaaccgcgacgucuccuuccaggaccugagcgacaacccgugcaagguggaccuccacacccaggccaucgagggcgccuggggguccggcgugggcuucacgcugaccugcaccgucgggcugaccgagugccccagcuucaugacguccaucaaggcgugcgaccucgccaugugcuacggcagcaccguggccaaccuggcccgggggagcaacaccgugaaggucgugggcaagggcgggcacuccggcagcuccuucaagugcugccacgacaccgacugcagcuccgaggggcugcucgcgagcgcgccccaccuggagcgcgugacgggcuucaaccagaucgacuccgacaaggucuacgacgacggggcgcccccgugcaccuucaagugcugguucaccaagagcggcgaguggcugcucggcauccugaacgggaacuggaucgugguggucgugcuggucgugauccucauccuguccaucaucauguucagcgugcugugcccccggcgcggccacaagaagaccgucuga

SEQ ID NO: 11653 - RNA, 3417 nt, Artificial Sequence
  derived and/or modified CDS sequence (opt1) from Hu39694(Hu39694)__AF028023.1__GP
auggagggcugguaccugaucgugcucggggucugcagcacccugacccuggccaugccccgcacgaucuacgagcuccggauggagugcccccacaccgugggccuggggcagggcuacaucaucggguccaccgagcugggccucauccccaucgagaccgugagcgaccugaagcuggaguccagcugcaacuucgaccuccacacgaccuccaugacccagaaguccuacacccaggucgaguggcgcaagaaguccgacacgaccgacaccaccaacgccgcgagcacgaccuucgaggcccagaccaagaccgugaaccugcggggcacgugcgugcuggccagcgagcucuacgacacccugaagaagaucaagaagaccguccugugcuacgaccugaccugcaaccagacgcacugccagcccaccguguaccugaucgcccccgugagcacgugcauguccauccgcagcugcauggccuccgucuucaccaaccggauccaggugaucuacgagaagacccacugcgugaccgggcagcuggucgagggccagugcuucaacccggcgcacacccucacccugagccagcccgcccacacguacgagauggugacccugcccgugaccugcuucuucacccccaagaaguccgaccagcucaagcugaucaagacguucgaggggaucaucagcaagaccggcugcaccgagaacgcccugcagggguacuacgucugcuuccucggcucccacagcgagccgcugcacgugcccucccuggaggacauccgcagcguggaggucuucagccggaugaucauccacccccgcggcgaggaccacgaccccauccagaacucccagggguuccuccggaucgugggcccgaucaccgccaaggugcccagcacguccagcaccgacacccugaaggggaccgcguucgccggcguccccauguacuccagccuguccacccucgugcgcacgaccgaccccgaguacguguucagcccgggcaucauccccgaguccaaccacagcacgugcgacaagaagaccaucccccugaccuggaccggguaccugcccaucgccggcgagauggagaaggucaccgggugcaccguguucugcacgcucgccggcccgggggccuccugcgaggcguacagcgagcacggcaucuucaacaucuccagcccgaccugccugguccacaaggugcagaaguuccggggcuccgagcagaagaucaacuucaucugccagcgcguggaccaggacgucgugguguacugcaacgggcagaagaaggucauccugaccaaggaccucgugaucggccagugcaucuacaccuucacgagccuguucucccugaugcccgacguggcccacagccucgccgucgagcugugcgugcccgggcugcacggcugggccaccgugaugcuccuguccaccuucugcuucggguggauccugauccccgccaucacccucgucgugcugaaguuccugaagauggcgacguucagcugcagccacuacaccaacgaguccaaguucaaguucauccucgagaaggugaaggucgaguaccagaagaccaugggcagcauggugugcgacaucugccaccacgagugcgagaccgccaaggagcuggagucccacaagcagagcugcaucaacggccagugccccuacugcaugacgaugaccgaggccaccgaguccgcccugcaggcccacuacagcaucugcaagcugaccgggcgguuccaggaggcgcucaagaagucccugaagcgccccgaggugaagaagggcugcuaccggacgcugggggucuuccgcuacaagagccggugcuacgugggccucguguggugcguccugcugaccugcgagcucaucgugugggccgccuccgccgagacgccccugcuggagagcgggugguccgacaccgcccacggcgugggcgaggucccgaugaagaccgaccucgagcuggacuucagccugcccuccagcuccagcuacuccuaccgccggaagcucaccaaccccgcgaacaaggaggagagcaucccguuccacuuccagauggagaagcaggucauccacgccgagauccagacccuggggcacuggauggacgccaccuucaacaucaagacggccuuccacugcuacggcgcgugccagaaguacagcuaccccuggcagaccgccaagugcuucuucgagaaggacuaccaguacgagaccggguggggcugcaaccccggcgacugccccggguucggcaccgggugcacggccugcggcguguaccuggacaagcucaaguccguggggaaggccuacaagaucaucagccugaaguacacccgcaaggugugcauccagcugggcaccgagcagaccugcaagcacaucgacgccaacgacugccucgugaccccguccgucaaggugugcaucaucggcacggugagcaagcugcagcccuccgacacccuccucuuccuggggccccuggagcagggcgggauccuccugaagcaguggugcaccaccagcugcgcguucggcgaccccggggacaucauguccacgaccagcggcaugcggugcccggagcacaccggcuccuuccgcaagaucugcggguucgccaccacgcccgucugcgaguaccagggcaacaccaucagcggguacaagcgcaugauggccaccaaggacuccuuccagagcuucaaccugaccgacccccacaucacgaccaacaagcucgaguggaucgaccccgacggcaacacccgggaccacgugaaccuggugcugaaccgcgacgucuccuuccaggaccucagcgacaacccgugcaagguggaccugcacacccaggccaucgagggggccuggggcuccggcgugggguucacgcugaccugcaccgucggccucaccgagugccccagcuucaucacguccaucaaggcgugcgacauggccaugugcuacgggagcaccguguccaaccuggcccggggcagcaacaccgugaaggucguggggaagggcggccacagcgggcugcacucccgcugcugccacgacaccgacugcagcuccgagggccucguggccagcgccccgcaccuggagcgggucacgggguucaaccagaucgacuccgacaagguguacgacgacggcgcgccgcccugcaccuucaagugcugguucaccaagagcggcgaguggcugcucgggauccugaacggcaacuggaucguggucguggugcuggucgugguccucaucuucuccaucauccuguucaacauccugugcccccgccgggggcacaagaagaccguguga

SEQ ID NO: 11654 - RNA, 3417 nt, Artificial Sequence
  derived and/or modified CDS sequence (opt1) from LECV(Of22819)__AF028022.1__GP
auggagggcugguaccugaucgugcucggggucugcagcacccugacccuggccaugcccaagacgaucuacgagcucaagauggagugcccgcacaccgugggccuggggcagggcaucaucgugggguccaccgagcugggccucauccccaucgagaccgccagcgaccugaagcuggaguccagcugcaacuucgaccuccacacgaccuccaugacccagaaguccuacacccaggucgaguggcgcaagaaguccgacacgaccgacaccaccaacgccgccgccacgaccuucgagagccaggccaagaccgugaaccugcgggggaccugcgugcuggccgccgagcucuacgacacgcugaagaaggucaagaagaccgugcugugcuacgaccugaccugcaaccagacccacugccagcccacgguguaccugaucgcccccgucaucacgugcaugagcauccgcagcugcauggccuccguguucaucagccggauccagaucaucuacgagaagacccacugcgugaccggccagcugaucgagggccagugcuucaacccggcccacacccucacccuggcgcagcccgcccacaccuacgagaccgucacgcugcccgugaccugcuucuucacccccaagaaguccgaccagcucaagcugaucaagaccuucgaggggaucaucagcaagacgggcugcaccgagaacgcccugcagggguacuacgugugcuuccucggcucccacagcgagccgcugcacguccccucccugaaggacauccgcagcgccgagguggugacccggaugaucguccacccccgcggcgaggaccacgaccccauccagaacucccagggguaccuccggaucgugggcccgcugaccgccaaggugcccagcacgagcuccagcgacacccugcaggggaccgcguucgccggcguccccauguacuccagccucuccacccuggugcgcaacaccgaccccgaguucguguucagcccgggcaucauccccgaguccaaccacagcgccugcgacaagaagacgaucccccugaccuggaccggguaccuccccaucuccggcgagauggagaaggucaccgggugcacgguguucugcacccuggccggcccgggggccagcugcgaggcguacuccgagagcggcaucuucaacaucuccagcccgaccugccuggucaacaaggugcagaaguuccggggcuccgagcagaagaucaacuucaucugccagcgcguggaccaggacgucgugguguacugcaacgggcagaagaaggucauccucaccaagacgcuggugaucggccagugcaucuacaccuucaccagccuguucucccucaugcccgacguggcccacagccuggccgucgagcugugcgugcccgggcuccacggcugggccaccgugaugcugcuguccacguucugcuucggguggauccucauccccgccaucacccuggucgugcugaaggugcucaaggucgcgaccuucagcugcagccacuacaccaacgaguccaaguucaaguucauccuggagaaggugaagguggaguaccagaagacgaugggcagcauggucugcgacaucugccaccacgagugcgagaccgccaaggagcuggagucccacaagcagagcugcaucaacggccagugccccuacugcaugaccaugaccgaggccacggaguccgcccugcaggcccacuucgcgaucugcaagcucaccgggcgguuccaggaggcccugaagaagucccugaagaagcccgaggugcgcaagggcugcuaccggacccucgggguguuccgcuacaagagccggugcuacgucggccugguguggugcgugcugcugaccugcgagcucaucgucugggccgccagcgcggagacgccccugcucgaguccggguggagcgacaccgcccacggcgugggcgaggugccgaugaagaccgaccuggagcuggacuucucccuccccagcuccagcuccuacagcuaccgccggaagcugaccaaccccgccaacaaggaggaguccaucccguuccacuuccagauggagaagcaggucauccacgccgagauccagaaccuggggcacuggauggacgccacguucaacaucaagaccgcguuccacugcuacggcgccugccagaaguacagcuaccccuggcagaccgccaagugcuucuucgagaaggacuaccaguacgagaccggguggggcugcaaccccggcgacugccccggggugggcacggggugcaccgccugcggcguguaccucgacaagcucaagagcgucgggaaggccuacaagaucaucucccugaaguacacccgcaaggugugcauccagcucggcaccgagcagacgugcaagcacaucgacgcgaacgacugccuggugaccccgagcgucaaggugugcaucgugggcaccgucuccaagcugcagcccagcgacacccuccuguuccuggggccccucgagcagggcgggaucauccugaagcaguggugcaccacguccugcgccuucggcgaccccggggacaucaugagcaccaccuccggcaugcggugcccggagcacaccggcagcuuccgcaagaucugcggguucgccacgacccccgugugcgaguaccagggcaacaccaucuccggguacaagcggaugauggccaccaaggacagcuuccaguccuucaaccugacggacccccacaucaccaccaacaagcucgaguggaucgaccccgacggcaacacccgcgaccacgugaaccugguccugaaccgcgacgugagcuuccaggaccucuccgacaacccgugcaagguggaccugcacacgcaggccaucgagggggcguggggcagcggcgucggguucacccugaccugcaccgugggccucacggagugccccuccuucaugaccagcaucaaggccugcgaccuggccaugugcuacggguccaccgugcacaaccuggcccggggcagcaacaccgucaaggugguggggaagggcggccacuccgggagcagcuucaagugcugccacgacacggacugcuccagcgagggccucgucgcguccgcgccccaccuggagcgcgugaccggguucaaccagaucgacagcgacaagguguacgacgacggcgcgcccccgugcaccuucaagugcugguucaccaaguccggcgaguggcugcucgggauccugaacggcaacuggaucgucguggucgugcugguggucgugcucaucuucagcaucauccuguucuccauccugugcccccggcgcgggcacaagaagacgguguga

SEQ ID NO: 11655 - RNA, 3417 nt, Artificial Sequence
  derived and/or modified CDS sequence (opt1) from ORNV(Ol22996)__AF028024.1__GP
auggagggcugguaccugaucgugcucggggucugcagcaccgugacccuggccaugcccaagacgaucuacgagcugaagauggagugcccccacaccgugggccucgggcagggcuacaucaucggguccaccgagcugaaccugauccccaucggcgccgcgagcgaccucaagcuggaguccagcugcgacuucgaccuguacaccacgcccaugacccagaaguccuacacccaggucgaguggcgcaagaaguccgagaccacggacaccaccaacgccgccgccaccacguucgagagccagaccaagaccgugaaccuccgggggaccugcauccuggccagcgagcuguacgacacgcucaacaagaucaagaagcccgugcugugcuacgaccugaacugcaaccagacccgcugccagccgaccgucuaccucaucgcgcccgugaucacgugcauguccauccggagcugcauggccuccgugagcaacucccgcauccagaucaucuacgagaagacccacugcgucaccggccagcugguggagggccagugcuucaaccccagccacacccugacccucgcccagcccgcccacacguacgagaccgugacccugccggugaccugcuucuucacgcccaagaaguccgaccagcugaagcucgugaagaccuucgaggggaucaucaccaagaccggcugcacggagaacgcgcugcagggguacuacgugugcuuccugggcagccacuccgagccccuccacguccccagccuggaggacauccgguccgccgagguggugagccgcaugaucguccacccgcggggcgaggaccacgaccccauccagaacagccaggggcaccuccgcaucgugggccccaucaccgccaaggugcccuccaccagcuccagcgacacccugcaggggacggccuucuccggcgucccgauguacagcucccugagcacccuggugcgguccgccgaccccgaguucguguucagccccggcauccuccccgaguccaaccacagcgucugcgacaagaagacccugccgcugaccuggaccggguaccuccccaucuccggcgagauggagaaggugacggggugcaccgucuucugcacccuggcgggccccggggccagcugcgaggccuacuccgagaacggcaucuucaacaucagcuccccgaccugccuggugaacaaggugcagaaguuccgcggcagcgagcagaagaucaacuucaucugccagcggauggaccaggacgucgugguguacugcaacgggcagaagaaggucauccucacgaagacccuggugaucggccagugcaucuacaccuucaccucccuguucagccucaugcccgacguggcccacagccuggccgucgagcugugcgugcccgggcuccacggcugggcgacggugaugcugcuguccaccuucugcuucggguggauccucauccccgccaucacccuggucgugcugaaguuccucaagauggccaccuucagcugcucccacuacacgaacgagagcaaguucaagcugauccuggagaaggugaaggucgaguaccagaagaccaugggcuccauggugugcgacaucugccaccacgagugcgagaccgccaaggugcuggagagccacaagcaguccugcaucaacggccagugccccuacugcaugaccaugacggaggccaccgagagcgcgcuccaggcccacuacuccaucugcaagcugaccgggcgcuuccaggaggcccugaagaagucccucaagaagccggaggucaagcggggcugcuaccgcacccuggggguguuccgguacaagagccgcugcuacgugggccuggucuggugcgugcuccugacgugcgagcugaucgugugggccgccagcgcggagacgccccuccuggaguccggguggagcgacaccgcccacggcgucggcgagauccccaugaagaccgaccuggagcucgacuucucccugccgagcuccagcagcuacuccuaccggcgcaagcugaccaaccccgccaacaaggaggagagcauccccuuccacuuccagauggagaagcaggucauccacgccgagauccagacccucgggcacuggauggacgcgaccuucaacaucaagaccgccuuccacugcuacggcgccugccagaaguacuccuaccccuggcagacggccaagugcuucuucgagaaggacuaccaguacgagaccggguggggcugcaacccgggcgacugccccggggugggcaccgggugcaccgccugcggcgucuaccuggacaagcucaagagcguggggaaggcguacaagaucaucucccugaaguacacgcggaaggugugcauccagcugggcaccgagcagaccugcaagcacaucgacgccaacgacugccuggucacccccagcgugaaggugugcaucgucggcacgguguccaagcuccagcccagcgacacccugcuguuccucgggccgcuggagcagggcgggaucauccugaagcagugguggaccaccuccugcgccuucggcgaccccggggacaucaugagcaccacguccggcaugcgcugccccgagcacaccggcagcuuccggaagaucugcggguucgccaccacccccgugugcgaguaccagggcaacacgaucuccggguacaagcgcaugauggccaccaaggacagcuuccaguccuucaaccucaccgacccgcacaucaccacgaacaagcuggaguggaucgaccccgacggcaacacccgcgaccacgucaaccuggugcucaaccgggacgugagcuuccaggaccuguccgacaaccccugcaaggucgaccugcacacccaggcgaucgagggggccuggggcagcggcgugggguucacccucacgugcaccgugggccugaccgagugccccuccuucaugaccagcaucaaggccugcgaccuggccaugugcuacgggagcacggucaccaaccucgcccgcggcuccaacaccgugaagguggucgggaagggcggccacagcggguccagcuucaagugcugccacgacaccgacugcuccagcgagggccugguggcguccgccccgcaccuggagcgggugacgggguucaaccagaucgacagcgacaaggucuacgacgacggcgccccgcccugcaccuuccgcugcugguucaccaaguccggcgaguggcuccuggggauccugaacggcaacuggaucgugguggucgugcucaucgucgugcugaucuucagcaucgugcuguucuccauccucugcccccggcgcgggcacaagaaggccgucuga

SEQ ID NO: 11656 - RNA, 3426 nt, Artificial Sequence
  derived and/or modified CDS sequence (opt1) from BCCV__L39950.1__GP
augggccgccuguaccucaucgugcuggggguccugaucaccgccaccgccggcuucccccggagcgugcacgagcucaagaucgagugcccgcacacggugguccuggggcagggcuacgugaccggguccguggagcugggcuucaucgcccucgaccaggucaccgaccugaagaucgagagcuccugcagcuucgaccaccacgccgcccccaccacgacccagaacuucacccagcugaagugggccaagaccgccuccacgaccgacaccaccaacgcggccgagacgaccuucgagagcaaguccaccgaggugcaccucaagggcgugugcaccauccccagcaacguccuggacgggcccucccgcccggugacgggccggaagaccguggucugcuacgaccuggccugcaaccagacccacugccagcccaccgugcaccuccuggcccccauccagacgugcaugagcgugcgcuccugcaugaucagccugcucgcgucccggauccaggucguguacgagaagaccuacugcgugaccgggcagcugaucgagggccugugcuucaaccccgucccgaaccucgcccugacccagcccgggcacacguacgacaccuucacccugcccaucacgugcuuccucguggccaagaagggcgccaaccugaagaucgccguggagcuggagaagcucaccaccaagaccggcugcgcggagaacgcccugcaggccuacuacaucugcuucaucgggcagcacagcgagccccugaccgucccgaugcucgaggacuaccgcuccgccgagaucuucacgcggaucaugaugaaccccaagggcgaggaccacgacauggagcagagcucccagggggcccugcgcaucgugggccccaucaagggcaaggugcccccgaccgagaccagcgacaccguccaggggaucgcguucgccggccugcccauguacuccagcuucagcucccucgugcggaaggccgagcccgaguaccuguucagccccgggaucaucgccgaguccaaccacagcuccugcgacaagaagacgcugccgcucaccuggcgcggcuuccugagcauguccggggagaucgagcggaucaccggcugcaacgucuucugcacccuggccggccccggggcgagcugcgaggccuacuccgagaacggcaucuucaacaucagcuccccgaccugccucgugaacaaggugcagaaguuccgcgggagcgagcagcggaucaacuucaucucccagcgcaucgaccaggacgucaucguguacugcaacggccagaagaaggugauccugacgaagacccuggucaucgggcagugcaucuacaccuucaccagcaucuucucccucauccccagcguggcccacucccuggccguggagcugugcguccccggcauccacggcugggccacgaucgcgcucgugaucaccuucugcuucggguggcugcugauccccaccaccacgauggugguccucaagugccugcggcugcucaccuacagcugcucccacuacagcaccgagagcaaguucaaggugauccuggagaaggugaaggucgaguaccagaagaccaugggcuccauggugugcgacaucugccaccacgagugcgagacggccaaggagcuggagagccacaagaaguccugcgccgacgggcagugccccuacugcaugaccaucaccgaggccaccgagagcgcgcugcaggcccacuacgccgugugcaagcucacgggccgcuuccacgaggcccugaagaagucccugaagaagcccgagguccagcgggggugcuaccgcacccucggcguguuccgguacaagagccgcugcuacgugggccuggucuggaugugccugcucacccuggagcugaucgugugggccgcguccgccgacaccccgcuccuggagcccggguggagcgacacggcccacggcgugggggacauccccaugaagaccgaccuggagcucgacuucgccaucccguccagcuccagcuacuccuaccggcgccgccuggucaaccccgccaacagcgacgagaccgugcccuuccacuuccagcuggagcgccaggugauccacgcggagauccagucccucggccacuggauggacgccaccuucaacaucaucagcgccuuccacugcuacggcgagugcaagaaguacuccuaccccuggcagacggccaagugcuucuucgagaaggacuaccaguacgagaccagcuggagcugcaacccgcccgacugccccggggucggcaccgggugcaccgccugcggcaucuaccuggacaagcugaaguccguggggaaggcguacaaggugaucacgcucaaguacgcccggaaggucugcauccagcugggcaccgagcagaccugcaagaacaucgacgugaacgacugccuggugaccagcuccaucaaggucugcaugaucggcacgaucagcaaguuccagcccggggacacccuccuguuccugggcccgcucgaggagggcgggcuggugcugaagcaguggugcaccaccacgugcuccuucggggaccccggcgacaucaugagcaccaccuccggcaugcggugccccgagcacaccgggagcuuccgcaagaucugcggcuucgccaccacgcccgugugcgaguaccaggggaacaccgucuccggcuucaagcggcucauggccaccaaggacagcuuccaguccuucaacgugagcgaggugcacaucaccacgaccaagcuggagugguccgacccggacagcaacaucaaggaccacaucaaccugauccucaaccgcgacgucuccuuccaggaccugagcgacaaccccugcaagguggaccuguccacccaggcgaucgacggggccuggggcagcggcgugggguucacccucacgugcaucgucggccugaccgagugcuccagcuucaugaccagcaucaaggugugcgacauggccaugugcuacggggccuccguggucaaccuggugcggggcagcaacaccgugaagaucgucgggaagggcggccacuccgggagcacguuccgcugcugccacgacaaggacugcaccuccaacggccuccuggccagcgcgccccaccuggagcgggugaccggguucaaccagaucgacuccgacaagguguacgacgacggcgcgcccccgugcagcaucaagugcugguucgccaaguccggcgaguggcuccuggggauccugaacggcaacugggucguggucgccgugcucgugaucauccugcugaucagcaucuuccucuucuccuucuucugccccauccgcagccacaagaagcagcuguga

SEQ ID NO: 11657 - RNA, 3408 nt, Artificial Sequence
  derived and/or modified CDS sequence (opt1) from DOBV(DOBV/Ano-Poroia/Afl9/1999)__NC_005234.1__GP
augaucauguggggccugcuccugaccaugauccugaucgacuucggggccagccuccgcaacguguacgacaugaagaucgagugcccccacuccaucaacuucggcgagagcuccgucaccgggaagguggagcugccgccccugcuccugacggacgccgaggcccuggugcccgagagcuccugcaacauggacaaccaccagagcauguccaucauccagaaggucaccaaggugagcuggcggaagaaggccgacaaggcccaggccgccaaggacuccuucgagaccaccagcuccgaggugaaccucaagggcacgugcgcgcugagccaccgcauggucgaggaguccuaccggaaccgccggagcgugaucugcuacgaccuguccugcaacagcacccacugcaagcccaccaugcacaugaucgugccgguccacuccugcaacaugaugaaguccugccucguggggcugggccccuaccgcauccagaucguguacgagcggaccuacugcacgaccggcauccugaccgaggggaagugcuucguccccgaccaguccaucgugaacgugaucaagaacggcgucuucgacaucgccagcgugagcaucgugugcuucuucauccgcgucaaggggaccaacuacaagaucauggccuccaucaagacggccaccgcgaacaacugcaacgacaccgacaacaaggugcagggcuacuaccucugcaucgucgggggcaacagcucccccguguacgccccgagcaccacggacuuccgguccauggaggcccuggccagccugcuccgcgcgccccacggcgaggaccacgaccuguccggggaggagguggccaccuacagcaucgccggccagaucgaggggaagaucccccacaccgccaacgccgccaacaugcuguucaccgcguucuccggcauccccagcuacuccagccucuccguguucaucggcagccaggacgggccggucaucuacucccccggccuguucccccggcugaaccagagcuccugcgacaagaucgcccucccccugaucugggagggguacaucgaccugccgggcuacuacgagacggugcaccccugcaacgucuucugcgugcucagcgggcccggcgccuccugcgaggccuucagcgagggcgggaucuucaacaucaccagcccgaccugccugguguccaagcagaaccgcuuccgggccgcggagcagcaggucaacuucgugugccagcgcguggaccaggacaucgucaucuacugcaacggccagaagaagaccauccugacgaagacccucgugaucgggcagugcaucuacagcgugaccucccuguucagcaucaugcccggcgucgcccacuccaucgccaucgagcugugcgugcccggguuccacggcugggccaccgccgcgcuccugacgaccuucugcuucggcuggauccugauccucagcaucacccuggccgugcuggucgugcucaaguucuucgccgccauccugcacaacuccagccaggagaaccgguucaagaucauccugcgcaagaucaaggaggaguucgagaagaccaagggguccauggugugcgaggucugcaaguacgagugcgagacgggcaaggagcucaaggcgcacaaccugagcugcccccagucccagugccccuacugcuucacccacugcgagccgaccgagagcgccuuccaggcccacuacaaggugugccaggccacccaccgguuccgcgacgaccugaagaagacgaucacgccccaguccaccagccccgggugcuaccggacccucaaccuguuccgcuacaagucccggugcuacaucuucaccgugugggucacccugcucaucaucgagagcaucaugugggccgcguccgccagcgagaccgugcuggagcccagcuggaacgacaacgcccacggcgugggggucgugccgaugcacaccgaccuggagcuggacuucucccuccccagcuccagcaaguacaccuacaagcgcaagcugacgagcccccugaaccaggagcagagcguggaccuccacaucgagaucgagucccagggcaucagcaccuccguccacgcccugggccacugguucgacgggcgccugaaccucaagaccagcuuccacugcuacggcgccugcaccaaguacgaguacccguggcacacggcgaagugccacuucgagcgggacuucgaguacgagaacaacugggggugcaaccccgccgacugccccggcaucggcaccgggugcaccgccugcggccuguacaucgaccagcugaagcccgugggguccgccuacaagcucaucaccgugcgcuacagccggaaggucugcgugcaguucggcgaggagaaccugugcaagacgaucgacaugaacgacugcuucgugacccgccacgucaaggugugcaucaucgggaccguguccaaguucagccagggcgacacccuggucuuccucggcccgauggagggcggcgggcugaucuucaaggacuggugcacguccacgugccaguucggggaccccggggacaucaugagccccaaggacaagggcuucuccugccccgacuucaccggccacuuccggaagaagugcaacuucgccaccaccccggugugcgaguacgacgggaacauggugagcggcuacaagaaggucauggcgaccaucgacuccuuccagagcuucaacaccagcuccauccacuacaccgacgagcgcaucgaguggaaggaccccgacgggaugcugaaggaccaccucaacauccuggugacgaaggacaucgacuucgagaaccugggcgagaaccccugcaagguggggcuccagaccagcuccaucgagggcgccuggggcagcggggucggcuucacccugaccugccagaucucccugacggagugcagccgguuccucaccuccaucaaggccugcgacauggccaucugcuacggggcgcagagcgugacccugauccgcggccagaacaccgugaaggucuccgggaagggcggccacagcggguccagcuucaagugcugccacggcacggacugcucccagcaggggcugcaggccagcgcgccccaccucgacaaggugaacggcaucguggagcaggaguccgagaaggucuacgacgacggcgccccgcagugcgggaucagcugcugguucgugaaguccggcgaguggaucaccgggaucuucaacggcaacuggaucgugaucgucgugcugguguucuucuucauccugagccucauccugcugucccuccugugccccauccggaagcacaagcgcagcuga

SEQ ID NO: 11658 - RNA, 3408 nt, Artificial Sequence
  derived and/or modified CDS sequence (opt1) from DOBV(DOB/Saaremaa/160V)__AJ009774.2__GP
augaucauguggggccugcuccugaccaugagccugaucaaccucggggccucccugcgcaacguguacgacaugaagaucgagugcccccacagcaucaacuucggcgaguccagcgucaccgggaagguggagcugccgcccauccuccugacggacgccgaggcccuggugcccgaguccagcugcaacauggacaaccaccagucccucagcaucacccagaaggucaccaagguguccuggcggaagaaggccgaccaggugcaggccgccaaggacagcuucgagaccacguccaacgagaucaaccugaaggggaccugcacccugacccaccgcauggucgaggagagcuaccggaaccgcaaguccgugaucugcuacgaccucagcugcaacuccacgcacugcaagcccaccaugcacaugaucgugccgguccacagcugcaacaugaugaaguccugccugguggggcugggccccuaccgggugcaggucguguacgagcgcaccuacugcaccacgggcauccucaccgaggggaagugcuucgugcccgaccagagcaucaucuccgucaucaagaacggcguguucgacaucgccagcgugagcaucgucugcuucuucauccgggugaaggggaccuccuacaagaucauggcgagcaucaagaccuccaaccccaacaacugcaacgacacggacaacaaggugcagggcuacuaccugugcaucgucggggccaacagcuccccgguguacgcccccagcaccaccgacuuccgcuccaccgaggcccuggcgagccuccugcggagcccccacggcgaggaccacgaccuguccggcgaggagguggccacguacuccaucgccgggcagaucgagggcaagaucccccacaccgccaacgccgcgaacauggccuucaccgccuucagcgggaucccguccuacagcucccucagcgucuucgccggcaaccaggacggcaccaucaucuucucccccgggcuguuccccaagcugaaccagagcuccugcgacaagguggcccucccccugaucugggagggcuacaucgaccugccgggguacuacgagacgauccaccccugcaacgucuucugcgugcucagcggccccggggcgagcugcgaggccuucuccgagggcggcaucuucaacaucaccagcccgaccugccugguguccaagcagaaccgcuuccgggccgccgagcagcagaucaacuucgucugccagcgcguggaccaggacaucgugaucuacugcaacgggcagaagaagaccauccugacgaagacccucgucaucggccagugcaucuacagcgugaccucccuguucagcaucaugcccuccguggcccacagcaucgcgaucgagcugugcguccccggguuccacggcugggccaccgccgcccuccugacgaccuucugcuucggguggauccugauccccuccaucacccucgccgugcugaucgugcugaaguucuucgcggccauccuccacaacagcucccaggagaaccgguucaagaucauccugcgcaagaucaaggaggaguucgagaagaccaagggcagcauggucugcgaggugugcaaguacgagugcgagacgggcaaggagcugaaggcccacaaccucuccugcccccagagccagugcccguacugcuucacccacugcgagcugaccgaguccgccuuccaggcgcacuaccgggugugccaggccacccaccgcuuccgggacgaccugaagaagaccaucacgccccagagcaccucccccgggugcuaccgcacccucaaccuguuccgguacaagagccgcugcuacaucuucaccgucuggguggugcugcucaucaucgagagcauccugugggccgccuccgccagcgagcugguccuggagcccaacuggaacgacaacgcgcacggcguggggaucgugccgaugcacacggaccucgagcuggacuucucccugcccagcuccagcaaguacaccuacaagcggaagcucaccucccccaucaaccaggagcagagcaucgaccugcacaucgagaucgagucccagggcaucagcaccuccguccacgcccuggggcacugguucgacggccgccucaaccugaagacgagcuuccacugcuacggcgccugcaccaaguacgaguacccguggcacaccgccaagugccacuucgagcgcgacuucgaguacgagaacaacugguccugcaacccgcccgacugccccgggaucggcaccgggugcacggccugcggccuguaccucgaccagcugaagcccgugggcagcgcguacaagcugaucaccgugcgguacucccgcaaggucugcgugcaguucggggaggagaaccucugcaagaccaucgacaugaacgacugcuucgugacccggcacgucaaggugugcaucaucggcacggugagcaaguucucccagggggacacccuggucuuccugggccccauggagggcggcggccucaucuucaaggacuggugcaccaccacgugccaguucggggaccccggcgacaucaugagccccaaggacaagggguucuccugcccggacuucaccggccacuuccgcaagaagugcaacuucgccaccacccccgugugcgaguacgacgggaacauggugagcggcuacaagaaggucauggccacgaucgacagcuuccaggccuucaacaccuccuacauccacuacaccgacgagcagaucgaguggaaggaccccgacggcaugcugaaggaccaccugaacauccucgugaccaaggacaucgacuucgagaaccugggggagaaccccugccgggugggccugcagacggccagcaucgagggggcguggggcuccggggucggcuucacccugaccugccagaucagccucaccgagugcucccgcuuccugacgagcaucaaggccugcgacauggccaucugcuacggcgcccaguccgugacccucgugcgggggcagaacaccgucaaggugagcggcaagggcgggcacuccgggagcuccuucaagugcugccacggcaacgacugcagccagcagggccugcaggcguccgccccgcaccuggacaaggugaacgggaucgucgagcaggagagcacccagguguacgacgacggcgcgccccagugcgggaucuccugcugguucaucaagagcggcgaguggaucaagggcaucuucuccgggaacuggaucgugaucgucgugcucaucgugcuguucauccugagccucauccugcuguccuuccucugccccauccgcaagcacaagcggagcuga

SEQ ID NO: 11659 - RNA, 3408 nt, Artificial Sequence
  derived and/or modified CDS sequence (opt1) from DOBV(East Slovakia/400Af/98)__AY168577.1__GP
augaucauguggggccugcuccugaccaugauccugaucgacuucgggaccagccuccgcaacguguacgacaugaagaucgagugcccccacuccaucaacuucggcgagagcuccgucacggggaagguggagcugccgccccugcuccugaccgacgccgaggcccuggugcccgagagcuccugcaacauggacaaccaccagagcauguccaucauccagaaggucaccaaggugagcuggcggaagaaggccgacaaggcccaggccgccaaggacuccuucgagaccacgagcuccgaggugaaccucaaggggaccugcacccugagccaccgcauggucgaggaguccuaccggaaccgccggagcgugaucugcuacgaccuguccugcaacagcacccacugcaagcccacgaugcacaugaucgugccgguccacuccugcaacaugaugaaguccugccucguggggcugggccccuaccgcauccagguggucuacgagcggaccuacugcaccaccggcauccugacggaggggaagugcuucgugcccgaccagagcaucgugaacgucaucaagaacggcguguucgacaucgccagcgugagcaucgucugcuucuucauccgcgugaaggggaccaacuacaagaucauggcguccaucaagaccgccaccgccaacaacugcaacgacacggacaacaaggugcagggcuacuaccucugcaucgucgggggcaacagcucccccguguacgccccgagcaccaccgacuuccgguccauggaggcgcuggccagccugcuccgcgcgccccacggcgaggaccacgaccuguccggggaggagguggccaccuacagcaucgccggccagaucgaggggaagaucccccacacggccaacgccgccaacaugcuguucaccgccuucuccggcauccccagcuacuccagccucuccgucuacaucggcagccaggacgggccgguggucuacucccccggccuguuccccaagcugaaccagagcuccugcgacaagguggcccucccccugaucugggagggguacaucgaccugccgggcuacuacgagaccgugcaccccugcaacgucuucugcgugcucagcgggcccggcgcguccugcgaggccuucagcgagggcgggaucuucaacaucaccagccccacgugccugguguccaagcagaaccgguuccgcgccgccgagcagcaggucaacuucgugugccagcggguggaccaggacaucgucaucuacugcaacggccagaagaagaccauccugaccaagacccucgugaucgggcagugcaucuacagcgugacgucccuguucagcaucaugccgggcgucgcccacuccaucgcgaucgagcugugcgugcccggguuccacggcugggccaccgccgcccuccugaccaccuucugcuucggcuggauccugauccccagcaucacgcucgccgugcuggucgugcugaaguucuucgcggccauccuccacaacuccagccaggagaaccgcuucaagaucauccugcggaagaucaaggaggaguucgagaagaccaagggguccauggugugcgaggucugcaaguacgagugcgagaccggcaaggagcugaaggcccacaaccucagcugcccccagucccagugcccguacugcuucacccacugcgagcccacggagagcgccuuccaggcgcacuacaaggugugccaggccacccaccgcuuccgggacgaccugaagaagaccaucacgccccaguccaccagccccgggugcuaccgcacccugaaccucuuccgguacaagucccgcugcuacaucuucaccgugugggucacccugcugaucaucgagagcaucaugugggccgccuccgccagcgagaacgugcucgagccgagcuggaacgacaacgcgcacggcgugggggucgugcccaugcacaccgaccuggagcuggacuucucccugcccagcuccagcaaguacacguacaagcggaagcucaccuccccgcugaaccaggagcagagcguggaccugcacaucgagaucgagucccagggcaucagcaccuccguccacgcccucggccacugguucgacgggcgccugaaccugaagaccagcuuccacugcuacggcgccugcacgaaguacgaguaccccuggcacaccgccaagugccacuucgagcgcgacuucgaguacgagaacuccugggggugcaaccccgccgacugccccggcaucggcaccgggugcaccgcgugcggccucuacaucgaccagcugaagccgguggggagcgccuacaagcugaucacggugcgguacucccgcaaggucugcgugcaguucggcgaggagaaccucugcaagaccaucgacaugaacgacugcuucgugacccggcacgucaaggugugcaucaucgggaccgugagcaaguucucccagggcgacacgcuggucuuccugggccccauggagggcggcgggcucaucuucaaggacuggugcaccagcacgugccaguucggcgaccccggggacaucaugucccccaaggacaagggcuucagcugcccggacuucaccggccacuuccgcaagaagugcaacuucgccaccacccccgugugcgaguacgacgggaacaugguguccggcuacaagaaggucauggccaccaucgacagcuuccagagcuucaacaccuccagcauccacuacacggacgagcggaucgaguggaaggaccccgacgggaugcugaaggaccaccugaacauccucgugaccaaggacaucgacuucgagaaccugggcgagaaccccugcaagguggggcugcagaccuccagcaucgagggcgccuggggcuccggggucggcuucacccucacgugccagaucagccugaccgagugcucccgcuuccugaccagcaucaaggcgugcgacauggccaucugcuacggggcccaguccgugacccucauccggggccagaacacggugaaggucagcgggaagggcggccacuccgggagcuccuucaagugcugccacggcaccgacugcagccagcaggggcugcaggccuccgcgccgcaccuggacaaggugaacggcaucguggagcaggagagcgagaaggucuacgacgacggcgcgccccagugcgggaucuccugcugguucgucaagagcggcgaguggaucaccgggaucuucaacggcaacuggaucgugaucguggugcucaucuucuucuucauccugucccugauccuccugagccugcucugccccauccgcaagcacaagcggagcuga

SEQ ID NO: 11660 - RNA, 3408 nt, Artificial Sequence
  derived and/or modified CDS sequence (opt1) from DOBV(East Slovakia/862Aa/97)__AY168578.1__GP
augaucauguggggccugcuccugaccaugagccugaucaaccucggggccucccugcgcaacguguacgaccugcggaucgagugcccccacagcaucaacuucggcgaguccagcgucaccgggaagguggagcucccgcccaucccccugacggacgccgagacccuggugcccgaguccagcugcaacauggacaaccaccagucccucagcaucacccagaaggucaccaagguguccuggcgcaagaaggcggacaaggugcaggccgccaaggacagcuucgagacgaccuccagcgagaucaaccugaaggggaccugcacccuggcccaccggauggucgaggaguccuaccgcaaccgcaagagcgugaucugcuacgaccucuccugcaacagcacgcacugcaagccgaccauguacaugaucgugcccguccacuccugcaacaugaugaaguccugccugguggggcugggccccuaccggauccagguggucuacgagcggaccuacugcaccacgggcauccucaucgaggggaagugcuucgugcccgaccagagcaucaucagcgugaucaagaacggcgucuucgacaucgccagcguguccaucgugugcuucuucauccgcaucaaggggaacagcuacaagaucaugaccaacaucaagaccgcgaacccgaacaacugcaacgacaccgacaacaagguccagggcuacuaccugugcaucgugggggccaacuccagccccguguacgcccccuccacgaccgacuuccggagcauggagguccuggccucccuccugcgcagcccccacggcgaggaccacgaccuguccggcgaggagguggcgaccuacagcaucgccggccagguggagggcaaggucccgcacaccgagaacgccgccaacaugcuguucacggccuucuccgggauccccagcuacuccagccucuccguguucgcgggcaaccaggacggcaccgucaucuacagccccgggcuguuccccaagcucaaccaguccagcugcgagaagguggcccugccgcugaucugggagggcuacaucgaccuccccggguacuacgagaccauccaccccugcaacguguucugcguccuguccggccccggggccagcugcgaggccuucagcgagggcggcaucuucaacaucaccuccccgacgugccuggugagcaagcagaaccgguuccgcgccgcggagcagcagaucaacuucgugugccagcgggucgaccaggacaucgugaucuacugcaacgggcagaagaagaccauccucaccaagacccuggugaucggccagugcaucuacuccgucacgagccuguucuccaucaugcccgggguggcccacagcaucgccaucgagcucugcgugcccggcuuccacgggugggccaccgccgcgcugcugaccaccuucugcuucggcuggauccucauccccuccaucacgcuggccauccugaucguccucaaguucuucgccgccauccugcacaacagcucccaggagaaccgcuucaaggugauccugcggaagaucaaggaggaguucgagaagaccaagggcagcauggugugcgaggucugcaaguacgagugcgagaccgggaaggagcucaaggcccacaaccuguccugcccgcagagccagugccccuacugcuucacccacugcgagcugacggaguccgcguuccaggcccacuaccgcgugugccaggccacccaccgguuccgcgacgaccucaagaagaccaucacgccccagagcaccucccccggcugcuaccggacgcugaaccuguuccgcuacaagagccggugcuacaucuucaccgugugggucgugcuccugaucaucgaguccauccugugggccgcgagcgccagcgagaucgugcuggagccguccuggaacgacaacgcccacggggucggcguggugcccaugcacaccgaccucgagcuggacuucagccugcccuccagcuccaaguacaccuacaagcgcaagcucacgagcccgaucaaccaggagcaguccgucgaccugcacaucgagaucgagagccagcgcaucuccaccagcgugcacgcccuggggcacugguucgacggccggcucaaccugaagaccuccuuccacugcuacggcgccugcaccaaguacgaguaccccuggcacacggcgcgcugccacuucgagcgggacuucgaguacgagaacagcugguccugcaaccccgccgacugccccgggaucggcaccgggugcaccgccugcggccuguaccucgaccagcugaagccggugggcagcgccuacaagcugaucaccguccgcuacucccggaaggugugcgugcaguucggggaggagaaccucugcaagaucaucgacaugaacgacugcuucgucagccgccacgugaaggugugcaucaucggcacggucuccaaguucagccagggggacacccugguguuccugggccccauggagggcgggggccucaucuucaaggacuggugcaccaccacgugccaguucggggaccccggcgacaucaugucccccaaggacaagggguucagcugcccggacuucaccggccacuuccggaagaagugcaacuucgccaccacccccgugugcgaguacgacgggaacauggucagcggcuacaagaaggugauggcgacgaucgacuccuuccaggccuucaacaccagcuacauccacuacaccgacgagcgcaucgaguggaaggaccccgacggcaugcugaaggaccacaucaacauccuggugaccaaggacaucgacuucgagaaccucggggagaaccccugcaaggucggccugcagacggccuccaucgagggggccuggggcagcggggugggcuucacccugaccugccagaucucccucaccgagugcagccgguuccugacguccaucaaggccugcgacauggcgaucugcuacggcgcccagagcgugacccugguccgcgggcagaacaccgugaagguguccggcaagggcgggcacagcggguccagcuucaagugcugccacggcaccgacugcucccagcagggccuccaggccagcgccccgcaccuggacaaggucaacgggaucguggagcaggaguccacccagguguacgacgacggcgcgccccagugcgggaucagcugcugguucaucaaguccggcgaguggaucaagggcaucuucaacgggaacuggaucgucaucguggugcugaucuucuucuucauccucagccugauccugcucuccuuccugugccccauccggaagcacaagcgcagcuga

SEQ ID NO: 11661 - RNA, 3408 nt, Artificial Sequence
  derived and/or modified CDS sequence (opt1) from DOBV(A35)__GU904036.1__GP
augaucauguggggccugcuccugacccugagccucaucucccugggggccagccugcgcaacguguacgaccuccggaucgagugcccccacuccaucaacuucggcgagagcuccgucaccgggaagguggagcugccgcccaucccccugacggacgccgagacccucgugcccgagagcuccugcaacauggacaaccaccagagccuguccaucacccagaaggucaccaaggugagcuggcgcaagaaggcggacaaggugcaggccgccaaggacuccuucgagacgaccagcuccgagaucaaccugaaggggaccugcacccucgcccaccggauggucgaggagagcuaccgcucccgcaagagcgugaucugcuacgaccuguccugcaacagcacgcacugcaagccgaccauguacaugaucgugcccguccacuccugcaacaugaugaaguccugccugguggggcucggccccuaccggauccagguggucuacgagcggaccuacugcaccacgggcauccugaucgaggggaagugcuucgugcccgaccagagcaucaucagcgugaucaagaacggcgucuucgacaucgccagcguguccaucgugugcuucuucauccgcaucaaggggaacagcuacaagaucaugaccaacaucaagaccgcgaacccgaacaacugcaacgacaccgacaacaagguccagggcuacuaccugugcaucgugggggccaacuccagccccguguacgcccccuccacgaccgacuuccggagcauggagguccucgccucccugcugcgcagcccccacggcgaggaccacgaccucuccggcgaggagguggcgaccuacagcaucgccggccagguggagggcaaggucccgcacaccgagaacgccgccaacaugcuguucacggccuucuccgggauccccagcuacuccagccuguccguguucgcgggcaaccaggacggcaccgucaucuacagccccggccucuuccccaagcugaaccaguccagcugcgagaagguggcccugccgcucaucugggagggguacaucgaccugcccggguacuacgagaccauccaccccugcaacguguucugcguccugagcggccccggggccuccugcgaggccuucagcgagggcggcaucuucaacaucaccuccccgacgugccucgugagcaagcagaaccgguuccgcgccgcggagcagcagaucaacuucgugugccagcgggucgaccaggacaucgugaucuacugcaacgggcagaagaagaccauccugaccaagacccuggugaucggccagugcaucuacuccgucacgagccucuucuccaucaugcccgggguggcccacagcaucgccaucgagcugugcgugcccggcuuccacgggugggccaccgccgcgcugcucaccaccuucugcuucggcuggauccugauccccuccaucacgcuggccauccucaucguccugaaguucuucgccgccauccugcacaacagcucccaggagaaccgcuucaaggugauccuccggaagaucaaggaggaguucgagaagaccaagggcagcauggugugcgaggucugcaaguacgagugcgagaccgggaaggagcugaaggcccacaaccuguccugcccgcagagccagugccccuacugcuucacccacugcgagcucacggaguccgcguuccaggcccacuaccgcgugugccaggccacccaccgguuccgcgacgaccugaagaagaccaucacgccccagagcaccucccccggcugcuaccggacgcugaaccucuuccgcuacaagagccggugcuacaucuucaccgugugggucgugcugcugaucaucgagagcauccugugggccgcguccgccagcgagaucgugcucgagccguccuggaacgacaacgcccacggggucggcguggugcccaugcacaccgaccuggagcuggacuucagccuccccuccagcuccaaguacaccuacaagcgcaagcugacgagcccgaucaaccaggagcaguccgucgaccugcacaucgagaucgagagccagcgcaucuccaccagcgugcacgcccucgggcacugguucgacggccggcugaaccugaagaccuccuuccacugcuacggcgccugcaccaaguacgaguaccccuggcacacggcgcgcugccacuucgagcgggacuucgaguacgagaacagcugguccugcaaccccgccgacugccccgggaucggcaccgggugcaccgccugcggccucuaccuggaccagcugaagccggugggcagcgccuacaagcucaucaccguccgcuacucccggaaggugugcgugcaguucggggaggagaaccugugcaagaucaucgacaugaacgacugcuucgucagccgccacgugaaggugugcaucaucggcacggucuccaaguucagccagggggacacccugguguuccucggccccauggagggcgggggccugaucuucaaggacuggugcaccaccacgugccaguucggggaccccggcgacaucaugagccccaaggacaagggguucuccugcccggacuucaccggccacuuccggaagaagugcaacuucgccaccacccccgugugcgaguacgacgggaacauggucagcggcuacaagaaggugauggcgacgaucgacuccuuccaggccuucaacaccagcuacauccacuacaccgacgagcgcaucgaguggaaggaccccgacggcaugcugaaggaccacaucaacauccucgugaccaaggacaucgacuucgagaaccugggggagaaccccugcaaggucggccugcagacggccuccaucgagggggccuggggcagcggggugggcuucacccugaccugccagaucucccucaccgagugcagccgguuccugacguccaucaaggccugcgacauggcgaucugcuacggcgcccagagcgugacccucguccgcgggcagaacaccgugaagguguccggcaagggcgggcacagcggguccagcuucaagugcugccacggcaccgacugcucccagcagggccugcaggccagcgccccgcaccuggacaaggucaacgggaucguggagcaggaguccacccagguguacgacgacggcgcgccccagugcgggaucagcugcugguucaucaaguccggcgaguggaucaagggcaucuucaacgggaacuggaucgucaucguggugcucaucuucuucuucauccugagccugauccuccugagcuuccugugccccauccggaagcacaagcgcuccuga

SEQ ID NO: 11662 - RNA, 3408 nt, Artificial Sequence
  derived and/or modified CDS sequence (opt1) from DOBV(A6)__GU904033.1__GP
augaucauguggggccugcuccugaccaugauccugaucgacuucggggccagccuccgcaacguguacgacaugaagaucgagugcccccacuccaucaacuucggcgagagcuccgucaccgggaagguggagcugccgccccugcuccugacggacgccgaggcccuggugcccgagagcuccugcaacauggacaaccaccagagcauguccaucauccagaaggucaccaaggugagcuggcggaagaaggccgacaaggcccaggccgccaaggacuccuucgagaccaccagcuccgaggugaaccucaagggcacgugcacccugagccaccgcauggucgaggaguccuaccggaaccgccggagcgugaucugcuacgaccuguccugcaacagcacccacugcaagcccaccaugcacaugaucgugccgguccacuccugcaacaugaugaaguccugccucguggggcugggccccuaccgcauccagguggcguacgagcggacguacugcaccaccggcauccugaccgaggggaagugcuucguccccgaccagagcaucgugagcgugaucaagaacggcgucuucgacaucgccagcguguccaucgugugcuucuucauccgcgucaaggggacgaacuacaagaucauggccagcaucaagaccgccaccgcgaacaacugcaacgacaccgacaacaaggugcagggcuacuaccucugcaucgucgggggcaacuccagccccguguacgccccguccacgaccgacuuccggagcauggaggcccuggccucccugcuccgcgcgccccacggcgaggaccacgaccugagcggggaggagguggccaccuacuccaucgccggccagaucgaggggaagaucccccacaccgccaacgccgccaacaugcuguucacggcguucagcggcauccccuccuacagcucccucagcguguucaucggcucccaggacgggccgaucaucuacagccccggccuguuccccaagcugaaccaguccagcugcgacaaggucgcccucccccugaucugggagggguacaucgaccugccgggcuacuacgagaccgugcaccccugcaacgucuucugcgugcucuccgggcccggcgccagcugcgaggccuucagcgagggcgggaucuucaacaucaccuccccgaccugccuggugagcaagcagaaccgguuccgcgccgcggagcagcaggucaacuucgugugccagcggguggaccaggacaucaucaucuacugcaacggccagaagaagacgauccugaccaagacccucgucaucgggcagugcaucuacuccgugaccagccuguucuccaucaugcccggcguggcccacagcaucgccaucgagcugugcguccccggguuccacggcugggccacggccgcgcuccugaccaccuucugcuucggcuggauccugauccccuccaucacccucgccgugcuggugguccugaaguucuucgccgccauccuccacaacagcucccaggagaaccgcuucaagaucauccugcggaagaucaaggaggaguucgagaagacgaaggggagcauggugugcgaggugugcaaguacgagugcgagaccggcaaggagcugaaggcgcacaaccucuccugcccccagagccagugcccguacugcuucacccacugcgagcccaccgaguccgccuuccaggcccacuacaaggucugccaggccacgcaccgcuuccgggacgaccugaagaagaccaucacgccccagagcaccucccccgggugcuaccgcacccugaaccucuuccgguacaagagccgcugcuacaucuucaccgugugggugacccugcugaucaucgaguccaucaugugggccgcgagcgccagcgagaacguccucgagccguccuggaacgacaacgcccacggcgugggggugguccccaugcacaccgaccuggagcuggacuucagccugcccuccagcuccaaguacaccuacaagcggaagcucacgagcccgcugaaccaggagcaguccguggaccugcacaucgagaucgagagccagggcaucuccaccagcgugcacgcccucggccacugguucgacgggcgccugaaccugaagaccuccuuccacugcuacggcgccugcaccaaguacgaguaccccuggcacacggcgaagugccacuucgagcgcgacuucgaguacgagaacagcugggggugcaaccccgccgacugccccggcaucggcaccgggugcaccgccugcggccucuacaucgaccagcugaagccggucggguccgccuacaagcugaucaccgugcgguacagccgcaaggugugcguccaguucggcgaggagaaccucugcaagacgaucgacaugaacgacugcuucgugacccggcacgugaaggucugcaucaucgggaccguguccaaguucagccagggcgacacccugguguuccugggccccauggucgggggcgggcucaucuucaaggacuggugcacguccacgugccaguucggcgaccccggggacaucaugagccccaaggacaagggcuucuccugcccggacuucaccggccacuuccgcaagaagugcaacuucgccaccacccccgugugcgaguacgacgggaacauggugagcggcuacaagaaggucauggcgaccaucgacagcuuccaguccuucaacaccagcuccauccacuacaccgacgagcggaucgaguggaaggaccccgacgggaugcugaaggaccaccugaacauccucgugacgaaggacaucgacuucgagaaccugggcgagaaccccugcaagguggggcugcagaccagcuccaucgagggcgccuggggcagcggggucggcuucacccugaccugccagaucucccucacggagugcagccgcuuccugaccuccaucaaggccugcgacauggccaucugcuacggggcgcagagcgugacccucauccggggccagaacaccgugaaggucuccgggaagggcggccacagcggguccagcuucaagugcugccacggcacggacugcucccagcaggggcugcaggccagcgccccgcaccuggacaaggugaacggcaucguggagcaggacuccgagaaggucuacgacgacggcgcgccccagugcgggaucagcugcugguucgugaaguccggcgaguggaucaccgggaucuucaacggcaacuggaucgugaucgucgugcucguguucuucuucauccugagccugauccuccugagccugcucugccccauccgcaagcacaagcgguccuga

SEQ ID NO: 11663 - RNA, 3408 nt, Artificial Sequence
  derived and/or modified CDS sequence (opt1) from DOBV(B13)__GU904034.1__GP
augaucauguggggccugcuccugaccaugauccugaucgacuucggggccagccuccgcaacguguacgacaugaagaucgagugcccccacuccaucaacuucggcgagagcuccgucaccgggaagguggagcugccgccccugcuccugacggacgccgaggcccuggugcccgagagcuccugcaacauggacaaccaccagagcauguccaucauccagaaggucaccaaggugagcuggcggaagaaggccgacaaggcccaggccgccaaggacuccuucgagaccaccagcuccgaggugaaccucaagggcacgugcacccugagccaccgcauggucgaggaguccuaccggaaccgccggagcgugaucugcuacgaccuguccugcaacagcacccacugcaagcccaccaugcacaugaucgugccgguccacuccugcaacaugaugaaguccugccucguggggcugggccccuaccgcauccagguggucuacgagcggacguacugcaccaccggcauccugaccgaggggaagugcuucgugcccgaccagagcaucgugagcgucaucaagaacggcguguucgacaucgcgagcguguccaucgucugcuucuucauccgcgugaaggggacgaacuacaagaucauggccagcaucaagaccgccaccgccaacaacugcaacgacaccgacaacaaggugcagggcuacuaccucugcaucgucgggggcaacuccagccccguguacgcgccguccacgaccgacuuccggagcauggaggcccuggccucccugcuccgcgcgccccacggcgaggaccacgaccugagcggggaggagguggccaccuacuccaucgccggccagaucgaggggaagaucccccacaccgccaacgccgccaacaugcuguucacggccuucagcggcauccccuccuacagcucccucagcgucuucaucggcucccaggacgggccgaucaucuacagccccggccuguuccccaagcugaaccaguccagcugcgacaagguggcgcucccccugaucugggagggguacaucgaccugccgggcuacuacgagaccguccaccccugcaacguguucugcgugcucuccgggcccggcgccagcugcgaggccuucagcgagggcgggaucuucaacaucaccuccccgaccugccuggucagcaagcagaaccgguuccgcgccgccgagcagcaggucaacuucgugugccagcggguggaccaggacaucaucaucuacugcaacggccagaagaagacgauccugaccaagacccucgugaucgggcagugcaucuacuccgugaccagccuguucuccaucaugcccggcgucgcgcacagcaucgccaucgagcugugcgugcccggguuccacggcugggccacggccgcccuccugaccaccuucugcuucggcuggauccugauccccuccaucacccucgcggugcuggucgugcugaaguucuucgccgccauccuccacaacagcucccaggagaaccgcuucaagaucauccugcggaagaucaaggaggaguucgagaagacgaaggggagcauggugugcgaggucugcaaguacgagugcgagaccggcaaggagcugaaggcccacaaccucuccugcccccagagccagugcccguacugcuucacccacugcgagcccaccgaguccgcguuccaggcccacuacaaggugugccaggccacgcaccgcuuccgggacgaccugaagaagaccaucacgccccagagcaccucccccgggugcuaccgcacccugaaccucuuccgguacaagagccgcugcuacaucuucaccgugugggucacccugcugaucaucgaguccaucaugugggccgccagcgcgagcgagaacgugcucgagccguccuggaacgacaacgcccacggcgugggggucgugcccaugcacaccgaccuggagcuggacuucagccugcccuccagcuccaaguacaccuacaagcggaagcucacgagcccgcugaaccaggagcaguccguggaccugcacaucgagaucgagagccagggcaucuccaccagcguccacgcccucggccacugguucgacgggcgccugaaccugaagaccuccuuccacugcuacggcgccugcaccaaguacgaguaccccuggcacacggccaagugccacuucgagcgcgacuucgaguacgagaacagcugggggugcaaccccgcggacugccccggcaucggcaccgggugcaccgccugcggccucuacaucgaccagcugaagccggugggguccgccuacaagcugaucaccgugcgguacagccgcaaggucugcgugcaguucggcgaggagaaccucugcaagacgaucgacaugaacgacugcuucgugacccggcacgucaaggugugcaucaucgggaccguguccaaguucagccagggcgacacccuggucuuccugggccccauggucgggggcgggcucaucuucaaggacuggugcacguccacgugccaguucggcgaccccggggacaucaugagccccaaggacaagggcuucuccugcccggacuucaccggccacuuccgcaagaagugcaacuucgccaccacccccgugugcgaguacgacgggaacauggugagcggcuacaagaaggugauggccaccaucgacagcuuccaguccuucaacaccagcuccauccacuacaccgacgagcggaucgaguggaaggaccccgacgggaugcugaaggaccaccugaacauccucgugacgaaggacaucgacuucgagaaccugggcgagaaccccugcaaggucgggcugcagaccagcuccaucgagggcgcguggggcagcggggugggcuucacccugaccugccagaucucccucacggagugcagccgcuuccugaccuccaucaaggccugcgacauggccaucugcuacggggcccagagcgugacccucauccggggccagaacaccgucaagguguccgggaagggcggccacagcggguccagcuucaagugcugccacggcacggacugcucccagcaggggcugcaggcgagcgccccgcaccuggacaaggugaacggcaucgucgagcaggacuccgagaagguguacgacgacggcgcgccccagugcgggaucagcugcugguucgugaaguccggcgaguggaucaccgggaucuucaacggcaacuggaucgucaucguggugcucgucuucuucuucauccugagccugauccuccugagccugcucugccccauccgcaagcacaagcgguccuga

SEQ ID NO: 11664 - RNA, 3408 nt, Artificial Sequence
  derived and/or modified CDS sequence (opt1) from DOBV(Aa1854/Lipetsk-02)__EU188453.1__GP
augaucauguggggccugcuccugaccauggcccugaucaaccccggggccacccuccgcaacguguacgacaugcggaucgagugcccgcacagcaucaacuucggcgaguccagcgucacggggaagguggagcugccgcccaucccccuggccgacgccgagacccucgugcccgaguccagcugcaacauggacaaccaccagucccugagcaucacccagaaggucaccaagguguccuggcgcaagaaggccgacaaggugcaggccgccaaggacagcuucgagacgaccuccagcgagaucaaccugaaggggaccugcacccucacgcaccggauggucgaggaguccuaccgcaaccgcaagagcgugaucugcuacgaccuguccugcaacagcacccacugcaagcccaccaugcacaugaucgugcccguccacuccugcaacaugaugaaguccugccuggugggccucggccccuaccggauccagguggucuacgagcggaccuacugcacgaccggcauccugaccgaggggaagugcuucgugccggaccagagcaucgugagcgucaucaagaacggcguguucgacaucgccuccgugagcaucgucugcuucuucauccgcaucaaggggaacagcuacaagaucauggccuccaucaaggaggccaaccccaacaacugcaacgacaccgacaacaaggugcagggcuacuaccugugcaucgugggggccaacagcucccccgucuacgcgcccagcacgaccgacuuccgguccguggaggcccucgccagccugcugcgcuccccgcacggcgaggaccacgaccucagcggcgaggagguggccaccuacuccaucgccgggcaggucgagggcaaggugccccacaccgcgaacgccgccaacaugcuguucacggccuucagcgggauccccucccacagcuccuucagcgucuucaccggcaaccaggacggcaccgugaucuacucccccgggcuguucccgaagcucaaccagagcgccugcgacaagguggcgcugccccugaucugggagggcuacaucgaccuccccggguacuacgagaccauccaccccugcaacgucuucugcgugcuguccggcccgggggccagcugcgaggccuucuccgagggcggcaucuucaacaucacgagcccgaccugccuggugagcaagcagaaccgguuccgcgccgccgagcagcagaucaacuucgucugccagcggguggaccaggacaucgugaucuacugcaacgggcagaagaagaccauccucaccaagacgcuggucaucggccagugcaucuacuccgugaccagccuguucuccaucaugcccgggguggcgcacagcaucgccaucgagcucugcguccccggcuuccacgggugggccaccgccgcccugcugaccacguucugcuucggcuggauccucauccccuccaucacccuggcgauccugaucgugcucaaguucuucgccgccauccugcacaacagcucccaggagaaccgcuucaagaucauccugcggaagaucaaggaggaguucgagcgcaccaagggcagcauggugugcgaggucugcaaguacgagugcgagaccgggaaggagcucaaggcccacaaccuguccugcccccagagccagugccccuacugcuucacgcacugcgagcugaccgaguccgcguuccaggcccacuaccgggugugccaggccacccaccgcuuccgggacgaccucaagaagaccaucacgccccagagcaccuccccgggcugcuaccgcacccugaaccuguuccgguacaagagccgcugcuacaucuucaccgugugggucgugcuccugaucaucgaguccauccugugggccgccagcgcguccgagaccgugcucgagcccaacuggaacgacaacgcccacggggucggcguggugcccaugcacacggaccuggagcuggacuucagccugccgagcuccagcaaguacaccuacaagcgcaagcucaccucccccaucaaccaggagcagagcgucgaccugcacaucgagguggagucccaggggaucagcaccuccgugcacgcccugggccacugguucgacggccggcucaaccugaagacgagcuuccacugcuacggggccugcaccaaguacgaguaccccuggcacaccgcccgcugccacuucgagcgggacuucgaguacgagaacuccuggagcugcaaccccgcggacugcccgggcaucgggaccggcugcacggccugcggccuguaccucgaccagcugaagcccgucggguccgccuacaagcugaucaccgugcgcuacagccggcgcgugugcguccaguucggcgaggagaaccucugcaagaccaucgacaugaacgacugcuucgugacccggcacgugaaggucugcaucaucgggacgguguccaaguucagccagggcgacacccugguguuccuggggcccauggagggcggcgggcucaucuucaaggacuggugcaccaccacgugccaguucggcgaccccggggacaucauguccccgaaggacaagggcuucagcugccccgacuucaccgggcacuuccgcaagaagugcaacuucgccaccacccccgucugcgaguacgacggcaacaugguguccggcuacaagaaggugauggccacgaucgacagcuuccaggcguucaacaccuccaacauccacuacaccgacgagcggaucgaguggaaggaccccgacgggaugcugaaggaccaccugaacauccucgucaccaaggacaucgacuucgagaaccugggcgagaacccgugcaagguggggcugcagacggccagcaucgagggcgccugggggagcggcgugggcuucacccugaccugccagaucucccucaccgagugcagccgcuuccugacguccaucaaggccugcgacauggcgaucugcuacggggcccagagcgucacccucgugcggggccagaacaccgugaaggucuccgggaagggcgggcacagcggcuccagcuucaagugcugccacggcaccgacugcucccagcaggggcugcaggccagcgcgccccaccuggacaaggugaacggcaucguggagcaggaguccacgcaggucuacgacgacggggcgccccagugcggcaucagcugcugguucaucaaguccggcgaguggaucaaggggaucuucaacggcaacuggaucgugaucgugguccucaucuucuucuucauccugagccugauccuccuguccuuccugugccccauccgcaagcacaagcggagcuga

SEQ ID NO: 11665 - RNA, 3402 nt, Artificial Sequence
  derived and/or modified CDS sequence (opt1) from DOBV(Ap/Sochi/hu)__JF920149.1__GP
auguggggccugcuccugaccaugauccugaucgacuucggggccacccuccgcaacguguacgacaugcggaucgagugcccccacagcgucaacuucggcgaguccagcguguccgggaagguggagcugccgcccguccugcucagcgagguggagacgcuggugcccgaguccagcugcaacauggacaaccaccaguccaugagcaucauccagaaggucacccagcugaccuggcgcaagaaggccgacaaggcccaggccgccaaggacuccuucgagaucaccagcggcgaggugucccucaaggggacgugcacccugacccaccggaugguggaggacagccaccgcaaccggaaguccaucaucugcuacgaccugagcugcaacuccacccacugcaagcccacgaugcacaugaucgucccgauccacagcugcaacaugaugaaguccugccucgugggccugggccccuaccgcauccagguggucuacgagcggaccuacugcaccaccgggauccugacggagggcaagugcuucgugcccgaccagagcaucgugaacgucaucaagaacgggguguucgacaucgccuccgugagcaucgucugcuucuucgugcgcgugaagggcaccaacuacaagaucauggccagcaucaagaccgcgaccuccaacaacugcaacgacacggggaacaagguccagggcuacuaccucugcaucgugggcgggaacagcucccccguguacgucccgagcaccaccgacuuccgguccauggaggcccuggccagcaugcugcgcgcgccccacggcgaggaccacgaccucgccggggaggagguggccaccuacuccaucgccggccaggucgagggcaaggugccccacacggccagcaccgccaacaugcugcugaccgcguucuccgggauccccagcuacuccagccucuccguguucaccggcagccaggacgggccgaucgucuacucccccggccuguuccccaagcugaaccagagcuccugcgacaagguggggcucccccugaucugggagggcuacaucgaccugccgggcuacuacgagacggugcaccagugcaacgucuucugcgugcucagcgggcccggcgccuccugcgaggccuucagcgagggcgggaucuucaacaucaccagccccaacugcaugguguccaagcagaaccgguuccgcgccgccgagcagcaggucaacuucgcgugccagcggguggaccaggacauccugaucuucugcaacgggcagaagaagaccauccugaccaagacgcucgugaucggccagugcaucuacagcaucaccucccuguucagcaucaugcccggcgucgcccacuccaucgccaucgagcugugcgugccgggguuccacggcugggccaccgccgcgcuccugaccacguucugcuucgggugggugcugauccccagcaucacccucgccguccugguggugcugaaguucuucgccgccauccuccacaacuccagccaggagaaccgcuucaagcugauccugaagaagaucaaggaggaguucgagaagaccaagggcuccauggucugcgaggugugcaaguacgagugcgagaccgggaaggagcucaaggcccacaaccugagcugcccccagucccagugccccuacugcuucacgcacugcgagccgaccgagagcgcguuccaggcccacuacaaggugugccaggccacccaccgguuccgcgacgaccugaagaagaccaucacgccccaguccaccagccccggcugcuaccggacccucaaccuguuccgcuacaagucccggugcuacaucuucaccgucuggguggugcugcucgucguggagagcgugaugugggccgcguccgccagcgagaccguccuggagcccagcuggaacgacaacgcccacggcguggggguggucccgaugcacacggaccuggagcuggacuucucccuccccagcuccagcaaguacaccuacaagcgcaagcugaccucccccaucaaccaggagcagagcguggaccugcacaucgagaucgagucccagggcaucagcaccuccgugcacgcccucgggcacugguucgacggccggcugaaccugaagacgagcuuccacugcuacggcgccugcaccaaguacgaguacccguggcacaccgcgcgcugccacuucgagcgcgacuucgaguacgagaacuccugggggugcaaccccgccgacugccccggcaucgggaccggcugcacggccugcgggaucuacaucgaccagcucaagcccgucggcagcgccuacaagcugaucaccgugcgguacucccgcaaggugugcguccaguucggcgaggagaaccugugcaagaccaucgacaugaacgacugcuucgugacccggcacgugaaggucugcaucaucgggacggugagcaaguucucccagggcgacacccucguguuccuggggccgauggagggcgggggccugaucuucaaggacuggugcaccagcacgugccaguucggcgaccccggggacaucaugucccccaaggacaagggcuucagcugccccgaguucaccgggcacuuccgcaagaagugcaacuucgccaccaccccggucugcgaguacgacggcaacaugguguccggguacaagaaggugauggcgaccaucgacagcuuccaggccuucaacacgagcuccauccacuacaccgacgagcggaucgaguggaaggaccccgacggcaugcucaaggaccaccugaacauccuggucaccaaggacaucgacuucgagaaccucggcgacaaccccugcaagguggggcugcagaccgugagcaucgagggcgccuggggguccggcgucggguucacgcugaccugccaggugagccucaccgagugcucccgcuuccugaccagcaucaaggccugcgacaaggccaucugcuacggcgcgcaguccagcacgcugauccggggccagaacaccgugaaggucuccgggaagggcgggcacagcggcuccagcuucaagugcugccacggcaccgacugcucccagcaggggcuccaggccagcgcgccccaccuggacaagaucaacggcaucguggagcaggagaacgagaaggucuacgacgacggggccccgcagugcggcaucuccugcugguucgucaagagcggggaguggauccagggcaucuucaacggcaacuggaucgugaucguggugcugaucuucuucuucauccucucccugauccugcucagcaucuucugccccauccgcaagcacaagcgguccuga

SEQ ID NO: 11666 - RNA, 3402 nt, Artificial Sequence
  derived and/or modified CDS sequence (opt1) from DOBV(Ap1584/Sochi-01)__EU188450.1__GP
auguggggccugcuccugaccaugauccugaucgacuucggggccacccuccgcaacguguacgacaugcggaucgagugcccccacagcgucaacuucggcgaguccagcguguccgggaagguggagcugccgcccguccugcucagcgagguggagacgcuggugcccgaguccagcugcaacauggacaaccaccaguccaugagcaucauccagaaggucacccagcugaccuggcgcaagaaggccgacaaggcgcaggccgccaaggacuccuucgagaucaccagcggcgaggugucccucaaggggacgugcacccugacccaccggaugguggaggacagccaccgcaaccggaaguccaucaucugcuacgaccugagcugcaacuccacccacugcaagcccacgaugcacaugaucgucccgauccacagcugcaacaugaugaaguccugccucgugggccugggccccuaccgcauccagguggucuacgagcggaccuacugcaccaccgggauccugacggagggcaagugcuucgugcccgaccagagcaucgugaacgucaucaagaacgggguguucgacaucgccuccgugagcaucgucugcuucuucgugcgcgugaagggcaccaacuacaagaucauggccagcaucaagaccgcgaccuccaacaacugcaacgacacggggaacaagguccagggcuacuaccucugcaucgugggcgggaacagcucccccguguacgucccgagcaccaccgacuuccgguccauggaggcccuggccagcaugcugcgcgcgccccacggcgaggaccacgaccucgccggggaggagguggccaccuacuccaucgccggccaggucgagggcaaggugccccacacggccaacgccgcgaacaugcugcugaccgccuucagcggggugcccuccuacagcucccucagcgucuucaccggcucccaggacgggccgaucguguacagccccggccuguuccccaagcugaaccaguccagcugcgacaagguggggcucccccugaucugggagggcuacaucgaccugccgggcuacuacgagaccguccaccagugcaacguguucugcgugcucuccgggcccggcgccagcugcgaggccuucuccgagggcgggaucuucaacaucacgagccccaacugcauggucagcaagcagaaccgguuccgcgccgcggagcagcaggucaacuucgccugccaguccguggaccaggacauccugaucuucugcaacgggcagaagaagaccauccugaccaagacccucgugaucggccagugcaucuaccccaucacgagccuguucuccaucaugccgggcguggcccacagcaucgccaucgagcugugcgugcccggguuccacggcugggccaccgcggcccuccugaccaccuucugcuucggguggguccugauccccuccaucacgcucgccgugcuggugguccugaaguucuucgccgccauccuccacaacagcucccaggagaaccgguucaagcugauccugaagaagaucaaggaggaguucgagaagaccaagggcagcauggugugcgaggugugcaaguacgagugcgagaccgggaaggagcucaaggcgcacaaccuguccugcccccagagccagugcccguacugcuucacccacugcgagcccacggaguccgccuuccaggcccacuacaaggucugccaggccacccaccgcuuccgggacgaccugaagaagaccaucacgccccagagcaccucccccggcugcuaccgcacccucaaccuguuccgguacaagagccgcugcuacaucuucaccgugugggugguccugcucgugguggaguccgucaugugggcggccagcgccuccgagaccgugcuggagccgagcuggaacgacaacgcccacggcgugggggucgugcccaugcacaccgaccuggagcuggacuucagccuccccuccagcuccaaguacacguacaagcggaagcugaccagcccgaucaaccaggagcaguccguggaccugcacaucgagaucgagagccagggcaucuccaccagcguccacgcccucgggcacugguucgacggccgccugaaccugaagaccuccuuccacugcuacggcgcgugcacgaaguacgaguaccccuggcacaccgcccggugccacuucgagcgcgacuucgaguacgagaacagcugggggugcaaccccgccgacugccccggcaucgggaccggcugcaccgccugcgggaucuacaucgaccagcucaagccggugggcuccgccuacaagcugaucacggugcgcuacagccggaaggucugcgugcaguucggcgaggagaaccugugcaagaccaucgacaugaacgacugcuucgugacccgccacgucaaggugugcaucaucgggaccguguccaaguucagccagggcgacacgcucgucuuccuggggcccauggagggcgggggccugaucuucaaggacuggugcaccuccacgugccaguucggcgaccccggggacaucaugagccccaaggacaagggcuucuccugcccggaguucaccgggcacuuccggaagaagugcaacuucgcgaccacccccgugugcgaguacgacggcaacauggugagcggguacaagaaggucauggccaccaucgacuccuuccaggccuucaacaccagcagcauccacuacacggacgagcgcaucgaguggaaggaccccgacggcaugcucaaggaccaccugaacauccuggugaccaaggacaucgacuucgagaaccucggcgacucccccugcaagguggggcugcagaccgucagcaucgagggcgccuggggguccggcgugggguucacccugacgugccaggugagccucaccgagugcucccgguuccugaccagcaucaaggccugcgacaaggcgaucugcuacggcgcccaguccagcacccugauccgcggccagaacacggucaagguguccgggaagggcgggcacagcggcuccagcuucaagugcugccacggcaccgacugcucccagcaggggcuccaggccagcgccccgcaccuggacaagaucaacggcaucgucgagcaggagaacgagaagguguacgacgacggggcgccccagugcggcaucuccugcugguucgucaagagcggggaguggauccagggcaucuucaacggcaacuggaucgugaucguggugcugaucuucuucuucauccucucccugauccugcucagcaucuucugccccauccggaagcacaagcgcuccuga

SEQ ID NO: 11667 - RNA, 3408 nt, Artificial Sequence
  derived and/or modified CDS sequence (opt1) from DOBV(GER/05/477/Af)__GQ205411.1__GP
augaucauguggggccugcuccugacccugagccucaucaaccugggggccucccugcgcaacguguacgacaugaagaucgagugcccccacagcaucaacuucggcgaguccagcgucaccgggaagguggagcucccgccccugcugcucacggacgccgaggcccuggugcccgaguccagcugcaacauggacaaccaccagucccugagcaucacccagaaggucaccaagguguccuggcggaagaaggccgacaaggugcaggccgccaaggacagcuucgagaccacguccagcgaggucaacuucaaggggaccugcacccucacccaccgcaugguggaggaguccuaccggaaccgcaagagcgugaucugcuacgaccuguccugcaacagcacgcacugcaagcccaccaugcacaugaucgucccggugcacuccugcaacaugaugaaguccugccugguggggcucggccccuaccggauccaggucguguacgagcgcaccuacugcaccacgggcauccugaccgaggggaagugcuucgugcccgaccaguccaucaucagcguccugaagaacggcguguucgacaucgccagcguguccaucgucugcuucuucauccggaucaaggggaccagcuacaagaucaugaccuccaucaaggaggcgaaccccaacaacugcaacgacacggacaacaaggugcagggcuacuaccucugcaucgugggggccaacagcuccccggucuacgcccccagcaccaccgacuuccgcuccguggaggcccuggcgagccugcuccggagcccccacggcgaggaccacgaccuggccggcgaggagguggccaccuacagcaucgccgggcaggucgagggcaaggugccccacacggccaacgcggccaacaugcuguucaccgccuucuccgggaucccgagcuacuccagcuucuccgucuucaccggcaaccaggagggcaacgugaucuacagccccggccucuuccccaagcugaaccaguccagcugcgagaagguggcccugccccucaucugggagggcuacaucgaccugccgggguacuacgagaccguccaccccugcaacguguucugcgugcuguccggccccggggccagcugcgaggcguucagcgagggcggcaucuucaacaucacguccccgaccugccucgucagcaagcagaaccgcuuccgggccgccgagcagcagaucaacuucgugugccagcgcguggaccaggacaucgucaucuacugcaacgggcagaagaagaccauccugaccaagacgcuggugaucggccagugcaucuacuccgugaccagccucuucuccaucaugcccggggucgcccacagcaucgccaucgagcugugcgugcccggcuuccacgggugggcgaccgccgcccugcucaccacguucugcuucggcuggauccugauccccuccaucacccuggccauccucaucauccugaaguucuucgccgcgcuguuccacaacagcucccaggagaaccgguucaagaucauccucaagaagaucaaggaggaguucgagaagaccaagggcagcauggugugcgaggucugcaaguacgagugcgagaccgggaaggagcugaaggcccacaaccuguccugcccccagagccagugcccguacugcuucacgcacugcgagcucaccgaguccgccuuccaggcccacuaccgcgugugccaggcgacccaccgguuccgcgacgaccugaagaagaccaucacgccccagagcacgucccccggcugcuaccggacccugaaccucuuccgcuacaagagccggugcuacaucuucaccgugugggucauccugcugaucaucgaguccauccugugggccgccagcgccagcgagaccgugcucgagcccuccuggaacgacaacgcccacggggugggcgucgugccgaugcacacggaccuggagcuggacuucagccuccccuccagcuccaaguacaccuacaagcgcaagcugaccagccccaucaaccaggagcaguccguggaccugcacaucgagaucgagagccaggggaucuccaccagcguccacgcgcucggccacugguucgacggccggcugaaccugaagacguccuuccacugcuacggggccugcaccaaguacgaguacccguggcacaccgccaagugccacuucgagcgcgacuucgaguacgagaacagcugguccugcaaccccgccgacugccccggcaucgggaccggcugcacggccugcggccucuaccuggaccagcugaagcccguggggagcgcguacaagcucaucaccgugcgcuacucccggaaggucugcgugcaguucggcgaggagaaccugugcaagaccaucgacaugaacgacugcuucgugacccgccacgucaaggugugcaucaucgggacggugagcaaguucucccagggcgacacccuggucuuccucgggccgauggagggcggcgggcugaucuucaaggacuggugcaccaccacgugccaguucggcgaccccggggacaucaugagccccaaggacaagggcuucuccugccccgacuucaccgggcacuuccggaagaagugcaacuucgccaccaccccggugugcgaguacgacggcaacauggugagcggcuacaagaaggucauggccacgaucgacagcuuccaggccuucaacaccuccaacauccacuacaccgacgagcgcaucgaguggaaggaccccgacgggaugcugaaggaccaccucaacauccuggugaccaaggacaucgacuucgagaaccugggcgagaaccccugcaagguggggcuccagacggccagcaucgacggcgcguggggguccggcgucggcuucacccugaccugccagaucagccugaccgagugcucccgguuccucacgagcaucaaggccugcgacauggccaucugcuacggggcccaguccgugacccuggugcgcggccagaacaccguccgggugagcgggaagggcgggcacuccggcagcuccuucaagugcugccacggcaccgacugcagccagcaggggcugcaggcguccgcgccccaccucgacaaggugaacggcaucgucgagcaggagagcacccagguguacgacgacggggccccgcagugcggcaucuccugcugguucgucaagagcggcgaguggaucaaggggaucuucaacggcaacuggaucgugaucguggugcugaucuuccuguuccuccugucccugauccuccugagcuuccugugccccauccgcaagcacaagcgguccuga

SEQ ID NO: 11668 - RNA, 3408 nt, Artificial Sequence
  derived and/or modified CDS sequence (opt1) from DOBV(GER/07/607/Af)__GQ205410.1__GP
augaucauguggggccugcucgugacccugagccugaucaaccucggggccucccugcgcaacgucuacgacaugaagaucgagugcccccacagcaucaacuucggcgaguccagcgugaccgggaagguggagcugccgccccucccccugacggacgccgagacccugguccccgaguccagcugcaacauggacaaccaccagucccucagcaucacccagaaggugaccaagguguccuggcggaagaaggccgacaagguccaggccgccaaggacagcuucgagacgaccuccagcgagaugaaccugaaggggaccugcacccugacgcaccgcaugguggaggaguccuaccggaaccgcaagagcgugaucugcuacgaccucuccugcaacagcacccacugcaagccgaccaugcacaugaucguccccgugcacuccugcaacaugaugaaguccugccuggugggccugggccccuaccggauccaggucguguacgagcgcaccuacugcacgaccggcauccucaccgaggggaagugcuucgugcccgaccaguccaucaucagcgucaugaagaacggcguguucgacaucgccagcguguccaucgucugcuucuucauccggaucaaggggaccagcuacaagaucaugacguccaucaaggaggccaacccgaacaacugcaacgacaccgacaccaaggugcagggcuacuaccugugcaucgugggggcgaacagcucccccgucuacgcccccagcaccacggacuuccgcuccguggaggcccuggccagccuccugcggagcccccacggcgaggaccacgaccuggcgggcgaggagguggccaccuacagcaucgccgggcaggucgagggcaaggugccgcacaccgccaacgccgcgaacaugcuguucaccgccuucuccgggauccccagcuacuccagcuucuccgucuucacgggcaaccaggacggcaccgugaucuacagccccggccucuuccccaagcugaaccaguccagcugcgacaagguggcccucccgcugaucugggagggguacaucgaccugcccggguacuacgagaccguccaccccugcaacguguucugcgugcucuccggccccggggccagcugcgaggccuucagcgagggcggcaucuucaacaucaccuccccgacgugccuggucagcaagcagaaccgcuuccgggcggccgagcagcagaucaacuucgugugccagcgcguggaccaggacaucgucaucuacugcaacgggcagaagaagaccauccugaccaagacccucgugaucggccagugcaucuacuccgugacgagccuguucuccaucaugcccggggucgcccacagcaucgccaucgagcugugcgugcccggcuuccacgggugggccaccgcggcccuccugaccaccuucugcuucggcuggauccugauccccuccaucacgcucgccauccugaucgugcugaaguucuucgccgcccuccugcacaacagcucccaggagaaccgguucaagaucauccugaagaagaucaaggaggaguucgagaagaccaagggcagcauggucugcgaggugugcaaguacgagugcgagaccgggaaggagcucaaggcgcacaaccuguccugcccgcagagccagugccccuacugcuucacccacugcgagcugaccgaguccgccuuccaggcccacuaccgcgugugccaggccacgcaccgguuccgcgacgaccucaagaagaccaucacgccccagagcaccucccccggcugcuaccggacccugaaccuguuccgcuacaagagccggugcuacaucuucaccgucugggugauccuccugaucaucgaguccauccugugggcggccagcgccagcgagaccgugcuggagccguccuggaacgacaacgcccacggggucggcguggugcccaugcacgccgaccucgagcuggacuucagccugcccuccagcuccaaguacaccuacaagcgcaagcucacgagcccgaucaaccaggagcaguccgucgaccugcacaucgagaucgagagccaggggaucuccaccagcgugcacgcgcugggccacugguucgacggccggcucaaccugaagaccuccuuccacugcuacggggccugcaccaaguacgaguaccccuggcacacggccaagugccacuucgagcgcgacuucgaguacgagaacagcugguccugcaaccccgccgacugccccggcaucgggaccggcugcaccgccugcggccuguaccucgaccagcugaagccgguggggagcgcguacaagcugaucaccguccgcuacucccggaaggugugcgugcaguucggcgaggagaaccucugcaagacgaucgacaugaacgacugcuucgucacccgccacgugaaggugugcaucaucgggaccgucagcaaguucucccagggcgacacccugguguuccuggggcccauggagggcggcgggcucaucuucaaggacuggugcacgacgaccugccaguucggcgaccccggggacaucaugagccccaaggacaagggcuucuccugcccggacuucaccgggcacuuccggaagaagugcaacuucgccaccacccccgugugcgaguacgacggcaacauggucagcggcuacaagaaggugauggccaccaucgacagcuuccaggccuucaacaccuccaacauccacuacacggacgagcgcaucgaguggaaggaccccgacgggaugcugaaggaccaccugaacauccucgugaccaaggacaucgacuucgagaaccugggcgagaaccccugcaaggucgggcugcagaccgccagcaucgacggcgcguggggguccggcgugggcuucacccucacgugccagaucagccugaccgagugcucccgguuccugaccagcaucaaggccugcgacauggccaucugcuacggggcccaguccgugacccucguccgcggccagaacacggugaaggugagcgggaagggcgggcacuccggcagcuccuucaagugcugccacggcaccgacugcagccagcaggggcugcaggcguccgccccgcaccuggacaaggucaacggcaucguggagcaggagagcacccagguguacgacgacggggcgccccagugcggcaucuccugcugguucgucaagagcggcgaguggaucaaggggaucuucuccggcaacuggaucgugaucgugguccucaucuuccuguuccugcucagccugauccugcucuccuuccugugccccauccggaagcacaagcgcagcuga

SEQ ID NO: 11669 - RNA, 3408 nt, Artificial Sequence
  derived and/or modified CDS sequence (opt1) from DOBV(GER/08/118/Aa)__GQ205412.1__GP
augaucauguggggccugcucgugauccugagccugaucaaccucggggccucccugcgcaacgucuacgacaugaagaucgagugcccccacagcaucaacuucggcgaguccagcgugaccgggaagguggagcugccgccccucccccugaccgacgccgagacgcugguccccgaguccagcugcaacauggacaaccaccagucccucagcaucacccagaaggugaccaagguguccuggcggaagaaggccgacaagguccaggccgccaaggacagcuucgagaccacguccagcgagaucaaccugaaggggaccugcacccugacccaccgcaugguggaggaguccuaccggaaccgcaagagcgugaucugcuacgaccucuccugcaacagcacgcacugcaagccgaccaugcacaugaucguccccgugcacuccugcaacaugaugaaguccugccuggugggccugggccccuaccggauccaggucguguacgagcgcaccuacugcaccacgggcauccucaccgaggggaagugcuucgugcccgaccaguccaucaucagcgucaugaagaacggcguguucgacaucgccagcguguccaucgucugcuucuucauccggaucaaggggaccagcuacaagaucaugaccuccaucaaggaggccaacccgaacaacugcaacgacacggacaacaaggugcagggcuacuaccugugcaucgugggggcgaacagcucccccgucuacgcccccagcaccaccgacuuccgcuccguggaggcccuggccagccuccugcggagcccccacggcgaggaccacgaccuggcgggcgaggagguggccaccuacagcaucgccgggcaggucgacggcaaggugccgcacacggccaacgccgcgaacaugcuguucaccgccuucuccgggauccccagcuacuccagcuucuccgucuucaccggcaaccaggacggcaccgugaucuacagccccggccucuuccccaagcugaaccaguccagcugcgacaagguggcccucccgcugaucugggagggguacaucgaccugcccggguacuacgagacgguccaccccugcaacguguucugcgugcucuccggccccggggccagcugcgaggccuucagcgagggcggcaucuucaacaucaccuccccgaccugccuggucagcaagcagaaccgcuuccgggcggccgagcagcagaucaacuucgugugccagcgcguggaccaggacaucgucaucuacugcaacgggcagaagaagaccauccugacgaagacccucgugaucggccagugcaucuacuccgugaccagccuguucuccaucaugcccggggucgcccacagcaucgccaucgagcugugcgugcccggcuuccacgggugggccaccgcggcccuccugacgaccuucugcuucggcuggauccugauccccuccaucacccucgccauccugaucgugcugaaguucuucgccgcccuccugcacaacagcucccaggagaaccgguucaagaucauccugaagaagaucaaggaggaguucgagaagaccaagggcagcauggucugcgaggugugcaaguacgagugcgagacggggaaggagcucaaggcgcacaaccuguccugcccgcagagccagugccccuacugcuucacccacugcgagcugaccgaguccgccuuccaggcccacuaccgcgugugccaggccacccaccgguuccgcgacgaccucaagaagaccaucacgccccagagcaccucccccggcugcuaccggacccugaaccuguuccgcuacaagagccggugcuacaucuucaccgucugggugauccuccugaucaucgaguccauccugugggcggccagcgccagcgagacgauccuggagccguccuggaacgacaacgcccacggggugggcgucgugcccaugcacaccgaccucgagcuggacuucagccugcccuccagcuccaaguacaccuacaagcgcaagcucaccagcccgaucaaccaggagcaguccguggaccugcacaucgagaucgagagccaggggaucuccacgagcguccacgcccugggccacugguucgacggccggcucaaccugaagaccuccuuccacugcuacggggcgugcaccaaguacgaguaccccuggcacaccgccaagugccacuucgagcgcgacuucgaguacgagaacagcugguccugcaaccccgccgacugccccggcaucgggacgggcugcaccgccugcggccuguaccucgaccagcugaagccgguggggagcgccuacaagcugaucaccgugcgcuacucccggaaggucugcgugcaguucggcgaggagaaccucugcaagaccaucgacaugaacgacugcuucgugacgcgccacgucaaggugugcaucaucgggaccgugagcaaguucucccagggcgacacccuggucuuccuggggcccauggagggcggcgggcucaucuucaaggacuggugcaccacgaccugccaguucggcgaccccggggacaucaugagccccaaggacaagggcuucuccugcccggacuucaccgggcacuuccggaagaagugcaacuucgcgaccacgcccgugugcgaguacgacggcaacauggugagcggcuacaagaaggucauggccaccaucgacagcuuccaggccuucaacaccuccaacauccacuacaccgacgagcgcaucgagugggaggaccccgacgggaugcugaaggaccaccugaacauccucgugacgaaggacaucgacuucgagaaccugggcgagaaccccugcaagguggggcugcagaccgccagcaucgacggcgccuggggguccggcgucggcuucacccugaccugccagaucagccucacggagugcucccgguuccugaccagcaucaaggcgugcgacauggccaucugcuacggggcccaguccgugacccucgugcgcggccagaacaccgucaaggugagcgggaagggcgggcacuccggcagcuccuucaagugcugccacggcacggacugcagccagcaggggcugcaggccuccgcgccgcaccuggacaaggugaacggcaucgucgagcaggagagcacccagguguacgacgacggggcgccccagugcggcaucuccugcugguucgucaagagcggcgaguggaucaaggggguguucuccggcaacuggaucgugaucgugguccucaucuuccuguuccugcucagccugauccugcucuccuuccugugccccauccggaagcacaagcgcagcuga

SEQ ID NO: 11670 - RNA, 3408 nt, Artificial Sequence
  derived and/or modified CDS sequence (opt1) from DOBV(GER/08/131/Af)__GQ205413.1__GP
augaucauguggggccugcuccugacccugagccucaucaaccugggggccucccugcgcaacguguacgacaugaagaucgagugcccccacagcaucaacuucggcgaguccagcgucaccgggaagguggagcucccgccccugcugcucacggacgccgagacccuggugcccgaguccagcugcaacauggacaaccaccagucccugagcaucacccagaaggucaccaagguguccuggcggaagaaggcggacaaggugcaggccgccaaggacagcuucgagacgaccuccagcgaggucaaccucaaggggaccugcacccugacgcaccgcaugguggaggaguccuaccggagccgcaaguccgugaucugcuacgaccugagcugcaacuccacccacugcaagcccaccaugcacaugaucgucccggugcacagcugcaacaugaugaaguccugccucguggggcugggccccuaccggauccaggucguguacgagcgcaccuacugcacgaccggcauccugaccgaggggaagugcuucgugcccgaccagagcaucaucagcgucaucaagaacggcguguucgacaucgccuccgugagcaucgucugcuucuucauccggaucaaggggaccuccuacaagaucaugacgagcaucaaggaguccaaccccaacaacugcaacgacaccgacaacaaggugcagggcuacuaccucugcaucgugggggccaacagcuccccggucuacgcgcccagcaccaccgacuuccgcuccguggaggcccuggccagccugcuccggucccccuacggcgaggaccacgaccuggccggcgaggagguggcgacguacagcaucgccgggcaggucgagggcaaggugccccacaccgccaacgccgccaacaugcuguucaccgcguucuccgggaucccgagcuacuccagcuucuccgucuucaccggcaaccaggacggcaacgugaucuacagccccggccucuuccccaagcugaaccaguccagcugcgagaagguggcccugccccucaucugggagggcuacaucgaccugccgggguacuacgagacgguccaccccugcaacguguucugcgugcugagcggccccggggccuccugcgaggccuucagcgagggcggcaucuucaacaucaccuccccgaccugccucgucagcaagcagaaccgcuuccgggccgcggagcagcagaucaacuucgugugccagcgcguggaccaggacaucgucaucuacugcaacgggcagaagaagaccauccugacgaagacccuggugaucggccagugcaucuacuccgugaccagccucuucuccaucaugcccggggucgcccacagcaucgccaucgagcugugcgugcccggcuuccacgggugggccaccgccgcgcugcucacgaccuucugcuucggcuggauccugauccccuccaucacccuggccauccucaucgugcugaaguucuucgccgcccugcuccacaacagcucccaggagaaccgguucaagaucauccugaagaagaucaaggaggaguucgagaagaccaagggcagcauggucugcgaggugugcaaguacgagugcgagacggggaaggagcugaaggcccacaaccucuccugcccccagagccagugcccguacugcuucacccacugcgagcugaccgaguccgcguuccaggcccacuaccgcgugugccaggccacccaccgguuccgcgacgaccugaagaagaccaucacgccccagagcaccucccccggcugcuaccggacccucaaccuguuccgcuacaagagccggugcuacaucuucaccgucugggugauccugcugaucaucgagagcauccucugggccgcguccgccagcgagaucgugcuggagcccuccuggaacgacaacgcccacggggucggcguggugccgaugcacacggaccuggagcucgacuucagccugcccuccagcuccaaguacaccuacaagcgcaagcugaccagccccaucaaccaggagcaguccgucgaccuccacaucgagaucgagagccaggggaucuccaccagcgugcacgcccugggccacugguucgacggccggcugaaccucaagacguccuuccacugcuacggggccugcaccaaguacgaguacccguggcacaccgcgaagugccacuucgagcgcgacuucgaguacgagaacagcugguccugcaaccccgccgacugccccggcaucgggaccggcugcacggccugcggccuguaccuggaccagcucaagcccguggggagcgccuacaagcugaucaccguccgcuacucccggaaggugugcgugcaguucggcgaggagaaccugugcaagaccaucgacaugaacgacugcuucgucacccgccacgugaaggugugcaucaucgggacggucagcaaguucucccagggcgacacccucguguuccuggggccgauggagggcggcgggcugaucuucaaggacuggugcaccaccacgugccaguucggcgaccccggggacaucaugagccccaaggacaagggcuucagcugccccgacuucaccgggcacuuccggaagaagugcaacuucgccaccaccccggugugcgaguacgacggcaacauggucuccggcuacaagaaggugauggcgacgaucgacagcuuccaggccuucaacaccuccaacauccacuacaccgacgagcgcaucgaguggaaggacaccgacgggaugcucaaggaccaccugaacauccuggugacgaaggacaucgacuucgagaaccucggcgagaaccccugcaaggucgggcugcagaccgccagcaucgacggcgccuggggguccggcgugggcuucacccugaccugccagaucagccucacggagugcucccgguuccugaccagcaucaaggccugcgacauggcgaucugcuacggggcccaguccgugacccugguccgcggccagaacaccgugcgggugagcgggaagggcgggcacuccggcagcuccuucaagugcugccacggcacggacugcagccaccaggggcuccaggccuccgccccgcaccuggacaaggucaacggcaucguggagcaggagagcacccagguguacgacgacggggcgccccagugcggcaucuccugcugguucgucaagagcggcgaguggaucaaggggaucuucuccggcaacuggaucgugaucgugguccugaucuuccucuuccugcugagccucauccugcugagcuuccucugccccauccgcaagcacaagcgguccuga

SEQ ID NO: 11671 - RNA, 3408 nt, Artificial Sequence
  derived and/or modified CDS sequence (opt1) from DOBV(GRW/Aa)__JQ026205.1__GP
augaucauguggggccugcuccugacccugagccucaucaaccugggggccucccugcgcaacguguacgacaugaagaucgagugcccccacagcaucaacuucggcgaguccagcgucaccgggaagggcgagcucccgccccugcugcucacggacgccgagacccuggugcccgaguccagcugcaacauggacaaccaccagucccugagcaucacccagaaggugaccaaggucuccuggcggaagaaggcggacaaggugcaggccgccaaggacagcuucgagacgaccuccagcgaggugaaccucaaggggaccugcacccugacgcaccgcauggucgaggaguccuaccggagccgcaaguccgugaucugcuacgaccugagcugcaacuccacccacugcaagcccaccaugcacaugaucgugccgguccacagcugcaacaugaugaaguccugccucgugggccugggccccuaccggauccagguggucuacgagcgcaccuacugcacgaccgggauccugaccgagggcaagugcuucgugcccgaccagagcaucaucagcgugaucaagaacggggucuucgacaucgccuccgugagcaucgugugcuucuucauccggaucaagggcaccuccuacaagaucaugacgagcaucaaggaguccaaccccaacaacugcaacgacaccgacaacaagguccagggguacuaccucugcaucgugggcgccaacagcuccccgguguacgcgcccagcaccaccgacuuccgcuccgucgaggcccuggccagccugcuccggucccccuacggcgaggaccacgaccuggccggggaggagguggcgacguacagcaucgccggccagguggaggggaaggucccccacaccgccaacgccgccaacaugcuguucaccgcguucuccggcaucccgagcuacuccagcuucuccguguucaccggcaaccaggacgggaacgucaucuacagccccggccucuuccccaagcugaaccaguccagcugcgagaagguggcccugccccucaucugggagggguacaucgaccugccgggcuacuacgagacggugcaccccugcaacgucuucugcgugagcuccgggcccggcgccagcugcgaggccuucuccgagggcgggaucuucaacaucaccagccccacgugccugguguccaagcagaaccgcuuccgggccgcggagcagcagaucaacuucgucugccagcgcguggaccaggacaucgugaucuacugcaacggccagaagaagaccauccucacgaagacccuggucaucgggcagugcaucuacagcgugaccucccuguucagcaucaugccgggcguggcccacuccaucgccaucgagcucugcguccccggguuccacggcugggccaccgccgcgcugcugacgaccuucugcuucggcuggauccucauccccagcaucacccuggccauccugaucgugcucaaguucuucgccgcccugcugcacaacuccagccaggagaaccgguucaagaucauccucaagaagaucaaggaggaguucgagaagaccaagggguccauggugugcgaggucugcaaguacgagugcgagacgggcaaggagcugaaggcccacaaccugagcugcccccagucccagugcccguacugcuucacccacugcgagcucaccgagagcgcguuccaggcccacuaccgcgugugccaggccacccaccgguuccgcgacgaccugaagaagaccaucacgccccaguccaccagccccgggugcuaccggacccugaaccucuuccgcuacaagagccggugcuacaucuucaccgugugggucauccugcugaucaucgaguccauccugugggccgcgagcgccuccgagaucgugcucgagcccagcuggaacgacaacgcccacggcgugggggucgugccgaugcacacggaccuggagcuggacuucucccuccccagcuccagcaaguacaccuacaagcgcaagcugaccucccccaucaaccaggagcagagcguggaccugcacaucgagaucgagucccagggcaucagcaccuccguccacgcccucggccacugguucgacgggcggcugaaccugaagacgagcuuccacugcuacggcgccugcaccaaguacgaguacccguggcacaccgcgaagugccacuucgagcgcgacuucgaguacgagaacuccuggagcugcaaccccgccgacugccccgggaucggcaccggcugcacggccugcgggcucuaccuggaccagcugaagcccgugggcuccgccuacaagcucaucaccgugcgcuacagccggaaggucugcgugcaguucggggaggagaaccugugcaagaccaucgacaugaacgacugcuucgugacccgccacgucaaggugugcaucaucggcacgguguccaaguucagccagggggacacccuggucuuccucggcccgauggagggcgggggccugaucuucaaggacuggugcaccaccacgugccaguucggggaccccggcgacaucaugagccccaaggacaagggguucuccugccccgacuucaccggccacuuccggaagaagugcaacuucgccaccaccccggugugcgaguacgacggcaacauggugagcggguacaagaaggucauggcgacgaucgacuccuuccaggccuucaacaccagcaacauccacuacaccgacgagcgcaucgaguggaaggaccccgacggcaugcugaaggaccaccucaacauccuggugaccaaggacaucgacuucgagaaccugggggagaaccccugcaaggugggccuccagacggccuccaucgacggggccuggggcagcggcgucggguucacccugaccugccagaucucccugaccgagugcagccgguuccucacguccaucaaggccugcgacauggcgaucugcuacggcgcccagagcgugacccuggugcgcgggcagaacaccguccggguguccggcaagggcgggcacagcggcuccagcuucaagugcugccacgggaccgacugcucccaccagggccugcaggccagcgcgccccaccucgacaaggugaacgggaucgucgagcaggaguccacccagguguacgacgacggcgccccgcagugcggcaucagcugcugguucaucaaguccggggaguggaucaagggcaucuucagcgggaacuggaucgugaucgucgugcugaucuuccuguuccuccugagccugauccuccuguccuuccugugccccauccgcaagcacaagcggagcuga

SEQ ID NO: 11672 - RNA, 3408 nt, Artificial Sequence
  derived and/or modified CDS sequence (opt1) from DOBV(Slo/Af-BER)__GU904035.1__GP
augaucauguggggccugcuccugaccaugauccugaucgacuucggggccagccuccgcaacguguacgacaugaagaucgagugcccccacuccaucaacuucggcgagagcuccgucaccgggaagguggagcugccgccccugcuccugacggacgccgaggcccuggugcccgagagcuccugcaacauggacaaccaccagagcauguccaucauccagaaggucaccaaggugagcuggcggaagaaggccgacaaggcccaggccgccaaggacuccuucgagaccaccagcuccgaggugaaccucaagggcacgugcacccugagccaccgcauggucgaggaguccuaccggaaccgccggagcgugaucugcuacgaccuguccugcaacagcacccacugcaagcccaccaugcacaugaucgugccgguccacuccugcaacaugaugaaguccugccucguggggcugggccccuaccgcauccagguggucuacgagcggacguacugcaccaccggcauccugaccgaggggaagugcuucgugcccgaccagagcaucgugagcgucaucaagaacggcguguucgacaucgcgagcguguccaucgucugcuucuucauccgcgugaaggggacgaacuacaagaucauggccagcaucaagaccgccaccgccaacaacugcaacgacaccgacaacaaggugcagggcuacuaccucugcaucgucgggggcaacuccagccccguguacgcgccguccacgaccgacuuccggagcauggaggcccuggccucccugcuccgcgcgccccacggcgaggaccacgaccugagcggggaggagguggccaccuacuccaucgccggccagaucgaggggaagaucccccacaccgccaacgccgccaacaugcuguucacggccuucagcggcauccccuccuacagcucccucagcgucuucaucggcucccaggacgggccgaucaucuacagccccggccuguuccccaagcugaaccaguccagcugcgacaagguggcgcucccccugaucugggagggguacaucgaccugccgggcuacuacgagaccguccaccccugcaacguguucugcgugcucuccgggcccggcgccagcugcgaggccuucagcgagggcgggaucuucaacaucaccuccccgaccugccuggucagcaagcagaaccgguuccgcgccgccgagcagcaggucaacuucgugugccagcggguggaccaggacaucaucaucuacugcaacggccagaagaagacgauccugaccaagacccucgugaucgggcagugcaucuacuccgugaccagccuguucuccaucaugcccggcgucgcgcacagcaucgccaucgagcugugcgugcccggguuccacggcugggccacggccgcccuccugaccaccuucugcuucggcuggauccugauccccuccaucacccucgcggugcuggucgugcugaaguucuucgccgccauccuccacaacagcucccaggagaaccgcuucaagaucauccugcggaagaucaaggaggaguucgagaagacgaaggggagcauggugugcgaggucugcaaguacgagugcgagaccggcaaggagcugaaggcccacaaccucuccugcccccagagccagugcccguacugcuucacccacugcgagcccaccgaguccgcguuccaggcccacuacaaggugugccaggccacgcaccgcuuccgggacgaccugaagaagaccaucacgccccagagcaccucccccgggugcuaccgcacccugaaccucuuccgguacaagagccgcugcuacaucuucaccgugugggucacccugcugaucaucgaguccaucaugugggccgccagcgcgagcgagaacgugcucgagccguccuggaacgacaacgcccacggcgugggggucgugcccaugcacaccgaccuggagcuggacuucagccugcccuccagcuccaaguacaccuacaagcggaagcucacgagcccgcugaaccaggagcaguccguggaccugcacaucgagaucgagagccagggcaucuccaccagcguccacgcccucggccacugguucgacgggcgccugaaccugaagaccuccuuccacugcuacggcgccugcaccaaguacgaguaccccuggcacacggccaagugccacuucgagcgcgacuucgaguacgagaacagcugggggugcaaccccgcggacugccccggcaucggcaccgggugcaccgccugcggccucuacaucgaccagcugaagccggugggguccgccuacaagcugaucaccgugcgguacagccgcaaggucugcgugcaguucggcgaggagaaccucugcaagacgaucgacaugaacgacugcuucgugacccggcacgucaaggugugcaucaucgggaccguguccaaguucagccagggcgacacccuggucuuccugggccccauggagggcggcgggcucaucuucaaggacuggugcacguccacgugccaguucggggaccccggggacaucaugagccccaaggacaagggcuucuccugcccggacuucaccggccacuuccgcaagaagugcaacuucgccaccacccccgugugcgaguacgacgggaacauggugagcggcuacaagaaggucauggccaccaucgacagcuuccaguccuucaacaccagcuccauccacuacaccgacgagcggaucgaguggaaggaccccgacgggaugcugaaggaccaccugaacauccucgugacgaaggacaucgacuucgagaaccugggcgagaaccccugcaagguggggcugcagaccagcuccaucgagggcgcguggggcagcggggucggcuucacccugaccugccagaucucccucacggagugcagccgcuuccugaccuccaucaaggccugcgacauggccaucugcuacggggcccagagcgugacccucauccggggccagaacaccgugaaggucuccgggaagggcggccacagcggguccagcuucaagugcugccacggcacggacugcucccagcaggggcugcaggcgagcgccccgcaccuggacaaggugaacggcaucguggagcaggacuccgagaaggucuacgacgacggcgcgccccagugcgggaucagcugcugguucgugaaguccggcgaguggaucaccgggaucuucaacggcaacuggaucgugaucgucgugcucguguucuucuucauccugagccugauccuccugagccugcucugccccauccgcaagcacaagcgguccuga

SEQ ID NO: 11673 - RNA, 3408 nt, Artificial Sequence
  derived and/or modified CDS sequence (opt1) from HTNV(76-118/POR)__KT885048.1__GP
augggcaucuggaaguggcuggugauggccagccucgucuggcccgugcugacccugcgcaacguguacgacaugaagaucgagugcccgcacaccgucuccuucgggggcaacagcgugaucggguacguggagcucccgcccgucccccuggccgacacggcgcagauggugcccgaguccagcugcuccauggacaaccaccagagccugaacaccaucaccaaguacacccagguguccuggcggggcaaggccgaccagagccaguccagccagaacuccuucgagacggucagcaccgagguggaccucaaggggaccugcgugcugaagcacaagauggucgaggaguccuaccgcagccggaaguccgugaccugcuacgaccugagcugcaacuccacguacugcaagcccacccucuacaugaucgugcccauccacgccugcaacaugaugaaguccugccugaucgcccugggccccuaccgcguccaggugguguacgagcggaccuacugcaugaccggcguccucaucgaggggaagugcuucgugccggaccaguccguggucagcaucaucaagcacggcaucuucgacaucgccagcgugcacaucgugugcuucuucgucgcggugaaggggaacacguacaagaucuucgagcaggucaagaaguccuucgagagcacgugcaacgacaccgagaacaaggugcagggcuacuacaucugcaucgucgggggcaacuccgcccccaucuacgugcccacccuggacgacuuccgcagcauggaggccuucaccggcaucuuccggagcccccacggggaggaccacgaccuggccggcgaggagaucgcgagcuacuccaucguggggccggccaacgccaaggugccccacagcgccuccagcgacacccuccgccugaucgccuacuccggcauccccagcuacuccagccuguccauccucaccagcuccaccgaggcgaagcacgucuucagccccggccuguucccgaagcugaaccacacgaacugcgacaaguccgccaucccccucaucuggaccgggaugaucgaccugcccggcuacuacgaggccgugcaccccugcaccguguucugcguccugagcgggccgggcgccagcugcgaggccuucuccgagggcgggaucuucaacaucaccagcuccaugugccucgugagcaagcagaaccgguuccgccugacggagcagcaggucaacuucgugugccagcggguggacauggacaucguggucuacugcaacggccagcgcaaggugauccugaccaagacccucgugaucgggcagugcaucuacaccaucacgucccuguucagccugcuccccggcgucgcgcacuccaucgccguggagcugugcgugcccggguuccacggcugggccaccgccgcccugcucgucaccuucugcuucgggugggugcugauccccgcgaucaccuucaucauccugacggugcucaaguucaucgccaacaucuuccacaccagcaaccaggagaaccggcugaaguccguccugcgcaagaucaaggaggaguucgagaagaccaagggcagcauggugugcgacgugugcaaguacgagugcgagaccuacaaggagcucaaggcccacggcgucuccugcccgcagagccagugccccuacugcuucacgcacugcgagcccaccgaggccgccuuccaggcgcacuacaaggugugccaggugacccaccgguuccgcgacgaccugaagaagaccgucacgccccagaacuucaccccggggugcuaccggacccugaaccucuuccgcuacaagucccggugcuacaucuucaccauguggaucuuccugcuggugcucgagagcauccugugggccgccuccgccagcgagacgccccugacccccguguggaacgacaacgcgcacggcgucggguccgugccgaugcacaccgaccucgagcuggacuucagccugaccagcuccagcaaguacaccuaccgccggaagcugacgaacccccucgaggaggcccaguccaucgaccugcacaucgagaucgaggagcagaccaucggcguggacguccacgcccuggggcacugguucgacggccgccucaaccugaagaccagcuuccacugcuacggcgccugcaccaaguacgaguaccccuggcacacggccaagugccacuacgagcgcgacuaccaguacgagaccuccugggggugcaaccccagcgacugcccgggcguggggaccggcugcaccgcgugcggccuguaccucgaccagcugaagcccgugggguccgccuacaagaucaucacgauccgguacagccgccgggucugcgugcaguucggcgaggagaaccugugcaagaucaucgacaugaacgacugcuucgugucccgccacgucaaggugugcaucaucgggaccgugagcaaguucucccagggcgacacccuccuguucuucgggccccuggagggcggcgggcucaucuucaagcacuggugcaccagcacgugccaguucggcgaccccggggacaucauguccccgcgggacaagggcuuccugugccccgaguuccccgggagcuuccgcaagaagugcaacuucgccaccacccccaucugcgaguacgacggcaacauggucuccggcuacaagaaggugauggccaccaucgacagcuuccaguccuucaacacgagcaccaugcacuucaccgacgagcggaucgaguggaaggacccggacgggaugcugcgcgaccacaucaacauccucgugaccaaggacaucgacuucgacaaccugggcgagaaccccugcaagaucgggcugcagacguccagcaucgagggcgccugggggagcggcgucggcuucacccugaccugccucgugucccugaccgagugccccacguuccucaccagcaucaaggcgugcgacaaggccaucugcuacggggccgaguccgugacccugacccggggccagaacacggucaaggugagcgggaagggcgggcacuccggcagcaccuucaagugcugccacggcgaggacugcucccagaucgggcugcacgccgccgcgccccaccucgacaaggucaacggcaucagcgagaucgagaacuccaagguguacgacgacggggccccgcagugcggcaucaagugcugguucgucaagagcggcgaguggaucuccgggaucuucagcggcaacuggaucgugcugaucgugcugugcguguuccuccuguucucccugguccuccugagcauccugugccccgugcgcaagcacaagaaguccuga

SEQ ID NO: 11674 - RNA, 3408 nt, Artificial Sequence
  derived and/or modified CDS sequence (opt1) from HTNV(76-118)__Y00386.1__GP
augggcaucuggaaguggcuggugauggccagccucgucuggcccgugcugacccugcgcaacguguacgacaugaagaucgagugcccgcacaccgucuccuucgggggcaacagcgugaucggguacguggagcucccgcccgucccccuggccgacacggcccagauggugcccgaguccagcugcuccauggacaaccaccagagccugaacaccaucaccaaguacacccagguguccuggcggggcaaggccgaccagagccaguccagccagaacuccuucgagacggucagcaccgagguggaccucaaggggaccugcgugcugaagcacaagauggucgaggaguccuaccgcagccggaaguccgugaccugcuacgaccugagcugcaacuccacguacugcaagcccacccucuacaugaucgugcccauccacgccugcaacaugaugaaguccugccugaucgcccugggccccuaccgcguccaggugguguacgagcggaccuacugcaugaccggcguccucaucgaggggaagugcuucgugccggaccaguccguggucagcaucaucaagcacggcaucuucgacaucgccagcgugcacaucgugugcuucuucgucgcggugaaggggaacacguacaagaucuucgagcaggucaagaaguccuucgagagcacgugcaacgacaccgagaacaaggugcagggcuacuacaucugcaucgucgggggcaacuccgcccccaucuacgugcccacccuggacgacuuccgcagcauggaggccuucaccggcaucuuccggagcccccacggggaggaccacgaccuggccggcgaggagaucgcgagcuacuccaucguggggccggccaacgccaaggugccccacagcgccuccagcgacacccucucccugaucgccuacagcggcauccccuccuacagcucccugagcauccucaccuccagcaccgaggcgaagcacgucuucucccccggccuguucccgaagcugaaccacacgaacugcgacaagagcgccaucccccucaucuggaccgggaugaucgaccugcccggcuacuacgaggccgugcaccccugcaccguguucugcguccugagcgggccgggcgccuccugcgaggccuucagcgagggcgggaucuucaacaucaccucccccaugugccucgugagcaagcagaaccgcuuccggcugacggagcagcaggucaacuucgugugccagcgcguggacauggacaucguggucuacugcaacggccagcggaaggugauccugaccaagacccucgugaucgggcagugcaucuacaccaucacgucccuguucagccugcuccccggcgucgcgcacuccaucgccguggagcugugcgugcccggguuccacggcugggccaccgccgcccugcucgucaccuucugcuucgggugggugcugaucccggcgaucaccuucaucauccugacggugcucaaguucaucgccaacaucuuccacaccagcaaccaggagaaccgccugaaguccguccugcggaagaucaaggaggaguucgagaagaccaagggcagcauggugugcgacgugugcaaguacgagugcgagaccuacaaggagcucaaggcccacggcgucuccugcccccagagccagugccccuacugcuucacgcacugcgagcccaccgaggccgccuuccaggcgcacuacaaggugugccaggugacccaccgcuuccgggacgaccugaagaagaccgucaccccgcagaacuucacgcccgggugcuaccgcacccugaaccucuuccgguacaagucccgcugcuacaucuucaccauguggaucuuccugcuggugcucgagagcauccugugggccgccuccgccagcgagacgccccugaccccgguguggaacgacaacgcgcacggcgucggguccgugcccaugcacaccgaccucgagcuggacuucagccugaccagcuccagcaaguacaccuaccggcgcaagcugacgaacccccucgaggaggcccaguccaucgaccugcacaucgagaucgaggagcagaccaucggcguggacguccacgcccuggggcacugguucgacggccggcucaaccugaagaccagcuuccacugcuacggcgccugcaccaaguacgaguaccccuggcacacggccaagugccacuacgagcgcgacuaccaguacgagaccuccugggggugcaacccgagcgacugccccggcguggggaccggcugcaccgcgugcggccuguaccucgaccagcugaagcccgugggguccgccuacaagaucaucacgauccgcuacagccggcgcgucugcgugcaguucggcgaggagaaccugugcaagaucaucgacaugaacgacugcuucgugucccggcacgucaaggugugcaucaucgggaccgugagcaaguucucccagggcgacacccuccuguucuucgggccccuggagggcggcgggcucaucuucaagcacuggugcaccagcacgugccaguucggcgacccgggggacaucaugagcccccgcgacaagggcuuccugugccccgaguuccccgggagcuuccggaagaagugcaacuucgccaccaccccgaucugcgaguacgacggcaacauggucuccggcuacaagaaggugauggccaccaucgacagcuuccaguccuucaacacgagcaccaugcacuucaccgacgagcgcaucgaguggaaggaccccgacgggaugcugcgggaccacaucaacauccucgugaccaaggacaucgacuucgacaaccugggcgagaaccccugcaagaucgggcugcagacguccagcaucgagggcgccugggggagcggcgucggcuucacccugaccugccucgugucccugaccgagugccccacguuccucaccagcaucaaggcgugcgacaaggccaucugcuacggggccgaguccgugacccugacccgcggccagaacacggucaaggugagcgggaagggcgggcacuccggcagcaccuuccggugcugccacggcgaggacugcucccagaucgggcugcacgccgccgcgccgcaccucgacaaggucaacggcaucagcgagaucgagaacuccaagguguacgacgacggggcgccccagugcggcaucaagugcugguucgugaaguccggcgaguggaucuccgggaucuucagcggcaacuggaucguccugaucgugcugugcguguuccuccuguucucccugguccuccugagcauccugugccccgugcgcaagcacaagaaguccuga

SEQ ID NO: 11675 - RNA, 3408 nt, Artificial Sequence
  derived and/or modified CDS sequence (opt1) from HTNV(A16)__AF288645.1__GP
augggccuguggaaguggcucaucauggccgugcuggucuggcccugcuucgcccugcgcaacguguacgacaugaagaucgagugcccgcacaccgugaacuucggggagaacagcgucgugggcuacguggagcucccgcccaugcccaucgccgacaucacccagaugaugcccgaguccagcugcuccauggacaaccaccagagccugaacacgaucaccaaguacacccaggucuccuggcggaagaaggccgaccaggcccagagcucccagaccagcuucgagacgguguccagcgagguggacuucaaggggaccugcguccugaagcacaagaugaucgaggacuccuaccgcagccggcgcuccaucaucugcuacgaccucagcugcaacuccaccuucugcaagcccacccuguaccugaucgugcccgugcacgccugcaacaugaugaaguccugccucaucgcccugggccccuaccggguccaggugguguacgagcgcacguacugcauguccgggguccugcucgagggcaagugcuucgugccggaccagagcguggucuccaucaucaagcacggcaucuucgacaucgcgagcgugcacaucgugugcuucuucgucgccaucaaggggagcaccuacaagauccuggagcaggucaagaaguccuucgagcugaccugcaacgacaccgacaacaagauccagggcuacuacaucugccucgucgggggcaacagcgcccccaucuacgugcccacgcuggacgacuuccgguccauggaggccuucgcggggaucuucaagagcccccacggcgaggaccacgaccuggccggcgaggagguggccuccuacagcaucguggggccggccaacgccaaggugccccacuccgcgagcgccgacacccucggccugguggccuucuccgggauccccagcuacuccagcuucuccguccugaccggcagcaccgacgcccgccacguguucucccccggcuucuucccgcagcucaaccagacgcggugcgacaagaccgccaucccccugaccuggaccgggaugaucgaccugcccggcuacuacgaggcggugcaccccugcacggucuucugcgugcucagcgggccgggcgccuccugcgaggccuucagcgagggcgggaucuucaacaucaccucccccaugugccuggugagcaagcagaaccgcuuccggagcuccaagcagcaggucaacuucgugugccagcgcguggacauggacaucgucguguacugcaacggccagaagaaggugauccugaccaagacccucgucaucgggcagugcaucuacacgaucaccagccuguucucccugcuccccggcguggcccacagcaucgccguggagcugugcguccccggguuccacggcugggcgaccgccgcccugcucgugaccuucugcuucgggugggugcugaucccggccgucacgcuggugauccucaccauccugaaguucaucgccaacaucuuccacaccuccaaccaggagaaccggcucaagagcgugcucaagaagaucaaggaggaguucgagaagaccaagggcuccauggucugcgacgugugcaaguacgagugcgagacguacaaggagcugaaggcgcacggcgugagcugcccccagucccagugccccuacugcuucacccacugcgagcccaccgaggccgccuuccaggcccacuacaaggucugccaggugacccaccgcuuccgggacgaccugaagaagacggugaccccgcagaacuucacccccgggugcuaccgcacccucaaccuguuccgguacaagagccgcugcuacaucuucaccaugugggucuuccugcucauccuggaguccauccugugggcggccagcgccuccgagacgccccucaccccgaucuggaacgacaacgcccacggcguggggagcauccccaugcacaccgaccuggagcuggacuucucccugaccagcuccagcaaguacacguaccggcgcaagcucaccaacccccuggaggagacccaggccguggaccugcacaucgagcucgcggagcagaccaucggcgucgacgugcacgcccuggggcacugguucgacggccggcugaaccucaagacgagcuuccacugcuacggcgccugcaccaaguacgaguaccccuggcacaccgccaagugccacuacgagcgcgacuaccaguacgagaccuccugggggugcaacccgagcgacugccccggcguggggacgggcugcaccgccugcggccuguaccuggaccagcucaagcccgucggguccgcguacaagaucaucaccauccgcuacagccggcgcgugugcgugcaguucggcgaggagaaccugugcaaggucaucgacaugaacgacugcuucgugucccggcacgugaaggucugcaucaucgggaccgugagcaaguucucccagggcgacacgcugcuguucuucgggccccuggagggcggcgggcugaucuucaagcacuggugcaccagcacgugccaguucggcgacccgggggacaucaugagcccccgcgacaagggcuuccucugccccgaguuccccgggagcuuccggaagaagugcaacuucgccaccaccccgcugugcgaguacgacggcaacaugaucuccggcuacaagaaggugauggccaccaucgacagcuuccaguccuucaacaccagcaccaugcacuucacggacgagcgcaucgaguggaaggaccccgacgggaugcugcgggaccacaucaacauccucgucaccaaggacaucgacuucgacaaccugggcgagaaccccugcaagaucgggcugcagaccuccagcaucgagggcgccuggggguccggcgugggcuucacccucacgugccuggugagccugaccgagugccccaccuuccucaccuccaucaaggccugcgacaaggcgaucugcuacggggccgagagcgucacgcugacccgcggccagaacaccgugaaggugagcgggaagggcgggcacuccggcagcaccuucaagugcugccacggcgaggacugcucccagacggggcugcacgccgccgcgccgcaccucgacaaggucaacggcaucagcgagaucgagaacuccaagguguacgacgacggggcgccccagugcggcaucaagugcugguucgucaagagcggcgaguggaucuccgggaucuucagcggcaacuggaucgugcugaucgugcugugcgucuuccuccuguucucccuggugcuccugagcgugcugugccccguccggaagcacaagaaguccuga

SEQ ID NO: 11676 - RNA, 3408 nt, Artificial Sequence
  derived and/or modified CDS sequence (opt1) from HTNV(A9)__AF035831.1__GP
augggcaucuggaaguggcuggugauggccagccucgucuggcccgccuacacccugcgcaacgcguacgacaugaagaucgagugcccgcacaccguguccuucggggagaacagcgugaucggcuacgucgagcugccccccaucccccucgccgacacgacccagauggugccggaguccagcugcuccauggacaaccaccagagccugaacaccaucaccaaguacacgcagguguccuggcgggggaaggccgaccacgcccaggccagccagaacuccuucgaggcggucagcgccgagguggaccugaagggcaccugcgugcucaagcacaagaugcuggaggaguccuaccgcagccggaaguccaucgccugcuacgaccugagcugcaacuccaccuacugcaagcccacccucuacaugaucguccccauccacgccugcaacaugaugaagagcugccugaucgcgcuggggccccaccgcgugcagguggucuacgagcggacguacugcaugaccggcgugcucaucgagggcaagugcuucgugccggaccaguccgucgugagcaucaucaagcacgggaucuucgacaucgccuccgugcacaucgucugcuucuucguggccgugaagggcaacaccuacaagaucuucgagcagaucaagaagagcuucgagagcaccugcaacgacacgaagaacaagguccagggguacuacaucugcaucgugggcgggaacuccgcccccaucuacgugcccacccuggacgacuuccgcagcauggaggccuucuccggcaucuuccggagcccccacggcgaggaccacgaccuggcgggggaggagaucgccuccuacagcaucgucggcccggccaacgccaaggugccccacuccgccagcuccgacacccucagccugaccgcguacuccgggauccccagcuacuccagccuguccauccucgccggcagcgccgaggccaagcacgucuucucccccggcuucuucccgcagcugaaccacacgaagugcgacaagaccgccaucccccugauguggaccgggaugaucgaccuccccggcuacuacgaggcgauccaccccugcaccguguucugcgugcugagcgggccgggcgccuccugcgaggccuucagcgaggggggcaucuucaacaucacgagccccaugugccuggucuccaagcagaaccgcuuccggcucaccgagcagcaggugaacuucgugugccagcgcgucgacauggacaucaucguguacugcaacggccagcggaaggugauccugaccaagacccuggucaucgggcagugcaucuacacgaucaccagccucuucucccugcugcccggcguggcccacagcaucgccguggagcucugcguccccggguuccacggcugggcgaccgccgcccugcuggugaccuucugcuucgggugggugcucaucccggccaugacguucaucguccugaccauccugaaguucaucgcgaacaucuuccacaccuccaaccaggagaacaagcucaagagcgugcugcgcaagaucaaggaggaguucgagaagaccaagggcuccauggugugcgacgucugcaaguacgagugcgagacguacaaggagcugaaggcccacggcgugagcugcccccagucccagugccccuacugcuucacccacugcgagcccaccgaggccgccuuccaggcccacuaccgggugugccaggucacccaccgcuuccgggacgaccucaagaagacggugaccccgcagaacuucacccccgggugcuaccgcacccugaaccuguuccgguacaagagccgcugcuacaucuucaccauguggguguuccuccugguccuggaguccauccucugggcggccagcgccuccgagaucccccugaacccgguguggaacgacaacgcccacggcguggggagcguccccaugcccacggaccuggagcucgacuucucccugaccagcuccagcaaguacaccuaccggcgcaagcugaccaacccccuggaggagagccaggccaucaaccuccacaucgagaucgaggagcagacgaucggcguggacgugcacgcgcuggggcacugguucgacggccggcugaaccucaagaccuccuuccacugcuacggcgccugcaccaaguacgaguacccguggcacaccgccaagugccacuacgagcgcgacuaccaguacgagacgagcugggggugcaaccccuccgacugccccggcgucgggaccggcugcaccgccugcggccuguaccuggaccagcuccgcgccguggggagcgcguacaagaucaucaccauccgguacucccgccgggugugcguccaguucggcgaggagaaccugugcaagaucaucgacaugaacgacugcuucgugagccgccacgugaaggucugcaucaucgggacgguguccaaguucagccagggcgacacccugcucuucuucgggccccuggagggcggcgggcugaucuucaagcacuggugcaccuccaccugccaguucggcgacccgggggacaucaugagcccccgggacaagggcuuccucugccccgaguuccccggguccagccgcaagaagugcaacuucgccacgaccccgcugugcgaguacgacggcaacaugguguccggcuacaagaaggucauggccaccaucgacagcuuccaguccuucaacaccagcacgaugcacuucaccgacgagcggaucgaguggaaggaccccgacgggaugcugcgcgaccacaucaacauccucgugaccaaggacaucgacuucgagaaccugggcgggaaccccugcaagaucggccugcagaccuccagcaucgagggggccuggggcuccggcgugggguucacgcucaccugccuggucagccugaccgagugccccaccuuccucacgagcaucaaggcgugcgacaaggccaucugcuacggcgccgaguccgugacccugacccgggggcagaacaccgugaaggucagcggcaaggggggccacuccggcagcacguucaagugcugccacggggaggagugcucccagaucggccugcacgccgccgcgccgcaccucgacaaggugaacgggaucagcgagaucgagaacaacaagguguacgacgacggcgccccccagugcggcaucaagugcugguucgucaaguccggggaguggaucagcggcaucuucuccgggaacuggaucgugcugaucgugcugugcgucuuccuccuguucagccugauccuccuguccauccugugccccgugcgcaagcacaagaagagcuga

SEQ ID NO: 11677 - RNA, 3408 nt, Artificial Sequence
  derived and/or modified CDS sequence (opt1) from HTNV(84FLi)__AF345636.2__GP
augggcguguggaaguggcuggucauggccagccucguguggcccgccugcacccugcgcaacguguacgacaugaagaucgagugcccgcacaccgucuccuucggggagaacagcgugaucggcuacguggagcugccgcccaugccccucgccgacacgacccagcugguccccgaguccagcugcuccauggacaaccaccagagccugaacaccaucaccaaguacacccagguguccuggcggaagaaggccgaccaggcccagagcucccagaacagcuucgagaccguguccgucgagguggaccucaaggggaccugcgugcugaagcacaagaugaucgaggagagcuaccgcucccgcaagagcaucacgugcuacgaccuguccugcaacagcacguacugcaagcccacccucuacaugaucguccccauccacgccugcaacaugaugaaguccugccugaucgcccugggccccuaccggguccaggugguguacgagcggaccuacugcaugaccggggugcucaucgagggcaagugcuucgugccggaccagagcgucguguccaucaucaagcacggcaucuucgacaucgcgagcgugaagaucgucugcuucuucguggccgugaaggggaacacguacaagcuguucgagcaggucaagaaguccuucgacuccacgugcaacgacaccgagaacaaggugcagggcuacuacaucugcaucgucgggggcaacagcgcccccaucuacgugcccacccuggacgacuuccgcuccauggaggccuucagcgggaucuuccggagcccccacggcgaggaccacgaccucgcgggcgaggagguggccagcuacuccaucgucgggccggccaacgccaaggugccccacagcgccuccagcgacacccugucccugaucgcguacagcggcauccccuccuacagcucccucagcauccugaccuccagcaccgaggccaagcacguguucucccccggguucuucccgcagcugaaccacaccaagugcgacaagacggccaucccccucaccuggaccggcaugaucgaccugcccggcuacuacgaggccauccaccugugcaccgucuucugcgugcucagcgggcccggcgccagcugcgaggcguucuccgagggcgggaucuucaacaucacgagcccgaugugccugguguccaagcagaaccaguuccgccugaccaagcagcaggucaacuucgugugccagcggguggacauggacaucgucguguacugcaacgggcagcgcaaggugauccucaccaagaccauggucaucggccagugcaucuacacgaucaccagccuguucucccugcuccccggcguggcccacagcaucgccguggagcugugcguccccggguuccacggcugggccaccgccgcgcugcucgugaccuucugcuucgggugggugcugauccccgccgucacguucaucauccugaccgugcucaaguucguggccaacaucuuccacaccuccaaccaggagaaccggcucaagagcguccugcgcaagaucaaggaggaguucgagaagaccaagggcuccauggugugcgacgugugcaaguacgagugcgagacguaccgggagcugaaggcccacggggucagcugcccgcagucccagugccccuacugcuucacccacugcgagcccaccgaggccgcguuccaggcccacuaccgcgugugccaggugacccaccgguuccgcgacgaccugaagaagaccgucacgccccagaacuucaccccgggcugcuaccggacccugaaccucuuccgcuacaagagccggugcuacaucuucaccauguggguguuccugcuggugcucgaguccauccugugggccgccagcgcguccgaggucccccugaaccccaucuggaacgacaacgcccacggcguggggagcgugccgaugcacacggaccucgagcuggacuucucccugaccagcagcuccaaguacaccuaccgccggaagcugaccaacccccucgaggagacgcaggccaucgaccugcacaucgagaucgaggagcagaccaucggcgucgacgugcacgcccuggggcacugguucgacggccgccucaaccugaagaccagcuuccacugcuacggggccugcaccaaguacgaguaccccuggcacacggcgaagugccacuacgagcgcgacuaccaguacgagaccuccuggggcugcaaccccagcgacugcccgggcguggggaccggcugcaccgccugcgggcuguaccucgaccagcugaagcccgucggcuccgccuacaagaucaucacgauccgguacagccgccgggugugcgugcaguucggcgaggagaaccugugcaaggucaucgacaugaacgacugcuucgugucccgccacgugaaggucugcaucaucgggaccgugagcaaguucucccagggcgacacccuccuguucuucgggccccuggagggcgggggccucaucuucaagcacuggugcaccagcacgugccaguucggcgaccccggggacaucauguccccgcgggacaagggcuuccugugccccgaguuccccgggagcuuccgcaagaagugcaacuucgccaccacgccccugugcgaguacgacggcaacaugaucuccggguacaagaaggugauggccaccaucgacagcuuccaguccuucaacaccagcaccaugcacuucaccgacgagcggaucgaguggaaggacccggacggcaugcuccgcgaccacaucaacauccuggucaccaaggacaucgacuucgacaaccugggcgagaaccccugcaagaucgggcuccagacguccagcaucgagggcgcguggggguccggcgugggguucacccugaccugccuggugagccucaccgagugccccacguuccugaccagcaucaaggccugcgacaaggccaucugcuacggcgccgaguccgucacccugacccggggccagaacacggugaaggucagcgggaagggcgggcacuccggcagcaccuucaagugcugccacggggaggacugcucccagaccggccuccacgccgcggcgccccaccuggacaaggugaacggcaucagcgagaucgagaacuccaagguguacgacgacggggccccgcagugcggcaucaagugcugguucgucaccagcggggaguggaucuccggcaucuucagcggcaacuggaucgugcugaucgugcucugcgucuuccugcuguucucccucgugcugcugagcgugcucugccccguccgcaagcacaagaaguccuga

SEQ ID NO: 11678 - RNA, 3408 nt, Artificial Sequence
  derived and/or modified CDS sequence (opt1) from HTNV(Aa03-161)__KT934990.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagaacuccuucgagacggugagcaccgaggucgaccugaagggcaccugcgugcugaagcacaagaugguggaggaguccuaccgcagccggaaguccaucaccugcuacgaccucagcugcaacuccacguacugcaagcccacccuguacaugaucguccccauccacgccugcaacaugaugaagagcugccugaucgcccucgggcccuaccgcgugcagguggucuacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcaccugcaacgacaccgagaacaaggugcagggguacuacaucugcaucgucggcgggaacuccgcccccaucuacgugcccacccuggacgacuuccgcagcauggaggccuucacgggcaucuuccgguccccccacggcgaggaccacgaccucgccggggaggagaccgcgaccuacagcaucgugggcccggccaacgccaaggucccccacuccgccagcuccgacacccugagccugaucgccuucuccgggauccccagcuacuccagccucuccauccugacgagcuccaccgaggcgaagcacguguucagccccggccuguucccgaagcucaaccacaccaacugcgacaagggcgccaucccccugauguggaccgggaugaucgaccugcccggcuacuacgaggccauccaccccugcacgguguucugcguccucuccgggccgggcgccagcugcgaggccuucagcgaggggggcaucuucaacaucaccucccccaugugccuggugagcaagcagaaccgcuuccggcugaccgagcagcaggugaacuucgucugccagcgcguggacguggacaucgucguguacugcaacggccagcggaaggugauccucaccaagacgcuggucaucgggcagugcaucuacaccaucaccucccuguucagccuccugcccggcguggcgcacuccaucgccguggagcugugcguccccggguuccacggcugggccaccgccgcccuccuggugacguucugcuucgggugggugcugaucccggcgaucaccuucaucauccucaccauccugaaguucaucgccaacaucuuccacaccagcaaccaggagaaccgccugaaguccguccuccggaagaucaaggaggaguucgagaagacgaagggcagcauggugugcgacgugugcaaguacgagugcgagaccuacaaggagcugaaggcccacggcgucuccugcccccagagccagugccccuacugcuucacccacugcgagcccaccgaggccgccuuccaggcgcacuacaaggugugccaggugacccaccgcuuccgggacgaccugaagaagacggucaccccgcagaacuucacccccgggugcuaccgcacccucaaccuguuccgguacaagucccgcugcuacaucuucacgauguggaucuuccugcucgugcuggagagcauccugugggccgccuccgccagcgagaccccccucaccccgguguggaacgacaacgcgcacggcgucggguccgugcccaugcacaccgaccuggagcuggacuucagccugacguccagcagcaaguacaccuaccggcgcaagcucaccaacccccuggaggaggcccaguccaucgaccugcacaucgagaucgaggagcagaccaucggcguggacguccacgcccucgggcacugguucgacggccggcugaaccugaagacgagcuuccacugcuacggcgccugcaccaaguacgaguaccccuggcacaccgccaagugccacuacgagcgcgacuaccaguacgagaccuccugggggugcaacccgagcgacugccccggcguggggacgggcugcaccgcgugcggccucuaccuggaccgccugaagcccgugggguccgccuacaagaucaucaccauccgguacagccgccgggucugcgugcaguucggcgaggagaaccucugcaagaucaucgacaugaacgacugcuucgugucccgccacgucaaggugugcaucaucgggaccgugagcaaguucucccagggcgacacgcugcuguucuucgggccccucgagggcggcgggcugaucuucaagcacuggugcaccagcaccugccaguucggcgacccgggggacaucauguccccccgggacaagggcuuccugugccccgaguuccccgggagcuuccgcaagaagugcaacuucgccaccacgccgaucugcgaguacgacggcaacauggucuccggcuaccggaaggugauggccaccaucgacagcuuccaguccuucaacaccagcaccaugcacuucacggacgagcgcaucgaguggaaggaccccgacgggaugcuccgggaccacaucaacauccuggugaccaaggacaucgacuucgacaaccugggcgagaaccccugcaagaucgggcuccagaccuccagcaucgagggcgccuggggguccggcgucggcuucacccugacgugccuggugagccucaccgagugccccaccuuccugaccagcaucaaggcgugcgacaaggccaucugcuacggggccgaguccgugacgcugacccgcggccagaacaccgucaaggugagcgggaagggcgggcacuccggcagcaccuucaagugcugccacggcgaggacugcucccagaucgggcuccacgccgccgcgccgcaccuggacaaggugaacggcaucagcgagauggagaacuccaaggucuacgacgacggggccccccagugcggcaucaagugcugguucgugaagagcggcgaguggaucuccgggaucuucagcggcaacuggaucguccugaucgugcucugcguguuccugcuguucucccucguccugcugagcauccucugccccgugcggaagcacaagaaguccuga

SEQ ID NO: 11679 - RNA, 3408 nt, Artificial Sequence
  derived and/or modified CDS sequence (opt1) from HTNV(Aa03-386)__KT934991.1__GP
augggcaucuggaaguggcuggugauggccagccucgucuggcccgugcugacccugcgcaacguguacgacaugaagaucgagugcccgcacaccaucuccuucggggagaacagcgucaucggcuacguggagcucccccccaugccccuggccgacacggcgcagcuggugccggaguccagcugcuccauggacaaccaccagagccucaacaccaucaccaaguacacccaggucuccuggcgggggaaggccgaccagagccaguccagccagaacuccuucgagacggugagcaccgagguggaccugaagggcaccugcguccugaagcacaagaugguggaggaguccuaccgcagccggaaguccaucaccugcuacgaccucagcugcaacuccacguacugcaagcccacccuguacaugaucgugcccauccacgccugcaacaugaugaagagcugccugaucgcccucgggcccuaccgcguccaggugguguacgagcggaccuacugcaugaccggcguccugaucgagggcaagugcuucgugccggaccaguccguggucagcaucaucaagcacgggaucuucgacaucgccagcgugcacaucgugugcuucuucgucgcggugaagggcaacacguacaagaucuucgagcaggugaagaaguccuucgagagcaccugcaacgacaccgagaacaagguccagggguacuacaucugcaucgugggcgggaacuccgcccccaucuacguccccacccuggacgacuuccgcagcauggaggccuucacgggcaucuuccgguccccccacggcgaggaccacgaccucgccggggaggagaccgcgaccuacagcaucgugggcccggccaacgccaaggugccccacuccgccagcuccgacacccugagccugaucgccuucuccgggauccccagcuacuccagccucuccauccugacgagcuccaccgaggcgaagcacgucuucagccccggccuguucccgaagcucaaccacaccaacugcgacaagggcgccaucccccugauguggaccgggaugaucgaccugcccggcuacuacgaggccauccaccccugcacgguguucugcgugcucuccgggccgggcgccagcugcgaggccuucagcgaggggggcaucuucaacaucaccucccccaugugccuggucagcaagcagaaccgcuuccggcugaccgagcagcaggugaacuucgugugccagcgcgucgacguggacaucguggucuacugcaacggccagcggaaggugauccucaccaagacgcuggugaucgggcagugcaucuacaccaucaccucccuguucagccuccugcccggcgucgcgcacuccaucgccguggagcugugcgugcccggguuccacggcugggccaccgccgcccuccuggucacguucugcuucgggugggugcugaucccggcgaucaccuucaucauccucaccauccugaaguucaucgccaacaucuuccacaccagcaaccaggagaaccgccugaaguccgugcuccggaagaucaaggaggaguucgagaagacgaagggcagcauggucugcgacgugugcaaguacgagugcgagaccuacaaggagcugaaggcccacggcguguccugcccccagagccagugccccuacugcuucacccacugcgagcccaccgaggccgccuuccaggcgcacuacaaggucugccaggugacccaccgcuuccgggacgaccugaagaagacggugaccccgcagaacuucacccccgggugcuaccgcacccucaaccuguuccgguacaagucccgcugcuacaucuucacgauguggaucuuccugcucguccuggagagcauccugugggccgccuccgccagcgagaccccccucaccccgguguggaacgacaacgcgcacggcgugggguccguccccaugcacaccgaccuggagcuggacuucagccugacguccagcagcaaguacaccuaccggcgcaagcucaccaacccccuggaggaggcccaguccaucgaccugcacaucgagaucgaggagcagaccaucggcguggacgugcacgcccucgggcacugguucgacggccggcugaaccugaagacgagcuuccacugcuacggcgccugcaccaaguacgaguaccccuggcacaccgccaagugccacuacgagcgcgacuaccaguacgagaccuccugggggugcaacccgagcgacugccccggcgucgggacgggcugcaccgcgugcggccucuaccuggaccgccugaagcccgugggguccgccuacaagaucaucaccauccgguacagccgccgggugugcguccaguucggcgaggagaaccucugcaagaucaucgacaugaacgacugcuucgugucccgccacgugaaggucugcaucaucgggaccgugagcaaguucucccagggcgacacgcugcuguucuucgggccccucgagggcggcgggcugaucuucaagcacuggugcaccagcaccugccaguucggcgacccgggggacaucauguccccccgggacaagggcuuccugugccccgaguuccccgggagcuuccgcaagaagugcaacuucgccaccacgccgaucugcgaguacgacggcaacaugguguccggcuacaagaaggucauggccaccaucgacagcuuccaguccuucaacaccagcaccaugcacuucacggacgagcggaucgaguggaaggaccccgacgggaugcuccgcgaccacaucaacauccuggugaccaaggacaucgacuucgacaaccugggcgagaaccccugcaagaucgggcuccagaccuccagcaucgagggcgccuggggguccggcgugggcuucacccugacgugccuggucagccucaccgagugccccaccuuccugaccagcaucaaggcgugcgacaaggccaucugcuacggggccgaguccgugacgcugacccggggccagaacaccgugaaggucagcgggaagggcgggcacuccggcagcaccuucaagugcugccacggcgaggacugcucccagaucgggcuccacgccgccgcgccgcaccuggacaaggugaacggcaucagcgagauggagaacuccaagguguacgacgacggggccccccagugcggcaucaagugcugguucgucaagagcggcgaguggaucuccgggaucuucagcggcaacuggaucgugcugaucguccucugcaucuuccugcuguucucccucgugcugcugagcauccucugccccgugcgcaagcacaagaaguccuga

SEQ ID NO: 11680 - RNA, 3408 nt, Artificial Sequence
  derived and/or modified CDS sequence (opt1) from HTNV(Aa04-722)__KU207182.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagaacuccuucgagacggugagcaccgaggucgaccugaagggcaccugcgugcugaagcacaagaugguggaggaguccuaccgcagccggaaguccaucaccugcuacgaccucagcugcaacuccacguacugcaagcccacccuguacaugaucguccccauccacgccugcaacaugaugaagagcugccugaucgcccucgggcccuaccgcgugcagguggucuacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcaccugcaacgacaccgagaacaaggugcagggguacuacaucugcaucgucggcgggaacuccgcccccaucuacgugcccacccuggacgacuuccgcagcauggaggccuucacgggcaucuuccgguccccccacggcgaggaccacgaccucgccggggaggagaccgcgaccuacagcaucgugggcccggccaacgccaaggucccccacuccgccagcuccgacacccugagccugaucgccuucuccgggauccccagcuacuccagccucuccauccugacgagcuccaccgaggcgaagcacguguucagccccggccuguucccgaagcucaaccacaccaacugcgacaagggcgccaucccccugauguggaccgggaucaucgaccugcccggcuacuacgaggccauccaccccugcacgguguucugcguccucuccgggccgggcgccagcugcgaggccuucagcgaggggggcaucuucaacaucaccucccccaugugccuggugagcaagcagaaccgcuuccggcugaccgagcagcaggugaacuucgucugccagcgcguggacguggacaucgucguguacugcaacggccagcggaaggugauccucaccaagacgcuggucaucgggcagugcaucuacaccaucaccucccuguucagccuccugcccggcguggcgcacuccaucgccguggagcugugcguccccggguuccacggcugggccaccgccgcccuccuggugacguucugcuucgggugggugcugaucccggcgaucaccuucaucauccucaccauccugaaguucaucgccaacaucuuccacaccagcaaccaggagaaccgccugaaguccguccuccggaagaucaaggaggaguucgagaagacgaagggcagcauggugugcgacgugugcaaguacgagugcgagaccuacaaggagcugaaggcccacggcgucuccugcccccagagccagugccccuacugcuucacccacugcgagcccaccgaggccgccuuccaggcgcacuacaaggugugccaggugacccaccgcuuccgggacgaccugaagaagacggucaccccgcagaacuucacccccgggugcuaccgcacccucaaccuguuccgguacaagucccgcugcuacaucuucacgauguggaucuuccugcucgugcuggagagcauccugugggccgccuccgccagcgagaccccccucaccccgguguggaacgacaacgcgcacggcgucggguccgugcccaugcacaccgaccuggagcuggacuucagccugacguccagcagcaaguacaccuaccggcgcaagcucaccaacccccuggaggaggcccaguccaucgaccugcacaucgagaucgaggagcagaccaucggcguggacguccacgcccucgggcacugguucgacggccggcugaaccugaagacgagcuuccacugcuacggcgccugcaccaaguacgaguaccccuggcacaccgccaagugccacuacgagcgcgacuaccaguacgagaccuccugggggugcaacccgagcgacugccccggcguggggacgggcugcaccgcgugcggccucuaccuggaccgccugaagcccgugggguccgccuacaagaucaucaccauccgguacagccgccgggucugcgugcaguucggcgaggagaaccucugcaagaucaucgacaugaacgacugcuucgugucccgccacgucaaggugugcaucaucgggaccgugagcaaguucucccagggcgacacgcugcuguucuucgggccccucgagggcggcgggcugaucuucaagcacuggugcaccagcaccugccaguucggcgacccgggggacaucauguccccccgggacaagggcuuccugugccccgaguuccccgggagcuuccgcaagaagugcaacuucgccaccacgccgaucugcgaguacgacggcaacauggucuccggcuacaagaaggugauggccaccaucgacagcuuccaguccuucaacaccagcaccaugcacuucacggacgagcggaucgaguggaaggaccccgacgggaugcuccgcgaccacaucaacauccuggugaccaaggacaucgacuucgacaaccugggcgagaaccccugcaagaucgggcuccagaccuccagcaucgagggcgccuggggguccggcgucggcuucacccugacgugccuggugagccucaccgagugccccaccuuccugaccagcaucaaggcgugcgacaaggccaucugcuacggggccgaguccgugacgcugacccggggccagaacaccgucaaggugagcgggaagggcgggcacuccggcagcaccuucaagugcugccacggcgaggacugcucccagaucgggcuccacgccgccgcgccgcaccuggacaaggugaacggcaucagcgagauggagaacuccaaggucuacgacgacggggccccccagugcggcaucaagugcugguucgugaagagcggcgaguggaucuccgggaucuucagcggcaacuggaucguccugaucgugcucugcguguuccugcuguucucccucguccugcugagcauccucugccccgugcgcaagcacaagaaguccuga

SEQ ID NO: 11681 - RNA, 3408 nt, Artificial Sequence
  derived and/or modified CDS sequence (opt1) from HTNV(Aa05-190)__KT934993.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccgcccaugccccugacggacaccgcccagcugguccccgaguccagcugcuccauggacaaccaccagagccucaacaccaucaccaaguacacccagguguccuggcgggggaaggcggaccagagccaguccagccagaacuccuucgagaccgugagcaccgaggucgaccugaaggggaccugcgugcugaagcacaagaugaucgaggaguccuaccgcagccggaaguccaucacgugcuacgaccucagcugcaacuccaccuacugcaagcccacccuguacaugaucgugcccauccacgccugcaacaugaugaaguccugccugaucgcccucgggcccuaccgcguccaggugguguacgagcggaccuacugcaugacgggcguccugaucgagggcaagugcuucgugccggaccaguccguggucagcaucaucaagcacgggaucuucgacaucgccagcgugcacaucgugugcuucuucgucgccgugaagggcaacaccuacaagaucuucgagcaggucaagaaguccuucgagagcacgugcaacgacaccgagaacaaggugcagggguacuacaucugcaucgugggcgggaacuccgcgcccaucuacguccccacgcuggacgacuuccgcagcauggaggccuucaccggcaucuuccggagcccccacggcgaggaccacgaccucgccggggaggagaccgccaccuacagcaucgugggcccggcgaacgccaaggugccccacuccgccagcuccgacacgcugagccugaucgccuucuccgggauccccagcuacuccagccucuccauccugaccagcuccaccgaggccaagcacgucuucagccccggccuguucccgaagcucaaccacaccaacugcgacaagggcgcgaucccccugauguggacggggaugaucgaccugcccggcuacuacgaggccauccaccccugcaccguguucugcgugcucuccgggccgggcgccagcugcgaggccuucagcgagggcggcaucuucaacaucaccucccccaugugccuggucagcaagcagaaccgcuuccggcugaccgagcagcaggucaacuucgugugccagcgcguggacguggacaucguggucuacugcaacggccagcggaaggugauccucacgaagacccuggugaucgggcagugcaucuacaccaucaccucccuguucagccuccugcccggcgucgcccacuccaucgcgguggagcugugcgugcccggguuccacggcugggccacggccgcccuccuggucaccuucugcuucgggugggugcugaucccggccaucaccuucaucauccucaccauccugaaguucaucgcgaacaucuuccacacgagcaaccaggagaaccgccugaaguccgugcuccggaagaucaaggaggaguucgagaagaccaagggcagcauggucugcgacgugugcaaguacgagugcgagaccuacaaggagcugaaggcccacggcguguccugcccccagagccagugccccuacugcuucacccacugcgagcccaccgaggccgccuuccaggcccacuacaaggucugccaggugacgcaccgcuuccgggacgaccugaagaagaccgugaccccgcagaacuucacccccgggugcuaccgcacgcucaaccuguuccgguacaagucccgcugcuacaucuucaccauguggaucuuccugcucguccuggagagcauccugugggcggccuccgccagcgagacgccccucaccccgguguggaacgacaacgcccacggcgugggguccguccccaugcacaccgaccuggagcuggacuucagccugaccuccagcagcaaguacaccuaccggcgcaagcucaccaacccccuggaggaggcgcaguccaucgaccugcacaucgagaucgaggagcagacgaucggcguggacgugcacgcccucgggcacugguucgacggccggcugaaccugaagaccagcuuccacugcuacggcgccugcaccaaguacgaguaccccuggcacaccgccaagugccacuacgagcgcgacuaccaguacgagacguccugggggugcaacccgagcgacugccccggcgucgggaccggcugcaccgccugcggccucuaccuggaccgccugaagcccgugggguccgcguacaagaucaucaccauccgguacagccgccgggugugcguccaguucggcgaggagaaccucugcaagaucaucgacaugaacgacugcuucgugucccgccacgugaaggucugcaucaucgggacggugagcaaguucucccagggcgacacccugcuguucuucgggccccucgagggcggcgggcugaucuucaagcacuggugcaccagcacgugccaguucggcgacccgggggacaucaugagcccccgggacaagggcuuccugugccccgaguuccccggguccuuccgcaagaagugcaacuucgccaccaccccgaucugcgaguacgacggcaacaugguguccggcuacaagaaggucauggccaccaucgacagcuuccaguccuucaacaccagcacgaugcacuucaccgacgagcggaucgaguggaaggaccccgacgggaugcuccgcgaccacaucaacauccuggugaccaaggacaucgacuucgacaaccugggcgagaaccccugcaagaucgggcuccagaccuccagcaucgagggcgccuggggguccggcgugggcuucacgcugaccugccuggucagccucaccgagugccccaccuuccugacgagcaucaaggccugcgacaaggcgaucugcuacggggccgaguccgugacccugacccggggccagaacaccgugaaggucagcgggaagggcgggcacuccggcagcaccuucaagugcugccacggcgaggacugcucccagaucgggcuccacgccgccgccccgcaccuggacaaggugaacggcaucagcgagauggagaacuccaagguguacgacgacggggcgccccagugcggcaucaagugcugguucgucaagagcggcgaguggaucuccgggaucuucagcggcaacuggaucgugcugaucguccucugcguguuccugcuguucucccucgugcugcugagcauccucugccccguccgcaagcacaagaaguccuga

SEQ ID NO: 11682 - RNA, 3408 nt, Artificial Sequence
  derived and/or modified CDS sequence (opt1) from HTNV(Aa09-1000)__KT935001.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagaacuccuucgagacggugagcaccgaggucgaccugaagggcaccugcgugcugaagcacaagaugguggaggaguccuaccgcagccggaaguccaucaccugcuacgaccucagcugcaacuccacguacugcaagcccacccuguacaugaucguccccauccacgccugcaacaugaugaagagcugccugaucgcccucgggcccuaccgcgugcagguggucuacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcaccugcaacgacaccgagaacaaggugcagggguacuacaucugcaucgucggcgggaacuccgcccccaucuacgugcccacccuggacgacuuccgcagcauggaggccuucacgggcaucuuccgguccccccacggcgaggaccacgaccucgccggggaggagaccgcgaccuacagcaucgugggcccggccaacgccaaggucccccacuccgccagcuccgacacccugagccugaucgccuucuccgggauccccagcuacuccagccucuccauccugacgagcuccaccgaggcgaagcacguguucagccccggccuguucccgaagcucaaccacaccaacugcgacaagggcgccaucccccugauguggaccgggaugaucgaccugcccggcuacuacgaggccauccaccccugcacgguguucugcguccucuccgggccgggcgccagcugcgaggccuucagcgaggggggcaucuucaacaucaccucccccaugugccuggugagcaagcagaaccgcuuccggcugaccgagcagcaggugaacuucgucugccagcgcguggacguggacaucgucguguacugcaacggccagcggaaggugauccucaccaagacgcuggucaucgggcagugcaucuacaccaucaccucccuguucagccuccugcccggcguggcgcacuccaucgccguggagcugugcguccccggguuccacggcugggccaccgccgcccuccuggugacguucugcuucgggugggugcugaucccggcgaucaccuucaucauccucaccauccugaaguucaucgccaacaucuuccacaccagcaaccaggagaaccgccugaaguccguccuccggaagaucaaggaggaguucgagaagacgaagggcagcauggugugcgacgugugcaaguacgagugcgagaccuacaaggagcugaaggcccacggcgucuccugcccccagagccagugccccuacugcuucacccacugcgagcccaccgaggccgccuuccaggcgcacuacaaggugugccaggugacccaccgcuuccgggacgaccugaagaagacggucaccccgcagaacuucacccccgggugcuaccgcacccucaaccuguuccgguacaagucccgcugcuacaucuucacgauguggaucuuccugcucgugcuggagagcauccugugggccgccuccgccagcgagaccccccucaccccgguguggaacgacaacgcgcacggcgucggguccgugcccaugcacaccgaccuggagcuggacuucagccugacguccagcagcaaguacaccuaccggcgcaagcucaccaacccccuggaggaggcccaguccaucgaccugcacaucgagaucgaggagcagaccaucggcguggacguccacgcccucgggcacugguucgacggccggcugaaccugaagacgagcuuccacugcuacggcgccugcaccaaguacgaguaccccuggcacaccgccaagugccacuacgagcgcgacuaccaguacgagaccuccugggggugcaacccgagcgacugccccggcguggggacgggcugcaccgcgugcggccucuaccuggaccgccugaagcccgugggguccgccuacaagaucaucaccauccgguacagccgccgggucugcgugcaguucggcgaggagaaccucugcaagaucaucgacaugaacgacugcuucgugucccgccacgucaaggugugcaucaucgggaccgugagcaaguucucccagggcgacacgcugcuguucuucgggccccucgagggcggcgggcugaucuucaagcacuggugcaccagcaccugccaguucggcgacccgggggacaucauguccccccgggacaagggcuuccugugccccgaguuccccgggagcuuccgcaagaagugcaacuucgccaccacgccgaucugcgaguacgacggcaacauggucuccggcuacaagaaggugauggccaccaucgacagcuuccaguccuucaacaccagcaccaugcacuucacggacgagcggaucgaguggaaggaccccgacgggaugcuccgcgaccacaucaacauccuggugaccaaggacaucgacuucgacaaccugggcgagaaccccugcaagaucgggcuccagaccuccagcaucgagggcgccuggggguccggcgucggcuucacccugacgugccuggugagccucaccgagugccccaccuuccugaccagcaucaaggcgugcgacaaggccaucugcuacggggccgaguccgugacgcugacccggggccagaacaccgucaaggugagcgggaagggcgggcacuccggcagcaccuucaagugcugccacggcgaggacugcucccagaucgggcuccacgccgccgcgccgcaccuggacaaggugaacggcaucagcgagauggagaacuccaaggucuacgacgacggggccccccagugcggcaucaagugcugguucgugaagagcggcgaguggaucuccgggaucuucagcggcaacuggaucguccugaucgugcucugcguguuccugcuguucucccucguccugcugagcauccucugccccgugcgcaagcacaagaaguccuga

SEQ ID NO: 11683 - RNA, 3408 nt, Artificial Sequence
  derived and/or modified CDS sequence (opt1) from HTNV(Aa09-948)__KT935000.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagaacuccuucgagacggugagcaccgaggucgaccugaagggcaccugcgugcugaagcacaagaugguggaggaguccuaccgcagccggaaguccaucaccugcuacgaccucagcugcaacuccacguacugcaagcccacccuguacaugaucguccccauccacgccugcaacaugaugaagagcugccugaucgcccucgggcccuaccgcgugcagguggucuacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcaccugcaacgacaccgagaacaaggugcagggguacuacaucugcaucgucggcgggaacuccgcccccaucuacgugcccacccuggacgacuuccgcagcauggaggccuucacgggcaucuuccgguccccccacggcgaggaccacgaccucgccggggaggagaccgcgaccuacagcaucgugggcccggccaacgccaaggucccccacuccgccagcuccgacacccugagccugaucgccuucuccgggauccccagcuacuccagccucuccauccugacgagcuccaccgaggcgaagcacguguucagccccggccuguucccgaagcucaaccacaccaacugcgacaagggcgccaucccccugauguggaccgggaugaucgaccugcccggcuacuacgaggccauccaccccugcacgguguucugcguccucuccgggccgggcgccagcugcgaggccuucagcgaggggggcaucuucaacaucaccucccccaugugccugaucagcaagcagaaccgcuuccggcugaccgagcagcaggugaacuucgugugccagcgcgucgacguggacaucguggucuacugcaacggccagcggaaggugauccucaccaagacgcuggugaucgggcagugcaucuacaccaucaccucccuguucagccuccugcccggcgucgcgcacuccaucgccguggagcugugcgugcccggguuccacggcugggccaccgccgcccuccuggucacguucugcuucgggugggugcugaucccggcgaucaccuucaucauccucaccauccugaaguucaucgccaacaucuuccacaccagcaaccaggagaaccgccugaaguccgugcuccggaagaucaaggaggaguucgagaagacgaagggcagcauggucugcgacgugugcaaguacgagugcgagaccuacaaggagcugaaggcccacggcguguccugcccccagagccagugccccuacugcuucacccacugcgagcccaccgaggccgccuuccaggcgcacuacaaggucugccaggugacccaccgcuuccgggacgaccugaagaagacggugaccccgcagaacuucacccccgggugcuaccgcacccucaaccuguuccgguacaagucccgcugcuacaucuucacgauguggaucuuccugcucguccuggagagcauccugugggccgccuccgccagcgagaccccccucaccccgguguggaacgacaacgcgcacggcgugggguccguccccaugcacaccgaccuggagcuggacuucagccugacguccagcagcaaguacaccuaccggcgcaagcucaccaacccccuggaggaggcccaguccaucgaccugcacaucgagaucgaggagcagaccaucggcguggacgugcacgcccucgggcacugguucgacggccggcugaaccugaagacgagcuuccacugcuacggcgccugcaccaaguacgaguaccccuggcacaccgccaagugccacuacgagcgcgacuaccaguacgagaccuccugggggugcaacccgagcgacugccccggcgucgggacgggcugcaccgcgugcggccucuaccuggaccgccugaagcccgugggguccgccuacaagaucaucaccauccgguacagccgccgggugugcguccaguucggcgaggagaaccucugcaagaucaucgacaugaacgacugcuucgugucccgccacgugaaggucugcaucaucgggaccgugagcaaguucucccagggcgacacgcugcuguucuucgggccccucgagggcggcgggcugaucuucaagcacuggugcaccagcaccugccaguucggcgacccgggggacaucauguccccccgggacaagggcuuccugugccccgaguuccccgggagcuuccgcaagaagugcaacuucgccaccacgccgaucugcgaguacgacggcaacaugguguccggcuacaagaaggucauggccaccaucgacagcuuccaguccuucaacaccagcaccaugcacuucacggacgagcggaucgaguggaaggaccccgacgggaugcuccgcgaccacaucaacauccuggugaccaaggacaucgacuucgacaaccugggcgagaaccccugcaagaucgggcuccagaccuccagcaucgagggcgccuggggguccggcgugggcuucacccugacgugccuggucagccucaccgagugccccaccuuccugaccagcaucaaggcgugcgacaaggccaucugcuacggggccgaguccgugacgcugacccggggccagaacaccgugaaggucagcgggaagggcgggcacuccggcagcaccuucaagugcugccacggcgaggacugcucccagaucgggcuccacgccgccgcgccgcaccuggacaaggugaacggcaucagcgagauggagaacuccaagguguacgacgacggggccccccagugcggcaucaagugcugguucgucaagagcggcgaguggaucuccgggaucuucagcggcaacuggaucgugcugaucguccucugcguguuccugcuguucucccucgugcugcugagcauccucugccccguccgcaagcacaagaaguccuga

SEQ ID NO: 11684 - RNA, 3408 nt, Artificial Sequence
  derived and/or modified CDS sequence (opt1) from HTNV(Aa10-434)__KT935004.1__GP
augggcaucuggaaguggcuggugauggccagccucgucuggcccgugcugacccugcgcaacguguacgacaugaagaucgagugcccgcacaccgucuccuucgggggcaacagcgugaucggguacguggagcucccgcccaugccccuggccgacacggcccagcugguccccgaguccagcugcuccauggacaaccaccagagccucaacaccaucaccaaguacacccagguguccuggcggggcaaggccgaccagagccaguccagccagaucuccuucgagacggugagcaccgaggucgaccugaaggggaccugcgugcugaagcacaagaugguggaggaguccuaccgcagccggaaguccaucacgugcuacgaccucagcugcaacuccaccuacugcaagcccacccuguacaugaucguccccauccacgccugcaacaugaugaaguccugccugaucgcccucggccccuaccgcguccaggugguguacgagcggaccuacugcaugaccggcgugcugaucgaggggaagugcuucgugccggaccaguccgucgugagcaucaucaagcacggcaucuucgacaucgccagcgugcacaucgucugcuucuucguggcggugaaggggaacacguacaagaucuucgagcaggucaagaaguccuucgagagcacgugcaacgacaccgagaacaaggugcagggcuacuacaucugcaucgucgggggcaacuccgcccccaucuacgugcccacccuggacgacuuccgcagcauggaggccuucaccggcaucuuccggagcccccacggggaggaccacgaccucgccggcgaggagaccgcgaccuacagcaucguggggccggccaacgccaaggucccccacuccgccagcuccgacacccugagccugaucgccuucuccggcauccccagcuacuccagccucuccauccugacgagcuccaccgaggcgaagcacguguucagccccggccuguucccgaagcucaaccacaccaacugcgacaagggggccaucccccugauguggaccggcaugaucgaccugcccggguacuacgaggccauccaccccugcacgguguucugcguccucuccggcccgggggccagcugcgaggccuucagcgagggcggcaucuucaacaucaccucccccaugugccuggugagcaagcagaaccgcuuccggcugaccgagcagcaggucaacuucgugugccagcgcguggacguggacaucgucguguacugcaacgggcagcggaaggugauccucaccaagacgcuggucaucggccagugcaucuacaccaucaccucccuguucagccuccugcccgggguggcgcacuccaucgccguggagcugugcguccccggcuuccacgggugggccaccgccgcccuccuggugacguucugcuucggcugggugcugaucccggcgaucaccuucaucauccucaccauccugaaguucaucgccaacaucuuccacaccagcaaccaggagaaccgccugaaguccguccuccggaagaucaaggaggaguucgagaagacgaagggcagcauggugugcgacgugugcaaguacgagugcgagaccuacaaggagcugaaggcccacggggucuccugcccccagagccagugccccuacugcuucacccacugcgagcccaccgaggccgccuuccaggcgcacuacaaggugugccaggugacccaccgcuuccgggacgaccugaagaagacggucaccccgcagaacuucacccccggcugcuaccgcacccucaaccuguuccgguacaagucccgcugcuacaucuucacgauguggaucuuccugcucgugcuggagagcauccugugggccgccuccgccagcgagacgccccucaccccgguguggaacgacaacgcgcacggggucggcuccgugcccaugcacaccgaccuggagcuggacuucagccugaccuccagcagcaaguacaccuaccggcgcaagcucaccaacccccuggaggaggcccaguccaucgaccugcacaucgagaucgaggagcagaccaucgggguggacguccacgcccucggccacugguucgacggccggcugaaccugaagacgagcuuccacugcuacggggccugcaccaaguacgaguaccccuggcacaccgccaagugccacuacgagcgcgacuaccaguacgagaccuccuggggcugcaacccgagcgacugccccggggugggcacgggcugcaccgcgugcgggcucuaccuggaccgccugaagcccgugggcuccgccuacaagaucaucaccauccgguacagccgccgggucugcgugcaguucggggaggagaaccucugcaagaucaucgacaugaacgacugcuucgugucccgccacgucaaggugugcaucaucggcaccaucagcaaguucucccagggggacacgcugcuguucuucggcccccucgagggcgggggccugaucuucaagcacuggugcaccagcacgugccaguucggggacccgggcgacaucaugagcccccgggacaagggguuccugugccccgaguuccccggcuccuuccgcaagaagugcaacuucgccaccaccccgaucugcgaguacgacggcaacaugguguccggguacaagaaggucauggccaccaucgacagcuuccaguccuucaacaccagcaccaugcacuucacggacgagcggaucgaguggaaggaccccgacggcaugcuccgcgaccacaucaacauccuggugaccaaggacaucgacuucgacaaccugggggagaaccccugcaagaucggccuccaggccuccagcaucgagggggcguggggcuccggcgugggguucacccugaccugccuggucagccucacggagugccccaccuuccugaccagcaucaaggccugcgacaaggccaucugcuacggcgccgaguccgugacccugacgcgggggcagaacaccgugaaggucagcggcaagggcgggcacuccggcagcaccuucaagugcugccacggggaggacugcucccagaucggccuccacgccgcggccccgcaccuggacaaggugaacgggaucagcgagauggagaacuccaagguguacgacgacggcgcgccccagugcggcaucaagugcugguucgucaagagcggggaguggaucuccggcaucuucagcgggaacuggaucgugcugaucguccucugcguguuccugcuguucucccucgugcugcugagcauccucugccccguccgcaagcacaagaaguccuga

SEQ ID NO: 11685 - RNA, 3408 nt, Artificial Sequence
  derived and/or modified CDS sequence (opt1) from HTNV(Aa10-518)__KT935005.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagaacuccuucgagacggugagcaccgaggucgaccugaagggcaccugcgugcugaagcacaagaugguggaggaguccuaccgcagccggaaguccaucaccugcuacgaccucagcugcaacuccacguacugcaagcccacccuguacaugaucguccccauccacgccugcaacaugaugaagagcugccugaucgcccucgggcccuaccgcgugcagguggucuacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcaccugcaacgacaccaagaacaaggugcagggguacuacaucugcaucgucggcgggaacuccgcccccaucuacgugcccacccuggacgacuuccgcagcauggaggccuucacgggcaucuuccgguccccccacggcgaggaccacgaccucgccggggaggagaccgcgaccuacagcaucgugggcccggccaacgccaaggucccccacuccgccagcuccgacacccugagccugaucgccuucuccgggauccccagcuacuccagccucuccauccugacgagcuccaccgaggcgaagcacguguucagccccggccuguucccgaagcucaaccacaccaacugcgacaagggcgccaucccccugauguggaccgggaugaucgaccugcccggcuacuacgaggccauccaccccugcacgguguucugcguccucuccgggccgggcgccagcugcgaggccuucagcgaggggggcaucuucaacaucaccucccccaugugccuggugagcaagcagaaccgcuuccggcugaccgagcagcaggugaacuucgucugccagcgcguggacguggacaucgucguguacugcaacggccagcggaaggugauccucaccaagacgcuggucaucgggcagugcaucuacaccaucaccucccuguucagccuccugcccggcguggcgcacuccaucgccguggagcugugcguccccggguuccacggcugggccaccgccgcccuccuggugacguucugcuucgggugggugcugaucccggcgaucaccuucaucauccucaccauccugaaguucaucgccaacaucuuccacaccagcaaccaggagaaccgccugaaguccguccuccggaagaucaaggaggaguucgagaagacgaagggcagcauggugugcgacgugugcaaguacgagugcgagaccuacaaggagcugaaggcccacggcgucuccugcccccagagccagugccccuacugcuucacccacugcgagcccaccgaggccgccuuccaggcgcacuacaaggugugccaggugacccaccgcuuccgggacgaccugaagaagacggucaccccgcagaacuucacccccgggugcuaccgcacccucaaccuguuccgguacaagucccgcugcuacaucuucacgauguggaucuuccugcucgugcuggagagcauccugugggccgccuccgccagcgagaccccccucaccccgguguggaacgacaacgcgcacggcgucggguccgugcccaugcacaccgaccuggagcuggacuucagccugacguccagcagcaaguacaccuaccggcgcaagcucaccaacccccuggaggaggcccaguccaucgaccugcacaucgagaucgaggagcagaccaucggcguggacguccacgcccucgggcacugguucgacggccggcugaaccugaagacgagcuuccacugcuacggcgccugcaccaaguacgaguaccccuggcacaccgccaagugccacuacgagcgcgacuaccaguacgagaccuccugggggugcaacccgagcgacugccccggcguggggacgggcugcaccgcgugcggccucuaccuggaccgccugaagcccgugggguccgccuacaagaucaucaccauccgguacagccgccgggucugcgugcaguucggcgaggagaaccucugcaagaucguggacaugaacgacugcuucgucucccgccacgugaaggugugcaucaucgggaccgucagcaaguucucccagggcgacacgcugcuguucuucgggccccucgagggcggcgggcugaucuucaagcacuggugcaccagcaccugccaguucggcgacccgggggacaucauguccccccgggacaagggcuuccugugccccgaguuccccgggagcuuccgcaagaagugcaacuucgccaccacgccgaucugcgaguacgacggcaacaugguguccggcuacaagaaggugauggccaccaucgacagcuuccaguccuucaacaccagcaccaugcacuucacggacgagcggaucgaguggaaggaccccgacgggaugcuccgcgaccacaucaacauccuggucaccaaggacaucgacuucgacaaccugggcgagaaccccugcaagaucgggcuccagaccuccagcaucgagggcgccuggggguccggcgugggcuucacccugacgugccuggugagccucaccgagugccccaccuuccugaccagcaucaaggcgugcgacaaggccaucugcuacggggccgaguccgucacgcugacccggggccagaacaccgugaaggugagcgggaagggcgggcacuccggcagcaccuucaagugcugccacggcgaggacugcucccagaucgggcuccacgccgccgcgccgcaccuggacaaggucaacggcaucagcgagauggagaacuccaagguguacgacgacggggccccccagugcggcaucaagugcugguucgucaagagcggcgaguggaucuccgggaucuucagcggcaacuggaucgugcugaucgugcucugcgucuuccugcuguucucccucgugcugcugagcauccucugccccgugcgcaagcacaagaaguccuga

SEQ ID NO: 11686 - RNA, 3408 nt, Artificial Sequence
  derived and/or modified CDS sequence (opt1) from HTNV(Aa10-561)__KT935006.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagaucuccuucgagacggugagcaccgaggucgaccugaagggcaccugcgugcugaagcacaagaugguggaggaguccuaccgcagccggaaguccaucaccugcuacgaccucagcugcaacuccacguacugcaagcccacccuguacaugaucguccccauccacgccugcaacaugaugaagagcugccugaucgcccucgggcccuaccgcgugcagguggucuacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcaccugcaacgacaccgagaacaaggugcagggguacuacaucugcaucgucggcgggaacuccgcccccaucuacgugcccacccuggacgacuuccgcagcauggaggccuucacgggcaucuuccgguccccccacggcgaggaccacgaccucgccggggaggagaccgcgaccuacagcaucgugggcccggccaacgccaaggucccccacuccgccagcuccgacacccugagccugaucgccuucuccgggauccccagcuacuccagccucuccauccugacgagcuccaccgaggcgaagcacguguucagccccggccuguucccgaagcucaaccacaccaacugcgacaagggcgccaucccccugauguggaccgggaugaucgaccugcccggcuacuacgaggccauccaccccugcacgguguucugcguccucuccgggccgggcgccagcugcgaggccuucagcgaggggggcaucuucaacaucaccucccccaugugccuggugagcaagcagaaccgcuuccggcugaccgagcagcaggugaacuucgucugccagcgcguggacguggacaucgucguguacugcaacggccagcggaaggugauccucaccaagacgcuggucaucgggcagugcaucuacaccaucaccucccuguucagccuccugcccggcguggcgcacuccaucgccguggagcugugcguccccggguuccacggcugggccaccgccgcccuccuggugacguucugcuucgggugggugcugaucccggcgaucaccuucaucauccucaccauccugaaguucaucgccaacaucuuccacaccagcaaccaggagaaccgccugaaguccguccuccggaagaucaaggaggaguucgagaagacgaagggcagcauggugugcgacgugugcaaguacgagugcgagaccuacaaggagcugaaggcccacggcgucuccugcccccagagccagugccccuacugcuucacccacugcgagcccaccgaggccgccuuccaggcgcacuacaaggugugccaggugacccaccgcuuccgggacgaccugaagaagacggucaccccgcagaacuucacccccgggugcuaccgcacccucaaccuguuccgguacaagucccgcugcuacaucuucacgauguggaucuuccugcucgugcuggagagcauccugugggccgccuccgccagcgagaccccccucaccccgguguggaacgacaacgcgcacggcgucggguccgugcccaugcacaccgaccuggagcuggacuucagccugacguccagcagcaaguacaccuaccggcgcaagcucaccaacccccuggaggaggcccaguccaucgaccugcacaucgagaucgaggagcagaccaucggcguggacguccacgcccucgggcacugguucgacggccggcugaaccugaagacgagcuuccacugcuacggcgccugcaccaaguacgaguaccccuggcacaccgccaagugccacuacgagcgcgacuaccaguacgagaccuccugggggugcaacccgagcgacugccccggcguggggacgggcugcaccgcgugcggccucuaccuggaccgccugaagcccgugggguccgccuacaagaucaucaccauccgguacagccgccgggucugcgugcaguucggcgaggagaaccucugcaagaucaucgacaugaacgacugcuucgugucccgccacgucaaggugugcaucaucgggaccaucagcaaguucucccagggcgacacgcugcuguucuucgggccccucgagggcggcgggcugaucuucaagcacuggugcaccagcaccugccaguucggcgacccgggggacaucauguccccccgggacaagggcuuccugugccccgaguuccccgggagcuuccgcaagaagugcaacuucgccaccacgccgaucugcgaguacgacggcaacaugguguccggcuacaagaaggucauggccaccaucgacagcuuccaguccuucaacaccagcaccaugcacuucacggacgagcggaucgaguggaaggaccccgacgggaugcuccgcgaccacaucaacauccuggugaccaaggacaucgacuucgacaaccugggcgagaaccccugcaagaucgggcuccaggccuccagcaucgagggcgcguggggguccggcgugggcuucacccugaccugccuggucagccucacggagugccccaccuuccugaccagcaucaaggccugcgacaaggccaucugcuacggggccgaguccgugacccugacgcggggccagaacaccgugaaggucagcgggaagggcgggcacuccggcagcaccuucaagugcugccacggcgaggacugcucccagaucgggcuccacgccgcggccccgcaccuggacaaggugaacggcaucagcgagauggagaacuccaagguguacgacgacggggccccccagugcggcaucaagugcugguucgucaagagcggcgaguggaucuccgggaucuucagcggcaacuggaucgugcugaucguccucugcguguuccugcuguucucccucgugcugcugagcauccucugccccguccgcaagcacaagaaguccuga

SEQ ID NO: 11687 - RNA, 3408 nt, Artificial Sequence
  derived and/or modified CDS sequence (opt1) from HTNV(Aa14-172)__KT935008.1__GP
augggcaucuggaaguggcuggugauggccagccucgucuggcccgugcugacccugcgcaacguguacgacaugaagaucgagugcccgcacaccgucagcuucggggagaacagcgugaucggcuacguggagcucccgcccaugccccugacggacaccgcccagcugguccccgaguccagcugcuccauggacaaccaccagagccucaacaccaucaccaaguacacccagguguccuggcgggggaaggcggaccagagccaguccagccagaacuccuucgagaccgugagcaccgaggucgaccugaaggggaccugcgugcugaagcacaagaugaucgaggaguccuaccgcagccggaaguccaucacgugcuacgaccucagcugcaacaacaccuacugcaagcccacccuguacaugaucgugcccauccacgccugcaacaugaugaaguccugccugaucgcccucgggcccuaccgcguccaggugguguacgagcggaccuacugcaugacgggcguccugaucgagggcaagugcuucgugccggaccagagcguggucuccaucaucaagcacgggaucuucgacaucgccagcgugcacaucgugugcuucuucgucgccgugaagggcaacaccuacaagaucuucgagcaggucaagaaguccuucgagagcacgugcaacgacaccgagaacaaggugcagggguacuacaucugcaucgugggcgggaacagcgcgcccaucuacguccccacgcuggacgacuuccgcuccauggaggccuucaccggcaucuuccggagcccccacggcgaggaccacgaccucgccggggaggagaccgccaccuacuccaucgugggcccggcgaacgccaaggugccccacagcgccuccagcgacacgcugucccugaucgccuucagcgggauccccuccuacagcucccucagcauccugaccuccagcaccgaggccaagcacgucuucucccccggccuguucccgaagcucaaccacaccaacugcgacaagggcgcgaucccccugauguggacggggaugaucgaccugcccggcuacuacgaggccauccaccccugcaccguguucugcgugcucagcgggccgggcgccuccugcgaggccuucagcgagggcggcaucuucaacaucaccagccccaugugccuggucuccaagcagaaccgcuuccggcugaccgagcagcaggucaacuucgugugccagcgcguggacguggacaucguggucuacugcaacggccagcggaaggugauccucacgaagacccuggugaucgggcagugcaucuacaccaucaccagccuguucucccuccugcccggcgucgcccacagcaucgcgguggagcugugcgugcccggguuccacggcugggccacggccgcccuccuggucaccuucugcuucgggugggugcugaucccggccaucaccuucaucauccucaccauccugaaguucaucgcgaacaucuuccacacguccaaccaggagaaccgccucaagagcgugcugcggaagaucaaggaggaguucgagaagaccaagggcuccauggucugcgacgugugcaaguacgagugcgagaccuacaaggagcugaaggcccacggcgugagcugcccccagucccagugccccuacugcuucacccacugcgagcccaccgaggccgccuuccaggcccacuacaaggucugccaggugacgcaccgcuuccgggacgaccugaagaagaccgugaccccgcagaacuucacccccgggugcuaccgcacgcucaaccuguuccgguacaagagccgcugcuacaucuucaccauguggaucuuccugcucguccuggaguccauccugugggcggccagcgccuccgagacgccccucaccccgguguggaacgacaacgcccacggcguggggagcguccccaugcacaccgaccuggagcuggacuucucccugaccagcuccagcaaguacaccuaccggcgcaagcucaccaacccccuggaggaggcgcagagcaucgaccugcacaucgagaucgaggagcagacgaucggcguggacgugcacgcccucgggcacugguucgacggccggcugaaccugaagaccuccuuccacugcuacggcgccugcaccaaguacgaguaccccuggcacaccgccaagugccacuacgagcgcgacuaccaguacgagacgagcugggggugcaacccguccgacugccccggcgucgggaccggcugcaccgccugcggccucuaccuggaccgccugaagcccguggggagcgcguacaagaucaucaccauccgguacucccgccgggugugcguccaguucggcgaggagaaccucugcaagaucaucgacaugaacgacugcuucgugagccgccacgugaaggucugcaucaucgggacgguguccaaguucagccagggcgacacccugcuguucuucgggccccucgagggcggcgggcugaucuucaagcacuggugcaccuccacgugccaguucggcgacccgggggacaucaugagcccccgggacaagggcuuccugugccccgaguuccccggguccuuccgcaagaagugcaacuucgccaccaccccgaucugcgaguacgacggcaacauggugagcggcuacaagaaggucauggccaccaucgacuccuuccagagcuucaacaccuccacgaugcacuucaccgacgagcggaucgaguggaaggaccccgacgggaugcuccgcgaccacaucaacauccuggugaccaaggacaucgacuucgacaaccugggcgagaaccccugcaagaucgggcuccagaccagcuccaucgagggcgccugggggagcggcgugggcuucacgcugaccugccuggucucccucaccgagugccccaccuuccugacgagcaucaaggccugcgacaaggcgaucugcuacggggccgagagcgugacccugacccggggccagaacaccgugaaggucuccgggaagggcgggcacagcggcuccaccuucaagugcugccacggcgaggacugcagccagaucgggcuccacgccgccgccccgcaccuggacaaggugaacggcaucuccgagguggagaacagcaaggucuacgacgacggggcgccccagugcggcaucaagugcugguucgugaaguccggcgaguggaucagcgggaucuucuccggcaacuggaucguccugaucgugcucugcguguuccugcuguucagccucguccugcuguccauccucugccccgugcgcaagcacaagaaguccuga

SEQ ID NO: 11688 - RNA, 3408 nt, Artificial Sequence
  derived and/or modified CDS sequence (opt1) from HTNV(Aa14-266)__KT935013.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccgcccaugccccuggccgacacggcccagaugguccccgaguccagcugcuccauggacaaccaccagagccugaacaccaucaccaaguacacccagguguccuggcgggggaaggccgaccagagccaguccaaccagaacagcuucgagacgguguccaccgaggucgaccucaaggggaccugcgugcugaagcacaagaugguggaggagagcuaccgcucccgcaagagcaucacgugcuacgaccuguccugcaacagcaccuacugcaagcccacccucuacaugaucguccccauccacgccugcaacaugaugaaguccugccugaucgcccuggggcccuaccggguccaggugguguacgagcggaccuacugcaugaccggcgugcucaucgagggcaagugcuucgugccggaccagagcgucguguccaucaucaagcacgggaucuucgacaucgccagcgugcacaucgucugcuucuucguggcggugaagggcaacacguacaagaucuucgagcaggucaagaaguccuucgaguccacgugcaacgacaccgagaacaaggugcagggguacuacaucugcaucgucggcgggaacagcgcccccaucuacgugcccacccuggacgacuuccgcuccauggaggccuucaccggcaucuuccggagcccccacggcgaggaccacgaccuggccggggaggagaucgcgaccuacuccaucgugggcccggccaacgccaaggucccccacagcgccuccagcgacacccucucccugaucgccuacagcgggauccccuccuacagcucccugagcauccucaccuccagcacggaggcgaagcacguguucucccccggccuguucccgaagcugaaccacaccaacugcgacaagagcgccaucccccucauguggaccggcaugaucgaccugcccggguacuacgaggccgugcaccccugcaccgucuucugcgugcuguccggcccgggggccagcugcgaggccuucagcgagggcgggaucuucaacaucacgucccccaugugccucgugagcaagcagaaccgcuuccggcugaccgagcagcaggucaacuucgugugccagcgcguggacgucgacaucgugguguacugcaacggccagcggaaggucauccugaccaagacccucgugaucggccagugcaucuacacgaucaccucccuguucagccugcuccccgggguggcgcacuccaucgccgucgagcugugcgugcccggcuuccacgggugggccaccgccgcccugcucgugaccuucugcuucggcuggguccugaucccggcgaucacguucaucauccugaccauccucaaguucaucgccaacaucuuccacaccagcaaccaggagaaccgccugaaguccgugcugcggaagaucaaggaggaguucgagaagaccaaggggagcauggugugcgacgucugcaaguacgagugcgagacguacaaggagcucaaggcccacggcguguccugcccccagagccagugccccuacugcuucacccacugcgagcccaccgaggccgccuuccaggcgcacuacaaggugugccaggucacccaccgcuuccgggacgaccugaagaagaccgugacgccgcagaacuucacccccggcugcuaccgcacccugaaccucuuccgguacaagucccgcugcuacaucuucaccauguggaucuuccugcuggugcucgagagcauccugugggccgccuccgccagcgagacgccccugaccccggucuggaacgacaacgcgcacggggugggcuccgugcccaugcacaccgaccucgagcuggacuucagccugaccuccagcagcaaguacacguaccggcgcaagcugaccaacccccucgaggaggcccaguccaucgaccugcacaucgagaucgaggagcagaccaucggggucgacgugcacgcccugggccacugguucgacgggcggcucaaccugaagaccagcuuccacugcuacggcgccugcacgaaguacgaguaccccuggcacaccgccaagugccacuacgagcgcgacuaccaguacgagaccuccuggggcugcaacccgagcgacugccccggggugggcaccgggugcacggcgugcggccuguaccucgaccagcugaagcccgucggcuccgccuacaagaucaucaccauccgcuacagccggcgcgugugcgugcaguucggggaggagaaccugugcaagaccaucgacaugaacgacugcuucgucucccggcacgugaaggugugcaucaucggcaccgucagcaaguucucccagggggacacgcuccuguucuucggcccccuggagggcggcggccucaucuucaagcacuggugcaccagcacgugccaguucggggacccgggcgacaucaugagcccccgcgacaagggguuccugugccccgaguuccccggcagcuuccggaagaagugcaacuucgccaccaccccgaucugcgaguacgacgggaacaugguguccggcuacaagaaggugauggccaccaucgacagcuuccaguccuucaacaccagcaccaugcacuucacggacgagcgcaucgaguggaaggaccccgacggcaugcugcgggaccacaucaacauccucgucaccaaggacaucgacuucgacaaccugggggagaaccccugcaagaucggccugcagaccuccagcaucgagggggccuggggcuccggggugggcuucacccucacgugccuggugagccugaccgagugccccaccuuccucaccagcaucaaggcgugcgacaaggccaucugcuacggcgccgaguccgucacgcugacccgcgggcagaacaccgugaaggugagcggcaagggcgggcacuccgggagcaccuucaagugcugccacggcgaggacugcucccagaucggccugcacgccgccgcgccgcaccucgacaaggucaacgggaucagcgagauggagaacuccaagguguacgacgacggcgcgccccagugcgggaucaagugcugguucgucaagagcggcgaguggaucuccggcaucuucagcgggaacuggaucgugcugaucgugcugugcgucuuccuccuguucucccuggugcuccugagcauccugugccccgugcggaagcacaagaaguccuga

SEQ ID NO: 11689 - RNA, 3408 nt, Artificial Sequence
  derived and/or modified CDS sequence (opt1) from HTNV(Aa14-272)__KT935014.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccgcccaugccccuggccgacacggcccagaugguccccgaguccagcugcuccauggacaaccaccagagccugaacaccaucaccaaguacacccagguguccuggcgggggaaggccgaccagagccaguccaaccagaacagcuucgagacgguguccaccgaggucgaccucaaggggaccugcgugcugaagcacaagaugguggaggagagcuaccgcucccgcaagagcaucacgugcuacgaccuguccugcaacagcaccuacugcaagcccacccucuacaugaucguccccauccacgccugcaacaugaugaaguccugccugaucgcccuggggcccuaccggguccaggugguguacgagcggaccuacugcaugaccggcgugcucaucgagggcaagugcuucgugccggaccagagcgucguguccaucaucaagcacgggaucuucgacaucgccagcgugcacaucgucugcuucuucguggcggugaagggcaacacguacaagaucuucgagcaggucaagaaguccuucgaguccacgugcaacgacaccgagaacaaggugcagggguacuacaucugcaucgucggcgggaacagcgcccccaucuacgugcccacccuggacgacuuccgcuccauggaggccuucaccggcaucuuccggagcccccacggcgaggaccacgaccuggccggggaggagaucgcgaccuacuccaucgugggcccggccaacgccaaggucccccacagcgccuccagcgacacccucucccugaucgccuacagcgggauccccuccuacagcucccugagcauccucaccuccagcacggaggcgaagcacguguucucccccggccuguucccgaagcugaaccacaccaacugcgacaagagcgccaucccccucauguggaccggcaugaucgaccugcccggguacuacgaggccgugcaccccugcaccgucuucugcgugcuguccggcccgggggccagcugcgaggccuucagcgagggcgggaucuucaacaucacgucccccaugugccucgugagcaagcagaaccgcuuccggcugaccgagcagcaggucaacuucgugugccagcgcguggacgucgacaucgugguguacugcaacggccagcggaaggucauccugaccaagacccucgugaucggccagugcaucuacacgaucaccucccuguucagccugcuccccgggguggcgcacuccaucgccgucgagcugugcgugcccggcuuccacgggugggccaccgccgcccugcucgugaccuucugcuucggcuggguccugaucccggcgaucacguucaucauccugaccauccucaaguucaucgccaacaucuuccacaccagcaaccaggagaaccgccugaaguccgugcugcggaagaucaaggaggaguucgagaagaccaaggggagcauggugugcgacgucugcaaguacgagugcgagacguacaaggagcucaaggcccacggcguguccugcccccagagccagugccccuacugcuucacccacugcgagcccaccgaggccgccuuccaggcgcacuacaaggugugccaggucacccaccgcuuccgggacgaccugaagaagaccgugacgccgcagaacuucacccccggcugcuaccgcacccugaaccucuuccgguacaagucccgcugcuacaucuucaccauguggaucuuccugcuggugcucgagagcauccugugggccgccuccgccagcgagacgccccugaccccggucuggaacgacaacgcgcacggggugggcuccgugcccaugcacaccgaccucgagcuggacuucagccugaccuccagcagcaaguacacguaccggcgcaagcugaccaacccccucgaggaggcccaguccaucgaccugcacaucgagaucgaggagcagaccaucggggucgacgugcacgcccugggccacugguucgacgggcggcucaaccugaagaccagcuuccacugcuacggcgccugcacgaaguacgaguaccccuggcacaccgccaagugccacuacgagcgcgacuaccaguacgagaccuccuggggcugcaacccgagcgacugccccggggugggcaccgggugcacggcgugcggccuguaccucgaccagcugaagcccgucggcuccgccuacaagaucaucaccauccgcuacagccggcgcgugugcgugcaguucggggaggagaaccugugcaagaucaucgacaugaacgacugcuucgucucccggcacgugaaggugugcaucaucggcaccgucagcaaguucucccagggggacacccuccuguucuucggcccccuggagggcggcggccucaucuucaagcacuggugcacgagcacgugccaguucggggacccgggcgacaucaugagcccccgcgacaagggguuccugugccccgaguuccccggcagcuuccggaagaagugcaacuucgccaccaccccgaucugcgaguacgacgggaacaugguguccggcuacaagaaggugauggccaccaucgacagcuuccaguccuucaacaccagcaccaugcacuucaccgacgagcgcaucgaguggaaggaccccgacggcaugcugcgggaccacaucaacauccucgucacgaaggacaucgacuucgacaaccugggggagaaccccugcaagaucggccugcagaccuccagcaucgagggggccuggggcuccggggugggcuucacccugaccugccucgugagccugacggagugccccaccuuccucaccagcaucaaggcgugcgacaaggccaucugcuacggcgccgaguccgucacccugacgcgcgggcagaacaccgugaaggugagcggcaagggcgggcacuccgggagcaccuucaagugcugccacggcgaggacugcucccagaucggccugcacgccgccgcgccgcaccucgacaaggucaacgggaucagcgagauggagaacuccaagguguacgacgacggcgcgccccagugcgggaucaagugcugguucgucaagagcggcgaguggaucuccggcaucuucagcgggaacuggaucgugcugaucgugcugugcgucuuccuccuguucucccuggugcuccugagcauccugugccccgugcggaagcacaagaaguccuga

SEQ ID NO: 11690 - RNA, 3408 nt, Artificial Sequence
  derived and/or modified CDS sequence (opt1) from HTNV(Aa14-362)__KT935015.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccgcccaugccccuggccgacacggcccagcugguccccgaguccagcugcuccauggacaaccaccagagccucaacaccaucaccaaguacacccagguguccuggcgggggaaggccgaccagagccaguccagccagaacuccuucgaggccgugagcacggaggucgaccugaaggggaccugcgugcugaagcacaagaugguggaggaguccuaccgcagccggaaguccaucacgugcuacgaccucagcugcaacuccaccuacugcaagcccacccuguacaugaucguccccauccacgccugcaacaugaugaaguccugccugaucgcccucgggcccuaccgcguccaggugguguacgagcggaccuacugcaugaccggcgugcugaucgagggcaagugcuucgugccggaccaguccgucgugagcaucaucaagcacgggaucuucgacaucgcgagcgugcacaucgucugcuucuucguggccgugaagggcaacaccuacaagaucuucgagcaggucaagaaguccuucgagagcacgugcaacgacaccgagaacaaggugcagggguacuacaucugcaucgucggcgggaacuccgcccccaucuacgugcccacccuggacgacuuccgcagcauggaggccuucaccggcaucuuccggagcccccacggcgaggaccacgaccucgcgggggaggagacggccaccuacagcaucgugggcccggccaacgccaaggucccccacuccgccagcuccgacacccugagccugaucgcguucuccgggauccccagcuacuccagccucuccauccugaccagcuccacggaggccaagcacguguucagccccggccuguucccgaagcucaaccacaccaacugcgacaagggcgccaucccccugauguggaccgggaugaucgaccugcccggcuacuacgaggccauccaccccugcaccguguucugcguccucuccgggccgggcgccagcugcgaggcguucagcgagggcggcaucuucaacaucacgucccccaugugccuggugagcaagcagaaccgcuuccggcugaccgagcagcaggucaacuucgugugccagcgcguggacguggacaucaucgucuacugcaacggccagcggaaggugauccucaccaagacccuggugaucgggcagugcaucuacacgaucaccucccuguucagccuccugcccggcgucgcccacuccaucgccguggagcugugcgugcccggguuccacggcugggccaccgccgcgcuccuggucaccuucugcuucgggugggugcugaucccggccaucacguucaucauccucaccauccugaaguucaucgccaacaucuuccacaccagcaaccaggagaaccgccugaaguccgugcuccggaagaucaaggaggaguucgagaagaccaagggcagcauggucugcgacgugugcaaguacgagugcgagacguacaaggagcugaaggcccacggcguguccugcccccagagccagugccccuacugcuucacccacugcgagcccaccgaggccgcguuccaggcccacuacaaggucugccaggugacccaccgcuuccgggacgaccugaagaagaccgugacgccgcagaacuucacccccgggugcuaccgcacccucaaccuguuccgguacaagucccgcugcuacaucuucaccauguggaucuuccugcucguccuggagagcauccugugggccgccuccgcgagcgagacgccccucaccccgguguggaacgacaacgcccacggcgugggguccguccccaugcacaccgaccuggagcuggacuucagccugaccuccagcagcaaguacacguaccggcgcaagcucaccaacccccuggaggaggcccaguccaucgaccugcacaucgagaucgaggagcagaccaucggcguggacgugcacgcccucgggcacugguucgacggccggcugaaccugaagaccagcuuccacugcuacggcgccugcacgaaguacgaguaccccuggcacaccgcgaagugccacuacgagcgcgacuaccaguacgagaccuccugggggugcaacccgagcgacugccccggcgucgggaccggcugcacggccugcggccucuaccuggaccgccugaagcccgugggguccgccuacaagaucaucaccauccgguacagccgccgggugugcguccaguucggcgaggagaaccucugcaagaucaucgacaugaacgacugcuucgugucccgccacgugaaggucugcaucaucgggaccgugagcaaguucucccagggcgacacccugcuguucuucgggccccucgagggcggcgggcugaucuucaagcacuggugcacgagcacgugccaguucggcgacccgggggacaucaugagcccccgggacaagggcuuccugugccccgaguuccccggguccuuccgcaagaagugcaacuucgccaccaccccgaucugcgaguacgacggcaacaugguguccggcuacaagaaggucauggccaccaucgacagcuuccaguccuucaacaccagcaccaugcacuucaccgacgagcggaucgaguggaaggaccccgacgggaugcuccgcgaccacaucaacauccuggugacgaaggacaucgacuucgacaaccugggcgagaaccccugcaagaucgggcuccagaccuccagcaucgagggcgcguggggguccggcgugggcuucacccugaccugccuggucagccucacggagugccccaccuuccugaccagcaucaaggccugcgacaaggccaucugcuacggggccgaguccgugacccugacgcggggccagaacaccgugaaggucagcgggaagggcgggcacuccggcagcaccuucaagugcugccacggcgaggacugcucccagaucgggcuccacgccgcggccccgcaccuggacaaggugaacggcaucagcgagauggagaacuccaagguguacgacgacggggcgccccagugcggcaucaagugcugguucgucaagagcggcgaguggaucuccgggaucuucagcggcaacuggaucgugcugaucguccucugcguguuccugcuguucucccucgugcugcugagcauccucugccccguccgcaagcacaagaaguccuga

SEQ ID NO: 11691 - RNA, 3408 nt, Artificial Sequence
  derived and/or modified CDS sequence (opt1) from HTNV(Aa14-404)__KT935018.1__GP
augggcaucuggaaguggcuggugauggccagccucgucuggcccgugcugacccugcgcaacguguacgacaugaagaucgagugcccgcacaccgucagcuucggggagaacagcgugaucggcuacguggagcucccgcccaugccccuggccgacacggcgcagaugguccccgaguccagcugcuccauggacaaccaccagagccugaacaccaucaccaaguacacccagguguccuggcgggggaaggccgaccagagccaguccagccagaacuccuucgagacggugagcaccgaggucgaccucaaggggaccugcgugcugaagcacaagaugguggaggaguccuaccgcagccggaaguccaucacgugcuacgaccugagcugcaacuccaccuacugcaagcccacccucuacaugaucguccccauccacgccugcaacaugaugaaguccugccugaucgcccuggggcccuaccgcguccaggugguguacgagcggaccuacugcaugaccggcgugcucaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcacgugcaacgacaccgagaacaaggugcagggguacuacaucugcaucgucggcgggaacuccgcccccaucuacgugcccacccuggacgacuuccgcagcauggaggccuucaccggcaucuuccggagcccccacggcgaggaccacgaccuggccggggaggagaucgcgaccuacagcaucgugggcccggccaacgccaaggucccccacuccgccagcuccgacacccucagccugaucgccuacuccgggauccccagcuacuccagccuguccauccucaccagcuccacggaggcgaagcacguguucagccccggccuguucccgaagcugaaccacaccaacugcgacaaguccgccaucccccucauguggaccggcaugaucgaccugcccggguacuacgaggccgugcaccccugcaccgucuucugcgugcugagcggcccgggggccagcugcgaggccuucuccgagggcgggaucuucaacaucacgagccccaugugccucguguccaagcagaaccgcuuccggcugaccgagcagcaggucaacuucgugugccagcgcguggacgucgacaucgugguguacugcaacggccagcggaaggucauccugaccaagacccucgugaucggccagugcaucuacacgaucaccagccuguucucccugcuccccgggguggcgcacagcaucgccgucgagcugugcgugcccggcuuccacgggugggccaccgccgcccugcucgugaccuucugcuucggcuggguccugaucccggcgaucacguucaucauccugaccauccucaaguucaucgccaacaucuuccacaccuccaaccaggagaaccgccucaagagcgugcugcggaagaucaaggaggaguucgagaagaccaagggguccauggugugcgacgucugcaaguacgagugcgagacguacaaggagcugaaggcccacggcgugagcugcccccagucccagugccccuacugcuucacccacugcgagcccaccgaggccaccuuccaggcccacuacaaggugugccaggucacccaccgcuuccgggacgaccugaagaagacggugaccccgcagaacuucacccccggcugcuaccgcacccugaaccucuuccgguacaagagccgcugcuacaucuucacgauguggaucuuccugcuggugcucgaguccauccugugggcggccagcgccuccgagacgccccugaccccggucuggaacgacaacgcccacggggugggcagcgugcccaugcacaccgaccucgagcuggacuucucccugaccagcagcuccaaguacaccuaccggcgcaagcugaccaacccccucgaggaggcgcagagcaucgaccugcacaucgagaucgaggagcagaccaucggggucgacgugcacgcccugggccacugguucgacgggcggcucaaccugaagacguccuuccacugcuacggcgccugcaccaaguacgaguaccccuggcacaccgccaagugccacuacgagcgcgacuaccaguacgagaccagcuggggcugcaacccguccgacugccccggggugggcacggggugcaccgccugcggccuguaccucgaccagcugaagcccgucggcagcgcguacaagaucaucaccauccgcuacucccggcgcgugugcgugcaguucggggaggagaaccugugcaagaucaucgacaugaacgacugcuucgucagccggcacgugaaggugugcaucaucggcaccgucuccaaguucagccagggggacacgcuccuguucuucggcccccuggagggcggcggccucaucuucaagcacuggugcaccuccacgugccaguucggggacccgggcgacaucaugagcccccgcgacaagggguuccugugccccgaguuccccggcuccuuccggaagaagugcaacuucgccaccaccccgcugugcgaguacgacgggaacauggugagcggcuacaagaaggugauggccaccaucgacuccuuccagagcuucaacaccuccaccaugcacuucacggacgagcgcaucgaguggaaggaccccgacggcaugcuccgggaccacaucaacauccuggucaccaaggacaucgacuucgacaaccugggggagaaccccugcaagaucggccuccagaccagcuccaucgagggggccuggggcagcggggugggcuucacccugacgugccuggugagccucaccgagugccccaccuuccugaccuccaucaaggccugcgacaaggcgaucugcuacggcgccgagagcgucacgcugacccgcgggcagaacaccgugaagguguccggcaagggcgggcacagcggguccaccuucaagugcugccacggcgaggacugcagccagaucggccuccacgccgccgccccgcaccuggacaaggucaacgggaucuccgagauggagaacagcaagguguacgacgacggcgcgccccagugcgggaucaagugcugguucgucaaguccggcgaguggaucagcggcaucuucuccgggaacuggaucgugcugaucgugcucugcgucuuccugcuguucagccucgugcugcuguccauccucugccccgugcggaagcacaagaaguccuga

SEQ ID NO: 11692 - RNA, 3408 nt, Artificial Sequence
  derived and/or modified CDS sequence (opt1) from HTNV(Aa14-423)__KT935022.1__GP
augggcaucuggaaguggcuggugauggccagccucgucuggcccgugcugacccugcgcaacguguacgacaugaagaucgagugcccgcacaccgucagcuucggggagaacagcgugaucggcuacguggagcucccgcccaugccccuggccgacacggcgcagaugguccccgaguccagcugcuccauggacaaccaccagagccugaacaccaucaccaaguacacccagguguccuggcgggggaaggccgaccagagccaguccagccagaacuccuucgagacggugagcaccgaggucgaccucaaggggaccugcgugcugaagcacaagaugguggaggaguccuaccgcagccggaaguccaucacgugcuacgaccugagcugcaacuccaccuacugcaagcccacccucuacaugaucguccccauccacgccugcaacaugaugaaguccugccugaucgcccuggggcccuaccgcguccaggugguguacgagcggaccuacugcaugaccggcgugcucaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcacgugcaacgacaccgagaacaaggugcagggguacuacaucugcaucgucggcgggaacuccgcccccaucuacgugcccacccuggacgacuuccgcagcauggaggccuucaccggcaucuuccggagcccccacggcgaggaccacgaccuggccggggaggagaucgcgaccuacagcaucgugggcccggccaacgccaaggucccccacuccgccagcuccgacacccucagccugaucgccuacuccgggauccccagcuacuccagccuguccauccucaccagcuccacggaggcgaagcacguguucagccccggccuguucccgaagcugaaccacaccaacugcgacaaguccgccaucccccucauguggaccggcaugaucgaccugcccggguacuacgaggccgugcaccccugcaccgucuucugcgugcugagcggcccgggggccagcugcgaggccuucuccgagggcgggaucuucaacaucacgagccccaugugccucguguccaagcagaaccgcuuccggcugaccgagcagcaggucaacuucgugugccagcgcguggacgucgacaucgugguguacugcaacggccagcggaaggucauccugaccaagacccucgugaucggccagugcaucuacacgaucaccagccuguucucccugcuccccgggguggcgcacagcaucgccgucgagcugugcgugcccggcuuccacgggugggccaccgccgcccugcucgugaccuucugcuucggcuggguccugaucccggcgaucacgcugaucauccucaccauccugaaguucaucgccaacaucuuccacaccuccaaccaggagaaccgccucaagagcgugcuccggaagaucaaggaggaguucgagaagaccaagggguccauggugugcgacgucugcaaguacgagugcgagacguacaaggagcugaaggcccacggcgugagcugcccccagucccagugccccuacugcuucacccacugcgagcccaccgaggccaccuuccaggcccacuacaaggugugccaggucacccaccgcuuccgggacgaccugaagaagacggugaccccgcagaacuucacccccggcugcuaccgcacccucaaccuguuccgguacaagagccgcugcuacaucuucacgauguggaucuuccugcucgugcuggaguccauccugugggcggccagcgccuccgagacgccccucaccccggucuggaacgacaacgcccacggggugggcagcgugcccaugcacaccgaccuggagcuggacuucucccugaccagcagcuccaaguacaccuaccggcgcaagcucaccaacccccuggaggaggcgcagagcaucgaccugcacaucgagaucgaggagcagaccaucggggucgacgugcacgcccucggccacugguucgacgggcggcugaaccugaagacguccuuccacugcuacggcgccugcaccaaguacgaguaccccuggcacaccgccaagugccacuacgagcgcgacuaccaguacgagaccagcuggggcugcaacccguccgacugccccggggugggcacggggugcaccgccugcggccucuaccuggaccagcugaagcccgucggcagcgcguacaagaucaucaccauccgcuacucccggcgcgugugcgugcaguucggggaggagaaccucugcaagaucaucgacaugaacgacugcuucgucagccggcacgugaaggugugcaucaucggcaccgucuccaaguucagccagggggacacgcugcuguucuucggcccccucgagggcggcggccugaucuucaagcacuggugcaccuccacgugccaguucggggacccgggcgacaucaugagcccccgcgacaagggguuccugugccccgaguuccccggcuccuuccggaagaagugcaacuucgccaccaccccgcucugcgaguacgacgggaacauggugagcggcuacaagaaggugauggccaccaucgacuccuuccagagcuucaacaccuccaccaugcacuucacggacgagcgcaucgaguggaaggaccccgacggcaugcugcgggaccacaucaacauccuggucaccaaggacaucgacuucgacaaccucggggagaaccccugcaagaucggccugcagaccagcuccaucgagggggccuggggcagcggggugggcuucacccugacgugccucgugagccugaccgagugccccaccuuccugaccuccaucaaggccugcgacaaggcgaucugcuacggcgccgagagcgucacgcucacccgcgggcagaacaccgugaagguguccggcaagggcgggcacagcggguccaccuucaagugcugccacggcgaggacugcagccagaucggccugcacgccgccgccccgcaccuggacaaggucaacgggaucuccgagauggagaacagcaagguguacgacgacggcgcgccccagugcgggaucaagugcugguucgucaaguccggcgaguggaucagcggcaucuucuccgggaacuggaucgugcucaucgugcugugcgucuuccugcuguucagccuggugcugcucuccauccugugccccgugcggaagcacaagaaguccuga

SEQ ID NO: 11693 - RNA, 3408 nt, Artificial Sequence
  derived and/or modified CDS sequence (opt1) from HTNV(Aa15-56)__KU207187.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcggcgcaaggccgaccagagccaguccagccagaacuccuucgagacggugagcaccgaggucgaccugaaggggaccugcgugcugaagcacaagaugguggaggaguccuaccggagccgcaaguccaucaccugcuacgaccucagcugcaacuccacguacugcaagcccacccuguacaugaucguccccauccacgccugcaacaugaugaagagcugccugaucgcccucggccccuaccgggugcagguggucuacgagcgcaccuacugcaugaccggggcccugaucgagggcaagugcuucgugccggaccaguccguggucagcaucaucaagcacggcaucuucgacaucgcgagcgugcacaucgugugcuucuucgucgccgugaaggggaacacguacaagaucuucgagcaggugaagaaguccuucgagagcaccugcaacgacaccgagaacaagguccagggcuacuacaucugcaucguggggggcaacuccgcccccaucuacguccccacccuggacgacuuccggagcauggaggccuucacggggaucuuccgcuccccccacggcgaggaccacgaccucgcgggcgaggagaccgccaccuacagcaucguggggccggccaacgccaaggugccccacuccgccagcuccgacacccugagccugaucgcguucuccggcauccccagcuacuccagccucuccauccugacgagcuccaccgaggccaagcacgucuucagccccgggcuguucccgaagcucaaccacaccaacugcgacaagggcgccaucccccugauguggaccggcaugaucgaccugcccggguacuacgaggccauccaccccugcacgguguucugcgugcucuccggcccgggggccagcugcgaggcguucagcgagggcgggaucuucaacaucaccucccccaugugccuggucagcaagcagaaccgguuccgccugaccgagcagcaggugaacuucgugugccagcgggucgacguggacaucguggucuacugcaacggccagcgcaaggugauccucaccaagacgcuggugaucggccagugcaucuacaccaucaccucccuguucagccuccugcccggggucgcccacuccaucgccguggagcugugcgugcccggcuuccacgggugggccaccgccgcgcuccuggucacguucugcuucggcugggugcugaucccggccaucaccuucaucauccucaccauccugaaguucaucgccaacaucuuccacaccagcaaccaggagaaccggcugaaguccgugcuccgcaagaucaaggaggaguucgagaagacgaaggggagcauggucugcgacgugugcaaguacgagugcgagaccuacaaggagcugaaggcccacggcguguccugcccccagagccagugccccuacugcuucacccacugcgagcccaccgaggccgcguuccaggcccacuacaaggucugccaggugacccaccgguuccgcgacgaccugaagaagacggugaccccgcagaacuucacccccggcugcuaccggacccucaaccuguuccgcuacaagucccggugcuacaucuucacgauguggaucuuccugcucguccuggagagcauccugugggccgccuccgcgagcgagaccccccucaccccgguguggaacgacaacgcccacggggugggcuccguccccaugcacaccgaccuggagcuggacuucagccugacguccagcagcaaguacaccuaccgccggaagcucaccaacccccuggaggaggcccaguccaucgaccugcacaucgagaucgaggagcagaccaucgggguggacgugcacgcccucggccacugguucgacgggcgccugaaccugaagacgagcuuccacugcuacggcgccugcaccaaguacgaguaccccuggcacaccgcgaagugccacuacgagcgcgacuaccaguacgagaccuccuggggcugcaacccgagcgacugccccggggucggcacggggugcaccgccugcggccucuaccuggaccggcugaagcccgugggcuccgccuacaagaucaucaccauccgcuacagccggcgcgugugcguccaguucggggaggagaaccucugcaagaucaucgacaugaacgacugcuucgugucccggcacgugaaggucugcaucaucggcaccgugagcaaguucucccagggggacacgcugcuguucuucggcccccucgaggggggcggccugaucuucaagcacuggugcaccagcaccugccaguucggggacccgggcgacaucauguccccccgcgacaagggguuccugugccccgaguuccccggcagcuuccggaagaagugcaacuucgccaccacgccgaucugcgaguacgacgggaacaugguguccggcuacaagaaggucauggccaccaucgacagcuuccaguccuucaacaccagcaccaugcacuucacggacgagcgcaucgaguggaaggaccccgacggcaugcuccgggaccacaucaacauccuggugaccaaggacaucgacuucgacaaccugggggagaaccccugcaagaucggccuccagaccuccagcaucgagggggcguggggcuccggggugggcuucacccugacgugccuggucagccucaccgagugccccaccuuccugaccagcaucaaggccugcgacaaggccaucugcuacggcgccgaguccgugacgcugacccgcgggcagaacaccgugaaggucagcggcaaggggggccacuccgggagcaccuucaagugcugccacggcgaggacugcucccagaucggccuccacgccgcggccccgcaccuggacaaggugaacgggaucagcgagauggagaacuccaagguguacgacgacggcgccccccagugcgggaucaagugcugguucgucaagagcggcgaguggaucuccggcaucuucagcgggaacuggaucgugcugaucguccucugcguguuccugcuguucucccucgugcugcugagcauccucugccccguccggaagcacaagaaguccuga

SEQ ID NO: 11694 - RNA, 3408 nt, Artificial Sequence
  derived and/or modified CDS sequence (opt1) from HTNV(CBAa11-106)__KC576787.1__GP
augggcauguggaaguggcuggugaucgccagccucgucuggcccgcccugacccugcgcaacguguacgacaugaagaucgagugcccgcacaccguguccuucggggagaacagcgucaucggcuacguggagcucccccccaugccccuggcggacacggcccagauggugccggaguccagcugcuccauggacaaccaccagagcaugaacaccaucaccaaguacacccaggucaucuggcgggggaaggccgaccccggccaguccagccagaacuccuucgagacggugagcaccgagaucgaccugaaggggaccugcgugcucaagcacaagauggucgaggaguccuaccgcagccggaaguccaucaccugcuacgaccugagcugcaacuccacguacugcaagcccacccuguacaugaucgugcccauccacgccugcaacaugaugaagagcugccucaucgcccugggcccguaccgcgugcaggucguguacgagcggaccuacugcaugaccggcgugcugaucgaggggaagugcuucguccccgaccaguccguggugagcaucaucaagcacggcaucuucgacaucgcguccguccacaucgugugcuucuucguggccgucaaggggaacacguacaagcucuucgagcaggugaagaagagcuucgagagcaccugcaacgacaccgagaacaaggugcagggcuacuacaucugcaucgucgggggcaacuucgcccccaucuacgugcccacccuggacgacuuccgcuccauggaggccuucacgggcaucuuccggagcccgcacggggaggaccacgaccuggcgggcgaggagaucgccuccuacagcaucgucgggcccgccaacgccaaggugccccacuccgccagcuccgacacccucagccugaucgcguacuccggcauccccagcuacuccagccuguccauccucaccagcuccaccgaggccaagcacguguucagcccgggccuguuccccaagcugaaccacacgaacugcgacaaguccgccaucccccucaccuggaccgggaugaucgaccugcccggcuacuacgaggccauccacccgugcaccgucuucugcgugcugagcgggcccggcgccuccugcgaggcguucagcgaggggggcaucuucaacaucacgagccccaugugccucguguccaagcagaaccgcuuccggcugaccgagcagcaggucaacuucgugugccagcgcguggacauggacaucgucguguacugcaacggccagcggaaggugauccugaccaagacccucgucaucgggcagugcaucuacacgaucaccagccuguucucccugcuccccggcguggcccacagcaucgccguggagcugugcgucccgggguuccacggcugggccaccgccgcgcugcucgugaccuucugcuucgggugggugcugauccccgccaucacguucaucauccugaccguccucaaguucguggccaacaucuuccacaccuccaaccaggagaaccgccugaagagcgugcugcggaagaucaaggaggaguucgagaagaccaagggcuccauggucugcgacgugugcaaguacgagugcgagacguacaaggagcucaaggcccacggcgugagcugcccccagucccagugccccuacugcuucacccacugcgagccgaccgaggccgcguuccaggcccacuacaaggucugccaggugacccaccgcuuccgggacgaccugaagaagaccgugacgccccagaacuucacccccgggugcuaccgcacccugaaccucuuccgguacaagagccgcugcuacaucuucaccaugugggucuuccugcugauccucgaguccgugcugugggccgccagcgcguccgagacgccgcugacccccguguggaacgacaacgcccacggcgucgggagcgugcccaugcacaccgaccucgagcuggacuucucccugaccagcuccagcaaguacacguaccggcgcaagcugaccaacccccucgaggaggcccagagcaucgaccugcacaucgagaucgaggagcagaccaucggcguggacguccacgcccuggggcacugguucgacggccggcucaaccugaagaccuccuuccacugcuacggcgccugcacgaaguacgaguacccguggcacaccgcgaagugccacuacgagcgcgacuaccaguacgagaccagcugggggugcaaccccuccgacugccccggcguggggaccggcugcacggccugcggccuguaccucgaccagcugaagcccguggggagcgccuacaagaucaucaccauccgcuacucccggcgcgucugcgugcaguucggcgaggagaaccugugcaagaucaucgacaugaacgacugcuucgugagccggcacgucaaggugugcaucaucgggaccguguccaaguucagccagggcgacacccuccuguucuucgggccgcuggagggcggcgggcucaucuucaagcacuggugcacguccaccugccaguucggcgaccccggggacaucaugagcccccgcgacaagggcuuccugugccccgaguucccgggguccuuccggaagaagugcaacuucgccaccacccccaucugcgaguacgacggcaacauggucagcggcuacaagaaggugauggccacgaucgacuccuuccagagcuucaacaccuccaccaugcacuucaccgacgagcgcaucgaguggaaggaccccgacgggaugcugcgggaccacaucaacauccucgugacgaaggacaucgacuucgacaaccugggcgagaaccccugcaagaucgggcugcagaccagcuccaucgagggcgcgugggggagcggcgucggcuucacccucaccugccuggugucccugacggagugcccgaccuuccucaccagcaucaaggccugcgacaaggccaucugcuacggggccgagagcgugacccugacgcgcggccagaacaccgucaagguguccgggaagggcgggcacagcggcuccaccuucaagugcugccacggcgaggacugcagccagaucgggcugcacgccgcggccccccaccucgacaaggugaacggcaucuccgagaucgagaacagcaaggucuacgacgacggggccccccagugcggcaucaagugcugguucgugaaguccggcgaguggaucagcgggaucuucuccggcaacuggaucguccugaucgugcugugcguguuccuccuguucagccugguccuccuguccauccugugccccgugcggaagcacaagaagagcuga

SEQ ID NO: 11695 - RNA, 3408 nt, Artificial Sequence
  derived and/or modified CDS sequence (opt1) from HTNV(CBAa11-26)__KC576786.1__GP
augggcauguggaaguggcuggugaucgccagccucgucuggcccgcccugacccugcgcaacguguacgacaugaagaucgagugcccgcacaccguguccuucggggagaacagcgucaucggcuacguggagcucccccccaugccccuggcggacacggcccagauggugccggaguccagcugcuccauggacaaccaccagagcaugaacaccaucaccaaguacacccaggucaucuggcgggggaaggccgaccccggccaguccagccagaacuccuucgagacggugagcaccgagaucgaccugaaggggaccugcgugcucaagcacaagauggucgaggaguccuaccgcagccggaaguccaucaccugcuacgaccugagcugcaacuccacguacugcaagcccacccuguacaugaucgugcccauccacgccugcaacaugaugaagagcugccucaucgcccugggcccguaccgcgugcaggucguguacgagcggaccuacugcaugaccggcgugcugaucgaggggaagugcuucguccccgaccaguccguggugagcaucaucaagcacggcaucuucgacaucgcguccguccacaucgugugcuucuucguggccgucaaggggaacacguacaagcucuucgagcaggugaagaagagcuucgagagcaccugcaacgacaccgagaacaaggugcagggcuacuacaucugcaucgucgggggcaacuccgcccccaucuacgugcccacccuggacgacuuccgcagcauggaggccuucacgggcaucuuccgguccccgcacggggaggaccacgaccuggcgggcgaggagaucgccagcuacuccaucgucgggcccgccaacgccaaggugccccacagcgccuccagcgacacccucucccugaucgcguacagcggcauccccuccuacagcucccugagcauccucaccuccagcaccgaggccaagcacguguucuccccgggccuguuccccaagcugaaccacacgaacugcgacaagagcgccaucccccucaccuggaccgggaugaucgaccugcccggcuacuacgaggccauccacccgugcaccgucuucugcgugcuguccgggcccggcgccagcugcgaggcguucagcgaggggggcaucuucaacaucacgucccccaugugccucgugagcaagcagaaccgcuuccggcugaccgagcagcaggucaacuucgugugccagcgcguggacauggacaucgucguguacugcaacggccagcggaaggugauccugaccaagacccucgucaucgggcagugcaucuacacgaucaccucccuguucagccugcuccccggcguggcccacuccaucgccguggagcugugcgucccgggguuccacggcugggccaccgccgcgcugcucgugaccuucugcuucgggugggugcugauccccgccaucacguucaucauccugaccguccucaaguucguggccaacaucuuccacaccagcaaccaggagaaccgccugaaguccgugcugcggaagaucaaggaggaguucgagaagaccaagggcagcauggucugcgacgugugcaaguacgagugcgagacguacaaggagcucaaggcccacggcguguccugcccccagagccagugccccuacugcuucacccacugcgagccgaccgaggccgcguuccaggcccacuacaaggucugccaggugacccaccgcuuccgggacgaccugaagaagaccgugacgccccagaacuucacccccgggugcuaccgcacccugaaccucuuccgguacaagucccgcugcuacaucuucaccaugugggucuuccugcugauccucgagagcgugcugugggccgccuccgcgagcgagacgccgcugacccccguguggaacgacaacgcccacggcgucggguccgugcccaugcacaccgaccucgagcuggacuucagccugaccuccagcagcaaguacacguaccggcgcaagcugaccaacccccucgaggaggcccaguccaucgaccugcacaucgagaucgaggagcagaccaucggcguggacguccacgcccuggggcacugguucgacggccggcucaaccugaagaccagcuuccacugcuacggcgccugcacgaaguacgaguacccguggcacaccgcgaagugccacuacgagcgcgacuaccaguacgagaccuccugggggugcaaccccagcgacugccccggcguggggaccggcugcacggccugcggccuguaccucgaccagcugaagcccgugggguccgccuacaagaucaucaccauccgcuacagccggcgcgucugcgugcaguucggcgaggagaaccugugcaagaucaucgacaugaacgacugcuucgugucccggcacgucaaggugugcaucaucgggaccgugagcaaguucucccagggcgacacccuccuguucuucgggccgcuggagggcggcgggcucaucuucaagcacuggugcacgagcaccugccaguucggcgaccccggggacaucauguccccccgcgacaagggcuuccugugccccgaguucccggggagcuuccggaagaagugcaacuucgccaccacccccaucugcgaguacgacggcaacauggucuccggcuacaagaaggugauggccacgaucgacagcuuccaguccuucaacaccagcaccaugcacuucaccgacgagcgcaucgaguggaaggaccccgacgggaugcugcgggaccacaucaacauccucgugacgaaggacaucgacuucgacaaccugggcgagaaccccugcaagaucgggcugcagaccuccagcaucgagggcgcguggggguccggcgucggcuucacccucaccugccuggugagccugacggagugcccgaccuuccucaccagcaucaaggccugcgacaaggccaucugcuacggggccgaguccgugacccugacgcgcggccagaacaccgucaaggugagcgggaagggcgggcacuccggcagcaccuucaagugcugccacggcgaggacugcucccagaucgggcugcacgccgcggccccccaccucgacaaggugaacggcaucagcgagaucgagaacuccaaggucuacgacgacggggccccccagugcggcaucaagugcugguucgugaagagcggcgaguggaucuccgggaucuucagcggcaacuggaucguccugaucgugcugugcguguuccuccuguucucccugguccuccugagcauccugugccccgugcggaagcacaagaaguccuga

SEQ ID NO: 11696 - RNA, 3408 nt, Artificial Sequence
  derived and/or modified CDS sequence (opt1) from HTNV(Fuyuan-Aa-145)__KJ857336.1__GP
augggcauguggaaguggcuggugaucgccagccucgucuggcccgcccugucccugcgcaacguguacgacaugaagaucgagugcccgcacaccgugagcuucggggagaacuccgucaucggcuacguggagcucccccccaugccccuggcggacaccgcccagauggugccggagagcuccugcagcauggacaaccaccaguccaucaacacgaucaccaaguacacccaggucaucuggcgggggaaggccgaccccggccagagcucccagaacagcuucgagaccguguccacggagguggaccugaaggggaccugcguccucaagcacaagaugguggaggagagcuaccgcucccggaagagcaucaccugcuacgaccuguccugcaacagcaccuucugcaagcccacgcuguacaugaucgugcccauccacgccugcaacaugaugaaguccugccucaucgcccugggcccguaccgcguccaggugguguacgagcggaccuacugcaugaccggcguccugaucgaggggaagugcuucgugcccgaccagagcguggucuccaucaucaagcacggcaucuucgacaucgcgagcgugcacguggucugcuucuucguggccgugaaggggaacaccuacaagcucuucgagcaggucaagaagagcuucgaguccacgugcaacgacaccgagaacaaggugcagggcuacuacaucugcaucgucgggggcaacagcgcccccaucuacgugcccacccuggacgacuuccgcuccauggaggccuucaccggcaucuucaagagcccgcacggggaggaccacgaccuggcgggcgaggagaucgccuccuacagcaucguggggcccgccaacgccaaggucccccacuccgccagcuccgacacgcucagccugaucgcguacuccggcauccccagcuacuccagccuguccauccucaccagcuccaccgacgccaagcacguguucagcccgggccuguuccccaagcugaaccacaccaacugcgacaaguccgccaucccccucacguggaccgggaugaucgaccugcccggcuacuacgaggccauccacccgugcaccguguucugcguccugagcgggcccggcgccagcugcgaggcguucuccgaggggggcaucuucaacaucaccagccccaugugccucguguccaagcagaaccgguuccgccugacggagcagcaggugaacuucgucugccagcggguggacauggacaucguggucuacugcaacggccagcgcaaggugauccugaccaagacccucgugaucgggcagugcaucuacaccaucacgagccuguucucccugcuccccggcgucgcccacagcaucgccguggagcugugcgugccgggguuccacggcugggccaccgccgcgcugcucgucaccuucugcuucgggugggugcugauccccgccgugaccuucaucauccugacgguccucaaguucaucgccaacaucuuccacaccuccaaccaggagaaccggcugaagagcgugcugcgcaagaucaaggaggaguucgagaagaccaagggcuccauggugugcgacgucugcaaguacgagugcgagaccuacaaggagcucaaggcccacggcgugagcugcccccagucccagugccccuacugcuucacgcacugcgagccgaccgaggccgcguuccaggcccacuacaaggugugccaggucacccaccgguuccgcgacgaccugaagaagaccgugaccccccagaacuucacgcccgggugcuaccggacccugaaccucuuccgcuacaagagccggugcuacaucuucaccauguggguguuccugcugauccucgaguccguccugugggccgccagcgcguccgagaccccgcugacgcccguguggaacgacaacgcccacggcguggggagcguccccaugcacaccgaccucgagcuggacuucucccugaccagcagcuccaaguacaccuaccgccggaagcugacgaacccccucgaggaggcccagagcaucgaccugcacaucgagaucgaggagcagaccaucggcguggacgugcacgcccuggggcacugguucgacggccgccucaaccugaagaccuccuuccacugcuacggcgccugcaccaaguacgaguacccguggcacacggcgaagugccacuacgagcgggacuaccaguacgagaccagcugggggugcaaccccuccgacugccccggcgucgggaccggcugcaccgccugcggccuguaccucgaccagcugaagcccguggggagcgccuacaagaucaucacgauccgcuacucccgccgggugugcguccaguucggcgaggagaaccugugcaagaucaucgacaugaacgacugcuucgugagccgccacgugaaggucugcaucaucgggaccguguccaaguucagccagggcgacacccuccuguucuucgggccgcuggagggcggcgggcucaucuucaagcacuggugcaccuccacgugccaguucggcgaccccggggacaucaugagcccccgggacaagggcuuccugugccccgaguucccgggguccuuccgcaagaagugcaacuucgccaccacccccaucugcgaguacgacggcaacauggugagcggcuacaagaaggucauggccaccaucgacuccuuccagagcuucaacacguccaccaugcacuucaccgacgagcggaucgaguggaaggaccccgacgggaugcugcgcgaccacaucaacauccucgugaccaaggacaucgacuucgacaaccugggcgagaaccccugcaagaucgggcugcagacgagcuccaucgagggcgcgugggggagcggcgugggcuucacccucaccugccuggucagccugaccgagugcccgacguuccucaccuccaucaaggccugcgacaaggccaucugcuacggggccgagagcgugacccugacccggggccagaacacggugaaggucuccgggaagggcgggcacagcggcuccaccuucaagugcugccacggcgaggacugcagcaagaucgggcugcacgccgcggccccccaccucgacaaggugaacggcaucuccgagaucgagaacagcaaggucuacgacgacggggccccccagugcggcaucaagugcugguucgugaaguccggcgaguggaucagcgggaucuucuccggcaacuggaucgugcugaucguccugugcguguuccuccuguucagccuggugcuccuguccauccugugccccguccgcaagcacaagaagagcuga

SEQ ID NO: 11697 - RNA, 3408 nt, Artificial Sequence
  derived and/or modified CDS sequence (opt1) from HTNV(Fuyuan-Aa-26)__KJ857334.1__GP
augggcauguggaaguggcuggugaucgccagccucgucuggcccgcccugucccugcgcaacguguacgacaugaagaucgagugcccgcacaccgugagcuucggggagaacuccgucaucggcuacguggagcucccccccaugccccuggcggacaccgcccagauggugccggagagcuccugcagcauggacaaccaccaguccaucaacacgaucaccaaguacacccaggucaucuggcgggggaaggccgaccccggccagagcucccagaacagcuucgagaccguguccacggagguggaccugaaggggaccugcguccucaagcacaagaugguggaggagagcuaccgcucccggaagagcaucaccugcuacgaccuguccugcaacagcaccuacugcaagcccacgcuguacaugaucgugcccauccacgccugcaacaugaugaaguccugccucaucgcccugggcccguaccgcguccaggugguguacgagcggaccuacugcaugaccggcguccugaucgaggggaagugcuucgugcccgaccagagcguggucuccaucaucaagcacggcaucuucgacaucgcgagcgugcacaucgugugcuucuucgucgccgugaaggggaacaccuacaagcucuucgagcaggugaagaagagcuucgaguccacgugcaacgacaccgagaacaagguccagggcuacuacaucugcaucguggggggcaacagcgcccccaucuacguccccacccuggacgacuuccgcuccauggaggccuucaccggcaucuucaagagcccgcacggggaggaccacgaccuggcgggcgaggagaucgccuccuacagcaucguggggcccgccaacgccaaggugccccacuccgccagcuccgacacgcucagccugaucgcguacuccggcauccccagcuacuccagccuguccauccucaccagcuccaccgacgccaagcacgucuucagcccgggccuguuccccaagcugaaccacaccaacugcgacaaguccgccaucccccucacguggaccgggaugaucgaccugcccggcuacuacgaggccauccacccgugcaccguguucugcgugcugagcgggcccggcgccagcugcgaggcguucuccgaggggggcaucuucaacaucaccagccccaugugccucgucuccaagcagaaccgguuccgccugacggagcagcaggugaacuucgugugccagcgggucgacauggacaucgugguguacugcaacggccagcgcaaggucauccugaccaagacccucgugaucgggcagugcaucuacaccaucacgagccuguucucccugcuccccggcguggcccacagcaucgccgucgagcugugcgugccgggguuccacggcugggccaccgccgcgcugcucgugaccuucugcuucggguggguccugauccccgccgugaccuucaucauccugacggugcucaaguucaucgccaacaucuuccacaccuccaaccaggagaaccggcugaagagcguccugcgcaagaucaaggaggaguucgagaagaccaagggcuccauggugugcgacgugugcaaguacgagugcgagaccuacaaggagcucaaggcccacggcgucagcugcccccagucccagugccccuacugcuucacgcacugcgagccgaccgaggccgcguuccaggcccacuacaaggugugccaggugacccaccgguuccgcgacgaccugaagaagaccgucaccccccagaacuucacgcccgggugcuaccggacccugaaccucuuccgcuacaagagccggugcuacaucuucaccauguggguguuccugcugauccucgaguccgugcugugggccgccagcgcguccgagaccccgcugacgcccgucuggaacgacaacgcccacggcguggggagcgugcccaugcacaccgaccucgagcuggacuucucccugaccagcagcuccaaguacaccuaccgccggaagcugacgaacccccucgaggaggcccagagcaucgaccugcacaucgagaucgaggagcagaccaucggcgucgacgugcacgcccuggggcacugguucgacggccgccucaaccugaagaccuccuuccacugcuacggcgccugcaccaaguacgaguacccguggcacacggcgaagugccacuacgagcgggacuaccaguacgagaccagcugggggugcaaccccuccgacugccccggcguggggaccggcugcaccgccugcggccuguaccucgaccagcugaagcccgucgggagcgccuacaagaucaucacgauccgcuacucccgccgggugugcgugcaguucggcgaggagaaccugugcaagaucaucgacaugaacgacugcuucgucagccgccacgugaaggugugcaucaucgggaccgucuccaaguucagccagggcgacacccuccuguucuucgggccgcuggagggcggcgggcucaucuucaagcacuggugcaccuccacgugccaguucggcgaccccggggacaucaugagcccccgggacaagggcuuccugugccccgaguucccgggguccuuccgcaagaagugcaacuucgccaccacccccaucugcgaguacgacggcaacauggugagcggcuacaagaaggugauggccaccaucgacuccuuccagagcuucaacacguccaccaugcacuucaccgacgagcggaucgaguggaaggaccccgacgggaugcugcgcgaccacaucaacauccucgucaccaaggacaucgacuucgacaaccugggcgagaaccccugcaagaucgggcugcagacgagcuccaucgagggcgcgugggggagcggcgugggcuucacccucaccugccuggugagccugaccgagugcccgacguuccucaccuccaucaaggccugcgacaaggccaucugcuacggggccgagagcgucacccugacccggggccagaacacggugaagguguccgggaagggcgggcacagcggcuccaccuucaagugcugccacggcgaggacugcagcaagaucgggcugcacgccgcggccccccaccucgacaaggucaacggcaucuccgagaucgagaacagcaagguguacgacgacggggccccccagugcggcaucaagugcugguucgucaaguccggcgaguggaucagcgggaucuucuccggcaacuggaucgugcugaucgugcugugcgucuuccuccuguucagccuggugcuccuguccauccugugccccgugcgcaagcacaagaagagcuga

SEQ ID NO: 11698 - RNA, 3408 nt, Artificial Sequence
  derived and/or modified CDS sequence (opt1) from HTNV(JS1)__KP970560.1__GP
augggcaucuggaaguggcuggugauggccagccucgucuggcccgugcugacccugcgcaacguguacgacaugaagaucgagugcccgcacaccgucuccuucgggggcaacagcgugaucggguacguggagcucccgcccgucccccuggccgacacggcccagauggugcccgaguccagcugcuccauggacaaccaccagagccugaacaccaucgccaaguacacccagguguccuggcggggcaaggccgaccagagccaguccagccagaacuccuucgagaccgucagcacggagguggaccucaaggggaccugcgugcugaagcacaagauggucgaggaguccuaccgcagccggaaguccgugaccugcuacgaccugagcugcaacuccaccuacugcaagcccacgcucuacaugaucgugcccauccacgccugcaacaugaugaaguccugccugaucgcccugggccccuaccgcguccaggugguguacgagcggaccuacugcaugaccggcguccucaucgaggggaagugcuucgugccggaccaguccguggucagcaucaucaagcacggcaucuucgacaucgcgagcgugcacaucgugugcuucuucgucgccgugaaggggaacaccuacaagaucuucgagcaggucaagaaguccuucgagagcacgugcaacgacaccgagaacaaggugcagggcuacuacaucugcaucgucgggggcaacuccgcccccaucuacgugcccacccuggacgacuuccgcagcauggaggccuucaccggcaucuuccggagcccccacggggaggaccacgaccuggcgggcgaggagaucgccuccuacuccaucguggggccggccaacgccaaggugccccacagcgccuccagcgacacgcucucccugaucgcguacagcggcauccccuccuacagcucccugagcauccucaccuccagcaccgaggccaagcacgucuucucccccggccuguucccgaagcugaaccacaccaacugcgacaagagcgccaucccccucaucuggacggggaugaucgaccugcccggcuacuacgaggccgugcaccccugcaccguguucugcguccugagcgggccgggcgccagcugcgaggcguucagcgagggcgggaucuucaacaucaccucccccaugugccucgugagcaagcagaaccgcuuccggcugaccgagcagcaggucaacuucgugugccagcgcguggacauggacaucguggucuacugcaacggccagcggaaggugauccugacgaagacccucgugaucgggcagugcaucuacaccaucaccucccuguucagccugcuccccggcgucgcccacuccaucgccguggagcugugcgugcccggguuccacggcugggccacggccgcgcugcucgucaccuucugcuucgggugggugcugaucccggccaucaccuucaucauccugaccgugcucaaguucaucgccaacaucuuccacacgagcaaccaggagaaccgccugaaguccguccugcggaagaucaaggaggaguucgagaagaccaagggcagcauggugugcgacgugugcaaguacgagugcgagaccuacaaggagcucaaggcccacggcgucuccugcccccagagccagugccccuacugcuucacccacugcgagcccacggaggccgcguuccaggcccacuacaaggugugccaggugacccaccgcuuccgggacgaccugaagaagaccgucaccccgcagaacuucacccccgggugcuaccgcacgcugaaccucuuccgguacaagucccgcugcuacaucuucaccauguggaucuuccugcuggugcucgagagcauccugugggccgccuccgcgagcgagacgccccugaccccgguguggaacgacaacgcccacggcgucggguccgugcccaugcacaccgaccucgagcuggacuucagccugaccagcuccagcaaguacaccuaccggcgcaagcugaccaacccccucgaggaggcccaguccaucgaccugcacaucgagaucgaggagcagacgaucggcguggacguccacgcccuggggcacugguucgacggccggcucaaccugaagaccagcuuccacugcuacggcgccugcaccaaguacgaguaccccuggcacaccgcgaagugccacuacgagcgcgacuaccaguacgagacguccugggggugcaacccgagcgacugccccggcguggggaccggcugcaccgccugcggccuguaccucgaccagcugaagcccgugggguccgccuacaagaucaucaccauccgcuacagccggcgcgucugcgugcaguucggcgaggggaaccugugcaagaucaucgacaugaacgacugcuucgugucccggcacgucaaggugugcaucaucggcacggugagcaaguucucccagggggacacccuccuguucuucggcccccuggagggcgggggccucaucuucaagcacuggugcaccuccacgugccaguucggggacccgggcgacaucaugagcccccgcgacaagggguuccugugccccgaguuccccggcagcuuccggaagaagugcaacuucgccaccaccccgaucugcgaguacgacggcaacauggucuccggguacaagaaggugauggccaccaucgacagcuuccaguccuucaacaccagcacgaugcacuucaccgacgagcgcaucgaguggaaggaccccgacggcaugcugcgggaccacaucaacauccucgugaccaaggacaucgacuucgacaaccugggggagaaccccugcaagaucggccugcagaccuccagcaucgagggggcguggggcagcggcgucggguucacgcugaccugccucgugucccugaccgagugccccaccuuccucacgagcaucaaggccugcgacaaggccaucugcuacggcgccgaguccgugacccugacccgcgggcagaacaccgucaaggugagcggcaagggcgggcacuccggcagcacguucaagugcugccacggggaggacugcucccagaucggccugcacgccgcggccccgcaccucgacaaggucaacgggaucagcgagaucgagaacuccaagguguacgacgacggcgcgccccagugcggcaucaagugcugguucgucaagagcggggaguggaucuccggcaucuucagcgggaacuggaucgugcugaucgugcugugcguguuccuccuguucucccugguccuccugagcauccugugccccgugcggaagcacaagaaguccuga

SEQ ID NO: 11699 - RNA, 3408 nt, Artificial Sequence
  derived and/or modified CDS sequence (opt1) from HTNV(LongquanAa-08-150)__JQ912803.1__GP
augggcaucuggaaguggcuggugauggccagccucgucuggcccgccuucacccugcgcaacguguacgacaugaagaucgagugcccgcacaccguguccuucggggagaacagcgucaucggcuacguggagcugccgcccaugccccucgccgacacggcccagauggugcccgaguccagcugcaacauggacaaccaccaguccaugaacaccaucaccaaguacacccaggucagcuggcgggggaaggccgaccaggcccaggccucccagaacagcuucgaggcgguguccgccgagguggaccugaagggcaucugcguccugaagcacaagaugcucgaggagagcuaccgcucccggaaguccaucacgugcuacgaccuguccugcaacagcaccuacugcaagcccacccuguacaugaucgugcccauccacgccugcaacaugaugaaguccugccucaucgcccuggggcccuaccgcgugcaggucguguacgagcggaccuacugcaugacgggcgugcugcucgagggcaagugcuucgucccggaccagagcgugguguccaucaucaagcacgggaucuucgacaucgcgagcguccacaucgugugcuucuucguggccgucaagggcaacaccuacaagcugcuggagcaggucaagaaguccuuccagagcacgugcaacgacaccgagaacaaggugcagggguacuacaucugcaucgugggcgggaacagcgcccccaucuacgugcccacccucgacgacuuccgcuccauggaggccuucagcggcaucuuccggagcccccacggcgaggaccacgaccuggccggggaggagaucgcgagcuacuccaucgucggcccggccaacgccaaggugccccacagcgccuccagcgacacccugucccucaucgccuacagcgggauccccuccuacagcucccugagcauccuggcguccagcaccgaggccaagcacguguucucccccggcuucuucccgcagcucaaccacaccaagugcgacaagacggccaucccccugaucuggaccggcaugaucgaccugcccggguacuacgaggccauccaccccugcaccgucuucugcgugcucagcggcccgggggccuccugcgaggcguucagcgagggcgggaucuucaacaucaccagccccaugugccugguguccaagcagaaccgcuuccggcugacggagcagcaggucaacuucgugugccagcgcguggacgucgacaucaucguguacugcaacggccagcggaaggugauccucaccaagacccuggucaucggccagugcaucuacaccaucacgagccuguucucccuccugcccgggguggcccacagcaucgccguggagcugugcguccccggcuuccacgggugggccaccgccgcgcuccuggugaccuucugcuucggcugggugcugaucccggcccucacccugaucauccugacgauccucaaguucaucgccaacaucuuccacacgugcaaccaggagaaccgccugaaguccguccugcggaagaucaaggaggaguucgagaagaccaaggggagcauggugugcgacgugugcaaguacgagugcgagaccuacaaggagcucaaggcccacggcgucuccugcccccagagccagugccccuacugcuucacccacugcgagcccaccgaggcggccuuccaggcccacuaccgcgugugccaggugacccaccgguuccgcgacgaccugaagaagaccgucacgccgcagaacuucacccccggcugcuaccggacccugaaccucuuccgcuacaagucccggugcuacaucuucaccaugugggugugccugcuggugcucgagagcauccugugggccgccuccgcgagcgaggucccccugaacccgguguggaacgacaacgcccacggggugggcuccguccccaugcacaccgaccuggagcucgacuucagccugacguccagcuccaaguacaccuaccgccggcgccugaccaacccccucgaggagacccagagcaucaaccugcacaucgagaucgaggagcagacgaucgggguggacgugcacgcccugggccacugguucgacgggcgccucaaccugaagaccagcuuccacugcuacggcgccugcaccaaguacgaguaccccuggcacaccgccaagugccacuacgagcgggacuaccaguacgagacguccuggggcugcaacccggcggacugccccggggucggcaccgggugcaccgccugcggccuguaccucgaccagcugaagcccgugggcagcgccuacaagaucaucaccauccgcuacucccggaaggugugcguccaguucggggaggagaaccugugcaaggugaucgacaugaacgacugcuucgugacgcgccacgucaaggugugcaucaucggcaccgugagcaaguucucccagggggacacccuccuguucuucggcccccuggagggcgggggccucaucuucaagcacuggugcaccagcacgugccaguucggggacccgggcgacaucaugagcccccgggacaagggguuccugugccccgaguuccccggcagcuuccgcaagaagugcaacuucgccaccaccccgcugugcgaguacgacgggaacauggucuccggcuacaagaaggugauggccaccaucgacagcuuccaguccuucaacacgagcaccaugcacuucaccgacgagcggaucgaguggaaggaccccgacggcaugcuccgcgaccacaucaacauccuggugaccaaggacaucgacuucgacaaccugggggagaaccccugcaagaucggccuccagacguccagcaucgagggggcguggggcuccggggucggcuucacccugaccugccugaucagccucaccgagugccccacguuccugaccuccaucaaggccugcgacaaggccaucugcuacggcgccgagagcgugacccugacccgggggcagaacacggugaaggucuccggcaagggcgggcacagcgggagcaccuucaagugcugccacggcgaggagugcucccagaucggccuccacgcggccgccccgcaccuggacaaggugaacgggaucagcgagaucgagaacaacaagguguacgacgacggcgcgccccagugcggggucaagugcugguucgugaaguccggcgaguggaucagcggcaucuucuccgggaacuggaucguccugaucgugcucugcguguuccugcuguucagccucguccugcuguccgugcucugccccgugcgcaagcacaagaaguccuga

SEQ ID NO: 11700 - RNA, 3408 nt, Artificial Sequence
  derived and/or modified CDS sequence (opt1) from HTNV(LongquanAa-08-157)__JQ912804.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugucccccaugccccucgcggacacggcccagauggugcccgagagcuccugcaacauggacaaccaccagagcaugaacaccaucaccaaguacacccaggucuccuggcggggcaaggccgaccaggcccaggccagccagaacuccuucgaggcggugagcgccgagguggaccugaaggggacgugcguccugaagcacaagaugcucgaggaguccuaccgcagccggaaguccaucaccugcuacgaccugagcugcaacuccaccuacugcaagccgacccuguacaugaucgugcccauccacgccugcaacaugaugaagagcugccucaucgcccugggccccuaccgcgugcaggucguguacgagcggacguacugcaugaccggggugcugaucgagggcaagugcuucguccccgaccaguccguggugagcaucaucaagcacggcaucuucgacaucgcguccguccacaucgugugcuucuucguggccgucaaggggaacaccuacaagcucuucgagcaggugaagaagagcuuccagagcaccugcaacggcacggagaacaaggugcagggguacuacaucugcaucgucggcgggaacuccgccccgaucuacgugcccacccuggacgacuuccgcagcauggaggccuucuccggcaucuuccggagcccccacggcgaggaccacgaccuggccggggaggagaucgcguccuacagcaucgucggccccgccaacgccaaggugccgcacuccgccagcuccgacacccucagccugaucgccuacuccgggauccccagcuacuccagccuguccauccucgcgagcuccaccgaggccaagcacguguucagccccggcuucuucccccagcugaaccacacgaagugcgacaagaccgccaucccgcugaccuggaccggcaugaucgaccuccccggguacuacgaggccauccaccccugcacggucuucugcgugcuguccggccccggggccagcugcgaggcguucagcgagggcgggaucuucaacaucaccuccccgaugugccuggugagcaagcagaaccgcuuccggcucaccgagcagcaggucaacuucgugugccagcgcguggacauggacaucaucgucuacugcaacggccagcggaaggugauccugaccaagacgcuggugaucggccagugcaucuacaccaucaccucccucuucagccugcugcccggggucgcccacuccaucgccguggagcucugcgugcccggcuuccacgggugggccaccgccgcgcugcuggucacguucugcuucggcugggugcucauccccgcccugacccugaucauccucaccauccugaaguucaucgccaaccuguuccacaccagcaaccaggagaaccgccucaaguccgugcugcggaagaucaaggaggaguucgagaagacgaaggggagcauggucugcgacgugugcaaguacgagugcgagaccuacaaggagcugaaggcccacggcguguccugcccgcagagccagugccccuacugcuucacccacugcgagcccaccgaggcggccuuccaggcccacuaccgcgucugccaggugacgcaccgguuccgcgacgaccucaagaagaccgugaccccccagaacuucaccccgggcugcuaccggacccugaaccuguuccgcuacaagucccggugcuacaucuucacgaugugggucugccuccuggugcuggagagcauccucugggccgccuccgcgagcgaggugccccugaaccccgucuggaacgacaacgcccacggggugggcuccgugccgaugcacaccgaccuggagcuggacuucagccucaccuccagcagcaaguacaccuaccgccggcgccugacgaacccccuggaggagacccaguccaucaaccuccacaucgagaucgaggagcagaccaucggggucgacgugcacgcccugggccacugguucgacgggcgccugaaccucaagaccagcuuccacugcuacggcgccugcacgaaguacgaguaccccuggcacaccgccaagugccacuacgagcgggacuaccaguacgagaccuccuggggcugcaaccccgcggacugcccgggggugggcaccgggugcacggccugcggccuguaccuggaccagcucaagcccgucggcagcgccuacaagaucaucaccauccgcuacucccggaaggugugcgugcaguucggggaggagaaccugugcaaggucaucgacaugaacgacugcuucgugacccgccacgugaaggucugcaucaucggcaccgugagcaaguucucccagggggacacgcugcucuucuucggcccccuggaggggggcggccugaucuucaagcacuggugcaccagcaccugccaguucggggaccccggcgacaucauguccccgcgggacaagggguuccucugccccgaguuccccggcagcuuccgcaagaagugcaacuucgccaccacgccccugugcgaguacgacgggaacaugguguccggcuacaagaaggucauggccaccaucgacagcuuccaguccuucaacaccagcaccaugcacuucacggacgagcggaucgaguggaaggacccggacggcaugcugcgcgaccacaucaacauccucgugaccaaggacaucgacuucgacaaccugggggagaaccccugcaagaucggccugcagaccuccagcaucgagggggcguggggcuccggggugggcuucacccucacgugccugaucagccugaccgagugccccaccuuccucaccuccaucaaggccugcgacaaggccaucugcuacggcgccgagagcgucacgcugacccgggggcagaacaccgugaaggugagcggcaaggggggccacuccgggagcaccuucaagugcugccacggcgaggagugcucccagaucggccugcacgcggccgccccccaccucgacaaggucaacgggaucagcgagaucgagaacaacaagguguacgacgacggcgccccgcagugcggggugaagugcugguucgucaaguccggcgaguggaucagcggcaucuucuccgggaacuggaucgugcugaucguccugugcguguuccuccuguucagccuggugcuccuguccguccugugccccgugcgcaagcacaagaagagcuga

SEQ ID NO: 11701 - RNA, 3408 nt, Artificial Sequence
  derived and/or modified CDS sequence (opt1) from HTNV(LongquanAa-08-196)__JQ912805.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugccgcccaugccccucgccgacacggcccagauggugcccgaguccagcugcaacauggacaaccaccaguccaugaacaccaucaccaaguacacccaggucagcuggcggggcaaggccgaccaggcccaggccucccagaacagcuucgaggcgguguccgccgagguggaccugaaggggacgugcguccugaagcacaagaugcucgaggagagcuaccgcucccggaaguccaucacgugcuacgaccuguccugcaacagcaccuacugcaagcccacccuguacaugaucgugcccauccacgccugcaacaugaugaaguccugccucaucgcccugggccccuaccgcgugcaggucguguacgagcggaccuacugcaugaccggggugcugaucgagggcaagugcuucgucccggaccagagcgugguguccaucaucaagcacggcaucuucgacaucgcgagcguccacaucgugugcuucuucguggccgucaaggggaacaccuacaagcuguucgagcaggucaagaaguccuuccagagcacgugcaacggcaccgagaacaaggugcagggguacuacaucugcaucgugggcgggaacagcgcccccaucuacgugcccacccuggacgacuuccgcuccauggaggccuucagcggcaucuuccggagcccccacggcgaggaccacgaccuggccggggaggagaucgcgagcuacuccaucgucggcccggccaacgccaaggugccccacagcgccuccagcgacacccucucccugaucgccuacagcgggauccccuccuacagcucccugagcauccucgcguccagcaccgaggccaagcacguguucucccccggcuucuucccgcagcugaaccacacgaagugcgacaagaccgccaucccccugaccuggaccggcaugaucgaccuccccggguacuacgaggccauccaccccugcacggucuucugcgugcugagcggcccgggggccuccugcgaggcguucagcgagggcgggaucuucaacaucaccagccccaugugccugguguccaagcagaaccgcuuccggcucaccgagcagcaggucaacuucgugugccagcgcguggacauggacaucaucgucuacugcaacggccagcggaaggugauccugaccaagacgcuggugaucggccagugcaucuacaccaucaccagccucuucucccugcugcccggggucgcccacagcaucgccguggagcucugcgugcccggcuuccacgggugggccaccgccgcgcugcuggucacguucugcuucggcugggugcucaucccggcccugacccugaucauccucaccauccugaaguucaucgccaacaucuuccacaccuccaaccaggagaaccgccucaagagcgugcuccggaagaucaaggaggaguucgagaagacgaagggguccauggucugcgacgugugcaaguacgagugcgagaccuacaaggagcugaaggcccacggcgugagcugcccccagucccagugccccuacugcuucacccacugcgagcccaccgaggcggccuuccaggcccacuaccgcgucugccaggugacgcaccgguuccgcgacgaccugaagaagaccgugaccccgcagaacuucacccccggcugcuaccggacccucaaccuguuccgcuacaagagccggugcuacaucuucacgaugugggucugccugcucgugcuggaguccauccugugggccgccagcgcguccgaggugccccucaacccggucuggaacgacaacgcccacggggugggcagcgugcccaugcacaccgaccuggagcuggacuucucccugaccagcuccagcaaguacaccuaccgccggcgccucacgaacccccuggaggagacccagagcaucaaccugcacaucgagaucgaggagcagaccaucggggucgacgugcacgcccucggccacugguucgacgggcgccugaaccugaagaccuccuuccacugcuacggcgccugcacgaaguacgaguaccccuggcacaccgccaagugccacuacgagcgggacuaccaguacgagaccagcuggggcugcaacccggcggacugccccggggugggcaccgggugcacggccugcggccucuaccuggaccagcugaagcccgucggcuccgccuacaagaucaucaccauccgcuacagccggaaggugugcgugcaguucggggaggagaaccucugcaaggucaucgacaugaacgacugcuucgugacccgccacgugaaggucugcaucaucggcaccguguccaaguucagccagggggacacgcugcuguucuucggcccccucgagggcgggggccugaucuucaagcacuggugcaccuccacgugccaguucggggacccgggcgacaucaugagcccccgggacaagggguuccugugccccgaguuccccggcuccuuccgcaagaagugcaacuucgccaccaccccgcucugcgaguacgacgggaacauggugagcggcuacaagaaggucauggccaccaucgacuccuuccagagcuucaacaccuccaccaugcacuucacggacgagcggaucgaguggaaggaccccgacggcaugcugcgcgaccacaucaacauccuggugaccaaggacaucgacuucgacaaccucggggagaaccccugcaagaucggccugcagaccagcuccaucgagggggcguggggcagcggggugggcuucacccugacgugccucaucucccugaccgagugccccaccuuccugaccagcaucaaggccugcgacaaggccaucugcuacggcgccgaguccgucacgcucacccgggggcagaacaccgugaaggugagcggcaagggcgggcacagcggguccaccuucaagugcugccacggcgaggagugcagccagaucggccugcacgcggccgccccgcaccuggacaaggucaacgggaucuccgagaucgagaacaacaagguguacgacgacggcgcgccccagugcggggugaagugcugguucgucaagagcggcgaguggaucuccggcaucuucagcgggaacuggaucgugcucaucguccugugcguguuccuccuguucucccuggugcugcucagcguccugugccccgugcgcaagcacaagaaguccuga

SEQ ID NO: 11702 - RNA, 3408 nt, Artificial Sequence
  derived and/or modified CDS sequence (opt1) from HTNV(LongquanAa-08-235)__JQ912810.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugccgcccaugccccucgccgacacggcccagauggugcccgaguccagcugcaacauggacaaccaccaguccaugaacaccaucaccaaguacacccaggucagcuggcggggcaaggccgaccaggcccaggccucccagaacagcuucgaggcgguguccgccgagguggaccugaaggggacgugcguccugaagcacaagaugcucgaggagagcuaccgcucccggaaguccaucacgugcuacgaccuguccugcaacagcaccuacugcaagcccacccuguacaugaucgugcccauccacgccugcaacaugaugaaguccugccucaucgcccugggccccuaccgcgugcaggucguguacgagcggaccuacugcaugaccggggugcugaucgagggcaagugcuucgucccggaccagagcgugguguccaucaucaagcacggcaucuucgacaucgcgagcguccacaucgugugcuucuucguggccgucaaggggaacaccuacaagcuguucgagcaggucaagaaguccuuccagagcacgugcaacggcaccgagaacaaggugcagggguacuacaucugcaucgugggcgggaacagcgcccccaucuacgugcccacccuggacgacuuccgcuccauggaggccuucagcggcaucuuccggagcccccacggcgaggaccacgaccuggccggggaggagaucgcgagcuacuccaucgucggcccggccaacgccaaggugccccacagcgccuccagcgacacccucucccugaucgccuacagcgggauccccuccuacagcucccugagcauccucgcguccagcaccgaggccaagcacguguucucccccggcuucuucccgcagcugaaccacacgaagugcgacaagaccgccaucccccugaccuggaccggcaugaucgaccuccccggguacuacgaggccauccaccccugcacggucuucugcgugcugagcggcccgggggccuccugcgaggcguucagcgagggcgggaucuucaacaucaccagccccaugugccugguguccaagcagaaccgcuuccggcucaccgagcagcaggucaacuucgugugccagcgcguggacauggacaucaucgucuacugcaacggccagcggaaggugauccugaccaagacgcuggugaucggccagugcaucuacaccaucaccagccucuucucccugcugcccggggucgcccacagcaucgccguggagcucugcgugcccggcuuccacgggugggccaccgccgcgcugcuggucacguucugcuucggcugggugcucaucccggcccugacccugaucauccucaccauccugaaguucaucgccaacaucuuccacaccuccaaccaggagaaccgccucaagagcgugcuccggaagaucaaggaggaguucgagaagacgaagggguccauggucugcgacgugugcaaguacgagugcgagaccuacaaggagcugaaggcccacggcgugagcugcccccagucccagugccccuacugcuucacccacugcgagcccaccgaggcggccuuccaggcccacuaccgcgucugccaggugacgcaccgguuccgcgacgaccugaagaagaccgugaccccgcagaacuucacccccggcugcuaccggacccucaaccuguuccgcuacaagagccggugcuacaucuucacgaugugggucugccugcucguguucgaguccauccugugggccgccagcgcguccgaggugccccugaacccggucuggaacgacaacgcccacggggugggcagcgugcccaugcacaccgaccucgagcuggacuucucccugaccagcuccagcaaguacaccuaccgccggcgccugacgaacccccucgaggagacccagagcaucaaccugcacaucgagaucgaggagcagaccaucggggucgacgugcacgcccugggccacugguucgacgggcgccucaaccugaagaccuccuuccacugcuacggcgccugcacgaaguacgaguaccccuggcacaccgccaagugccacuacgagcgggacuaccaguacgagaccagcuggggcugcaacccggcggacugccccggggugggcaccgggugcacggccugcggccuguaccucgaccagcugaagcccgucggcuccgccuacaagaucaucaccauccgcuacagccggaaggugugcgugcaguucggggaggagaaccugugcaaggucaucgacaugaacgacugcuucgugacccgccacgugaaggucugcaucaucggcaccguguccaaguucagccagggggacacgcuccuguucuucggcccccuggagggcgggggccucaucuucaagcacuggugcaccuccacgugccaguucggggacccgggcgacaucaugagcccccgggacaagggguuccugugccccgaguuccccggcuccuuccgcaagaagugcaacuucgccaccaccccgcugugcgaguacgacgggaacauggugagcggcuacaagaaggucauggccaccaucgacuccuuccagagcuucaacaccuccaccaugcacuucacggacgagcggaucgaguggaaggaccccgacggcaugcuccgcgaccacaucaacauccuggugaccaaggacaucgacuucgacaaccugggggagaaccccugcaagaucggccuccagaccagcuccaucgagggggcguggggcagcggggugggcuucacccugacgugccugaucucccucaccgagugccccaccuuccugaccagcaucaaggccugcgacaaggccaucugcuacggcgccgaguccgucacgcugacccgggggcagaacaccgugaaggugagcggcaagggcgggcacagcggguccaccuucaagugcugccacggcgaggagugcagccagaucggccuccacgcggccgccccgcaccuggacaaggucaacgggaucuccgagaucgagaacaacaagguguacgacgacggcgcgccccagugcggggugaagugcugguucgucaagagcggcgaguggaucuccggcaucuucagcgugaacuggaucguccugaucgugcucugcguguuccugcuguucucccucguccugcugagcgugcucugccccgugcgcaagcacaagaaguccuga

SEQ ID NO: 11703 - RNA, 3408 nt, Artificial Sequence
  derived and/or modified CDS sequence (opt1) from HTNV(LongquanAa-09-171)__JQ912824.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugccccccaugccccucgcggacacggcccagauggugccggaguccagcugcaacauggacaaccaccaguccaugaacaccaucaccaaguacacccaggucagcuggcggggcaaggccgaccaggcccaggccucccagaacagcuucgaggcgguguccgccgagguggaccugaaggggacgugcguccugaagcacaagaugcucgaggagagcuaccgcucccggaagagcaucaccugcuacgaccuguccugcaacagcaccuacugcaagcccacccuguacaugaucgugcccauccacgccugcaacaugaugaaguccugccucaucgcccugggccccuaccgcgugcaggucguguacgagcggacguacugcaugaccggggugcugaucgagggcaagugcuucgucccggaccagagcgugguguccaucaucaagcacggcaucuucgacaucgcgagcguccacaucgugugcuucuucguggccgucaaggggaacaccuacaagcucuucgagcaggugaagaaguccuuccagagcaccugcaacggcacggagaacaaggugcagggguacuacaucugcaucgucggcgggaacagcgcccccaucuacgugcccacccuggacgacuuccgcuccauggaggccuucagcggcaucuuccgguccccccacggcgaggaccacgaccuggccggggaggagaucgcgagcuacuccaucgucggcccggccaacgccaaggugccccacagcgccuccagcgacacccucucccugaucgccuacagcgggauccccuccuacagcucccugagcauccucgcguccagcaccgaggccaagcacguguucucccccggcuucuucccgcagcugaaccacacgaagugcgacaagaccgccaucccccugaccuggaccggcaugaucgaccuccccggguacuacgaggccauccaccccugcacggucuucugcgugcugagcggcccgggggccuccugcgaggcguucagcgagggcgggaucuucaacaucaccagccccaugugccugguguccaagcagaaccgcuuccggcucaccgagcagcaggucaacuucgugugccagcgcguggacauggacaucaucgucuacugcaacggccagcggaaggugauccugaccaagacgcuggugaucggccagugcaucuacaccaucaccagccucuucucccugcugcccggggucgcccacagcaucgccguggagcucugcgugcccggcuuccacgggugggccaccgccgcgcugcuggucacguucugcuucggcugggugcucaucccggcccugacccugaucauccucaccauccugaaguucaucgccaacaucuuccacaccaacaaccaggagaaccgccugaaguccgugcuccggaagaucaaggaggaguucgagaagacgaaggggagcauggucugcgacgugugcaaguacgagugcgagaccuacaaggagcugaaggcccacggcguguccugcccccagagccagugccccuacugcuucacccacugcgagcccaccgaggcggccuuccaggcccacuaccgcgucugccaggugacgcaccgguuccgcgacgaccugaagaagaccgugaccccgcagaacuucacccccggcugcuaccggacccucaaccuguuccgcuacaagucccggugcuacaucuucacgaugugggucugccugcucgugcuggagagcauccugugggccgccuccgcgagcgaggugccccucaacccggucuggaacgacaacgcccacggggugggcuccgugcccaugcacaccgaccuggagcuggacuucagccugaccuccagcuccaaguacaccuaccgccggcgccucacgaacccccuggaggagacccagagcaucaaccugcacaucgagaucgaggagcagaccaucggggucgacgugcacgcccucggccacugguucgacgggcgccugaaccugaagaccagcuuccacugcuacggcgccugcacgaaguacgaguaccccuggcacaccgccaagugccacuacgagcgggacuaccaguacgagaccuccuggggcugcaacccggcggacugccccggggugggcaccgggugcacggccugcggccucuaccuggaccagcugaagcccgucggcagcgccuacaagaucaucaccauccgcuacucccggaaggugugcgugcaguucggggaggagaaccucugcaaggucaucgacaugaacgacugcuucgugacccgccacgugaaggucugcaucaucggcaccgugagcaaguucucccagggggacacgcugcuguucuucggcccccucgaggggggcggccugaucuucaagcacuggugcaccagcaccugccaguucggggacccgggcgacaucauguccccccgggacaagggguuccugugccccgaguuccccggcagcuuccgcaagaagugcaacuucgccaccacgccgcucugcgaguacgacgggaacaugguguccggcuacaagaaggucauggccaccaucgacagcuuccaguccuucaacaccagcaccaugcacuucacggacgagcggaucgaguggaaggaccccgacggcaugcugcgcgaccacaucaacauccuggugaccaaggacaucgacuucgacaaccucggggagaaccccugcaagaucggccugcagaccuccagcaucgagggggcguggggcuccggggugggcuucacccugacgugccucaucagccugaccgagugccccaccuuccugaccuccaucaaggccugcgacaaggccaucugcuacggcgccgagagcgucacgcucacccgggggcagaacaccgugaagguguccggcaaggggggccacagcgggagcaccuucaagugcugccacggcgaggagugcucccagaucggccugcacgcggccgccccgcaccuggacaaggucaacgggaucagcgagaucgagaacaacaagguguacgacgacggcgccccccagugcggggugaagugcugguucgucaaguccggcgaguggaucagcggcaucuucuccgggaacuggaucgugcucaucguccugugcguguuccugcucuucagccuggugcugcucuccguccugugccccgugcgcaagcacaagaagagcuga

SEQ ID NO: 11704 - RNA, 3408 nt, Artificial Sequence
  derived and/or modified CDS sequence (opt1) from HTNV(LongquanAa-09-191)__JQ912825.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugccccggaugccccucgcggacacggcccagauggugcccgaguccagcugcaacauggacaaccaccaguccaugaacaccaucaccaaguacacccaggucagcuggcgcggcaaggccgaccaggcccaggccucccagaacagcuucgaggcgguguccgccgagguggaccugaaggggacgugcguccugaagcacaagaugcucgaggagagcuaccggucccgcaagagcaucaccugcuacgaccuguccugcaacagcaccuacugcaagccgacccuguacaugaucgugcccauccacgccugcaacaugaugaaguccugccucaucgcccugggccccuaccgggugcaggucguguacgagcgcacguacugcaugaccggggugcugaucgagggcaagugcuucguccccgaccagagcgugguguccaucaucaagcacggcaucuucgacaucgcgagcguccacaucgugugcuucuucguggccgucaaggggaacaccuacaagcucuucgagcaggugaagaaguccuuccagagcaccugcaacggcacggagaacaaggugcagggguacuacaucugcaucgucggcgggaacagcgccccgaucuacgugcccacccuggacgacuuccgguccauggaggccuucagcggcaucuuccgcuccccccacggcgaggaccacgaccuggccggggaggagaucgcgagcuacuccaucgucggccccgccaacgccaaggugccgcacagcgccuccagcgacacccucucccugaucgccuacagcgggauccccuccuacagcucccugagcauccucgcguccagcaccgaggccaagcacguguucucccccggcuucuucccccagcugaaccacacgaagugcgacaagaccgccaucccgcugaccuggaccggcaugaucgaccuccccggguacuacgaggccauccaccccugcacggucuucugcgugcugagcggccccggggccuccugcgaggcguucagcgagggcgggaucuucaacaucaccagcccgaugugccugguguccaagcagaaccgguuccgccucaccgagcagcaggucaacuucgugugccagcggguggacauggacaucaucgucuacugcaacggccagcgcaaggugauccugaccaagacgcuggugaucggccagugcaucuacaccaucaccagccucuucucccugcugcccggggucgcccacagcaucgccguggagcucugcgugcccggcuuccacgggugggccaccgccgcgcugcuggucacguucugcuucggcugggugcucauccccgcccugacccugaucauccucaccauccugaaguucaucgccaacaucuuccacaccuccaaccaggagaaccggcugaagagcgugcuccgcaagaucaaggaggaguucgagaagacgaagggguccauggucugcgacgugugcaaguacgagugcgagaccuacaaggagcugaaggcccacggcgugagcugcccgcagucccagugccccuacugcuucacccacugcgagcccaccgaggcggccuuccaggcccacuaccgggucugccaggugacgcaccgcuuccgggacgaccugaagaagaccgugaccccccagaacuucaccccgggcugcuaccgcacccucaaccuguuccgguacaagagccgcugcuacaucuucacgaugugggucugccugcucgugcuggaguccauccugugggccgccagcgcguccgaggugccccucaaccccgucuggaacgacaacgcccacggggugggcagcgugccgaugcacaccgaccuggagcuggacuucucccugaccagcuccagcaaguacaccuaccggcgccgccucacgaacccccuggaggagacccagagcaucaaccugcacaucgagaucgaggagcagaccaucggggucgacgugcacgcccucggccacugguucgacgggcggcugaaccugaagaccuccuuccacugcuacggcgccugcacgaaguacgaguaccccuggcacaccgccaagugccacuacgagcgcgacuaccaguacgagaccagcuggggcugcaaccccgcggacugcccgggggugggcaccgggugcacggccugcggccucuaccuggaccagcugaagcccgucggcuccgccuacaagaucaucaccauccgguacagccgcaaggugugcgugcaguucggggaggagaaccucugcaaggucaucgacaugaacgacugcuucgugacccggcacgugaaggucugcaucaucggcaccguguccaaguucagccagggggacacgcugcuguucuucggcccccucgaggggggcggccugaucuucaagcacuggugcaccuccaccugccaguucggggaccccggcgacaucaugagcccgcgcgacaagggguuccugugccccgaguuccccggcuccuuccggaagaagugcaacuucgccaccacgccccucugcgaguacgacgggaacauggugagcggcuacaagaaggucauggccaccaucgacuccuuccagagcuucaacaccuccaccaugcacuucacggacgagcgcaucgaguggaaggacccggacggcaugcugcgggaccacaucaacauccuggugaccaaggacaucgacuucgacaaccucggggagaaccccugcaagaucggccugcagaccagcuccaucgagggggcguggggcagcggggugggcuucacccugacgugccucaucucccugaccgagugccccaccuuccugaccagcaucaaggccugcgacaaggccaucugcuacggcgccgaguccgucacgcucacccgcgggcagaacaccgugaaggugagcggcaaggggggccacagcggguccaccuucaagugcugccacggcgaggagugcagccagaucggccugcacgcggccgccccccaccuggacaaggucaacgggaucuccgagaucgagaacaacaagguguacgacgacggcgccccgcagugcggggugaagugcugguucgucaagagcggcgaguggaucuccggcaucuucagcgggaacuggaucgugcucaucguccugugcguguuccugcucuucucccuggugcugcucagcguccugugccccgugcggaagcacaagaaguccuga

SEQ ID NO: 11705 - RNA, 3408 nt, Artificial Sequence
  derived and/or modified CDS sequence (opt1) from HTNV(LongquanAa-09-350)__JQ912835.1__GP
auggagaucuggaaguggcuggugauggccagccucgucuggcccgccuucacccgccggaacguguacgacaugaagaucgagugcccgcacaccguguccuucggcgagaacagcgucaucggguacguggagcugccgcccaugccccuggccgacacggcccagauggugcccgaguccagcugcaacauggacaaccaccaguccaugaacaccaucaccaaguacacccaggucagcuggcgcggcaaggccgaccaggcccaggccucccagaacagcuucgaggcgguguccgccgagguggaccucaaggggacgugcguccugaagcacaagaugcuggaggagagcuaccggucccgcaagagcaucacgugcuacgaccucuccugcaacagcaccuacugcaagcccacccuguacaugaucgugcccauccacgccugcaacaugaugaaguccugccugaucgcccucggccccuaccgggugcaggucguguacgagcgcaccuacugcaugaccggggugcugaucgagggcaagugcuucgucccggaccagagcgugguguccaucaucaagcacggcaucuucgacaucgcgagcguccacaucgugugcuucuucguggccgucaaggggaacaccuacaagcuguucgagcaggucaagaaguccuuccagagcacgugcaacggcaccgagaacaaggugcagggguacuacaucugcaucgugggcgggaacagcgcccccaucuacgugcccacccucgacgacuuccgguccauggaggccuucagcggcaucuuccgcagcccccacggcgaggaccacgaccuggccggggaggagaucgcgagcuacuccaucgucggcccggccaacgccaaggugccccacagcgccuccagcgacacccugucccucaucgccuacagcgggauccccuccuacagcucccugagcauccuggcguccagcaccgaggccaagcacguguucucccccggcuucuucccgcagcucaaccacacgaagugcgacaagaccgccaucccccugaccuggaccggcaugaucgaccugcccggguacuacgaggccauccaccccugcacggucuucugcgugcucagcggcccgggggccuccugcgaggcguucagcgagggcgggaucuucaacaucaccagccccaugugccugguguccaagcagaaccgguuccgccugaccgagcagcaggucaacuucgugugccagcggguggacauggacaucaucgucuacugcaacggccagcgcaaggugauccucaccaagacgcuggugaucggccagugcaucuacaccaucaccagccuguucucccuccugcccggggucgcccacagcaucgccguggagcugugcgugcccggcuuccacgggugggccaccgccgcgcuccuggucacguucugcuucggcugggugcugaucccggcccucacccugaucauccugaccauccucaaguucaucgccaacaucuuccacaccuccaaccaggagaaccggcugaaguccgugcugcgcaagaucaaggaggaguucgagaagacgaagggguccauggucugcgacgugugcaaguacgagugcgagaccuacaaggagcucaaggcccacggcgugagcugcccccagucccagugccccuacugcuucacccacugcgagcccaccgaggcggccuuccaggcccacuaccgggucugccaggugacgcaccgcuuccgggacgaccugaagaagaccgugaccccgcagaacuucacccccggcugcuaccgcacccugaaccucuuccgguacaagagccgcugcuacaucuucacgaugugggucugccugcuggugcucgaguccauccugugggccgccagcgcguccgaggugccccugaacccggucuggaacgacaacgcccacggggugggcagcgugcccaugcacaccgaccucgagcuggacuucucccugaccagcuccagcaaguacaccuaccggcgccgccugacgaacccccucgaggagacccagagcaucaaccugcacaucgagaucgaggagcagaccaucggggucgacgugcacgcccugggccacugguucgacgggcggcucaaccugaagaccuccuuccacugcuacggcgccugcacgaaguacgaguaccccuggcacaccgccaagugccacuacgagcgcgacuaccaguacgagaccagcuggggcugcaacccggcggacugccccggggugggcaccgggugcacggccugcggccuguaccucgaccagcugaagcccgucggcuccgccuacaagaucaucaccauccgguacagccgcaaggugugcgugcaguucggggaggagaaccugugcaaggucaucgacaugaacgacugcuucgugacccggcacgugaaggucugcaucaucggcaccguguccaaguucagccagggggacacgcuccuguucuucggcccccuggagggcgggggccucaucuucaagcacuggugcaccuccacgugccaguucggggacccgggcgacaucaugagcccccgcgacaagggguuccugugccccgaguuccccggcuccuuccggaagaagugcaacuucgccaccaccccgcugugcgaguacgacgggaacauggugagcggcuacaagaaggucauggccaccaucgacuccuuccagagcuucaacaccuccaccaugcacuucacggacgagcgcaucgaguggaaggaccccgacggcaugcuccgggaccacaucaacauccuggugaccaaggacaucgacuucgacaaccugggggagaaccccugcaagaucggccuccagaccagcuccaucgagggggcguggggcagcggggugggcuucacccugacgugccugaucucccucaccgagugccccaccuuccugaccagcaucaaggccugcgacaaggccaucugcuacggcgccgaguccgucacgcugacccgcgggcagaacaccgugaaggugagcggcaagggcgggcacagcggguccaccuucaagugcugccacggcgagaagugcagccagaucggccuccacgcggccgccccgcaccuggacaaggucaacgggaucuccgagaucgagaacaacaagguguacgacgacggcgcgccccagugcggggugaagugcugguucgucaagagcggcgaguggaucuccggcaucuucagcgggaacuggaucgugcugaucguccucugcguguuccugcuguucucccucgugcugcugagcguccucugccccgugcggaagcacaagaaguccuga

SEQ ID NO: 11706 - RNA, 3408 nt, Artificial Sequence
  derived and/or modified CDS sequence (opt1) from HTNV(LongquanAa-09-489)__JQ912844.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugccccggaugccccucgcggacacggcccagauggugcccgaguccagcugcaacauggacaaccaccaguccaugaacaccaucaccaaguacacccaggucagcuggcgcggcaaggccgaccaggcccaggccucccagaacagcuucgaggcgguguccgccgagguggaccugaaggggacgugcguccugaagcacaagaugcucgaggagagcuaccggucccgcaagagcaucaccugcuacgaccuguccugcaacagcaccuacugcaagccgacccuguacaugaucgugcccauccacgccugcaacaugaugaaguccugccucaucgcccugggccccuaccgggugcaggucguguacgagcgcacguacugcaugaccggggugcugaucgagggcaagugcuucguccccgaccagagcgugguguccaucaucaagcacggcaucuucgacaucgcgagcguccacaucgugugcuucuucguggccgucaaggggaacaccuacaagcucuucgagcaggugaagaaguccuuccagagcaccugcaacggcacggagaacaaggugcagggguacuacaucugcaucgucggcgggaacagcgccccgaucuacgugcccacccuggacgacuuccgguccauggaggccuucagcggcaucuuccgcuccccccacggcgaggaccacgaccuggccggggaggagaucgcgagcuacuccaucgucggccccgccaacgccaaggugccgcacagcgccuccagcgacacccucucccugaucgccuacagcgggauccccuccuacagcucccugagcauccucgcguccagcaccgaggccaagcacguguucucccccggcuucuucccccagcugaaccacacgaagugcgacaagaccgccaucccgcugaccuggaccggcaugaucgaccuccccggguacuacgaggccauccaccccugcacggucuucugcgugcugagcggccccggggccuccugcgaggcguucagcgagggcgggaucuucaacaucaccagcccgaugugccugguguccaagcagaaccgguuccgccucaccgagcagcaggucaacuucgugugccagcggguggacauggacaucaucgucuacugcaacggccagcgcaaggugauccugaccaagacgcuggugaucggccagugcaucuacaccaucaccagccucuucucccugcugcccggggucgcccacagcaucgccguggagcucugcgugcccggcuuccacgggugggccaccgccgcgcugcuggucacguucugcuucggcugggugcucauccccgcccugacccugaucauccucaccauccugaaguucaucgccaacaucuuccacaccuccaaccaggagaaccggcugaagagcgugcuccgcaagaucaaggaggaguucgagaagacgaagggguccauggucugcgacgugugcaaguacgagugcgagaccuacaaggagcugaaggcccacggcgugagcugcccgcagucccagugccccuacugcuucacccacugcgagcccaccgaggcggccuuccaggcccacuaccgggucugccaggugacgcaccgcuuccgggacgaccugaagaagaccgugaccccccagaacuucaccccgggcugcuaccgcacccucaaccuguuccgguacaagagccgcugcuacaucuucacgaugugggucugccugcucgugcuggaguccauccugugggccgccagcgcguccgaggugccccucaaccccgucuggaacgacaacgcccacggggugggcagcgugccgaugcacaccgaccugcagcuggacuucucccugaccagcuccagcaaguacaccuaccggcgccgccucacgaacccccuggaggagacccagagcaucaaccugcacaucgagaucgaggagcagaccaucggggucgacgugcacgcccucggccacugguucgacgggcggcugaaccugaagaccuccuuccacugcuacggcgccugcacgaaguacgaguaccccuggcacaccgccaagugccacuacgagcgcgacuaccaguacgagaccagcuggggcugcaaccccgcggacugcccgggggugggcaccgggugcacggccugcggccucuaccuggaccagcugaagcccgucggcuccgccuacaagaucaucaccauccgguacagccgcaaggugugcgugcaguucggggaggagaaccucugcaaggucaucgacaugaacgacugcuucgugacccggcacgugaaggucugcaucaucggcaccguguccaaguucagccagggggacacgcugcuguucuucggcccccucgaggggggcggccugaucuucaagcacuggugcaccuccaccugccaguucggggaccccggcgacaucaugagcccgcgcgacaagggguuccugugccccgaguuccccggcuccuuccggaagaagugcaacuucgccaccacgccccucugcgaguacgacgggaacauggugagcggcuacaagaaggucauggccaccaucgacuccuuccagagcuucaacaccuccaccaugcacuucacggacgagcgcaucgaguggaaggacccggacggcaugcugcgggaccacaucaacauccuggugaccaaggacaucgacuucgacaaccucggggagaaccccugcaagaucggccugcagaccagcuccaucgagggggcguggggcagcggggugggcuucacccugacgugccucaucucccugaccgagugccccaccuuccugaccagcaucaaggccugcgacaaggccaucugcuacggcgccgaguccgucacgcucacccgcgggcagaacaccgugaaggugagcggcaaggggggccacagcggguccaccuucaagugcugccacggcgaggagugcagccagaucggccugcacgcggccgccccccaccuggacaaggucaacgggaucuccgagaucgagaacaacaagguguacgacgacggcgccccgcagugcggggugaagugcugguucgucaagagcggcgaguggaucuccggcaucuucagcgggaacuggaucgugcucaucguccugugcguguuccugcucuucucccuggugcugcucagcguccugugccccgugcggaagcacaagaaguccuga

SEQ ID NO: 11707 - RNA, 3408 nt, Artificial Sequence
  derived and/or modified CDS sequence (opt1) from HTNV(LongquanAa-09-541)__JQ912850.1__GP
augggcaucuggaaguggcuggugauggccagccucgucuggcccgccuucacccugcgcaacguguacgacaugaagaucgagugcccgcacaccguguccuucggggagaacagcgucaucggcuacguggagcugccgcccaugccccucgccgacacggcccagauggugcccgaguccagcugcaacauggacaaccaccaguccaugaacaccaucaccaaguacacccaggucagcuggcgggggaaggccgaccaggcccaggccucccagaacagcuucgaggcgguguccgccgagguggaccugaagggcaucugcguccugaagcacaagaugcucgaggagagcuaccgcucccgcaagagcaucacgugcuacgaccuguccugcaacagcaccuacugcaagcccacccuguacaugaucgugcccauccacgccugcaacaugaugaaguccugccucaucgcccuggggcccuaccgggugcaggucguguacgagcggaccuacugcaugacgggcgugcugcucgagggcaagugcuucgucccggaccagagcgugguguccaucaucaagcacgggaucuucgacaucgcgagcguccacaucgugugcuucuucguggccgucaagggcaacaccuacaagcuguucgagcaggucaagaaguccuuccagagcacgugcaacgggaccgagaacaaggugcagggcuacuacaucugcaucgucgggggcaacagcgcccccaucuacgugcccacccuggacgacuuccgcuccauggaggccuucagcggcaucuuccggagcccccacggggaggaccacgaccucgccggcgaggagaucgcguccuacuccaucguggggccggccaacgccaaggugccccacagcgccuccagcgacacccugucccugaucgccuacagcggcauccccuccuacagcucccucagcauccuggcguccagcaccgaggccaagcacguguucucccccggcuucuucccgcagcugaaccacaccaagugcgacaagacggccaucccccucaccuggaccgggaugaucgaccugcccggcuacuacgaggccauccaccccugcaccgucuucugcgugcugagcgggccgggcgccuccugcgaggcguucagcgagggcgggaucuucaacaucacgagccccaugugccucguguccaagcagaaccgcuuccggcugaccgagcagcaggucaacuucgugugccagcgcguggacauggacaucaucgucuacugcaacggccagcggaaggugauccugaccaagacccucgugaucgggcagugcaucuacacgaucaccagccuguucucccugcuccccggcgucgcccacagcaucgccguggagcugugcgugcccggguuccacggcugggccaccgccgcgcugcucgucaccuucugcuucgggugggugcugaucccggcccugacgcucaucauccugaccauccugaaguucaucgccaacaucuuccacaccuccaaccaggagaaccgccucaagagcgugcugcggaagaucaaggaggaguucgagaagaccaagggcuccauggucugcgacgugugcaaguacgagugcgagacguacaaggagcugaaggcccacggcgugagcugcccccagucccagugccccuacugcuucacccacugcgagcccaccgaggcggccuuccaggcccacuaccgcgucugccaggugacccaccgguuccgcgacgaccucaagaagacggugaccccgcagaacuucacccccgggugcuaccggacccugaaccuguuccgcuacaagagccggugcuacaucuucaccaugugggucugccuccuggugcuggaguccauccucugggccgccagcgcguccgaggugccccugaacccggucuggaacgacaacgcccacggcguggggagcgugcccaugcacacggaccuggagcuggacuucucccucaccagcuccagcaaguacaccuaccgccggcgccugaccaacccccuggaggagacgcagagcaucaaccuccacaucgagaucgaggagcagaccaucggcgucgacgugcacgcccuggggcacugguucgacggccgccugaaccucaagaccuccuuccacugcuacggcgccugcaccaaguacgaguaccccuggcacacggccaagugccacuacgagcgggacuaccaguacgagaccagcugggggugcaacccggcggacugccccggcguggggaccggcugcaccgccugcggccuguaccuggaccagcucaagcccgucggguccgccuacaagaucaucacgauccgcuacagccggaaggugugcgugcaguucggcgaggagaaccugugcaaggucaucgacaugaacgacugcuucgugacccgccacgugaaggucugcaucaucgggaccguguccaaguucagccagggcgacacccuccucuucuucgggccccuggagggcggcgggcugaucuucaagcacuggugcacguccacgugccaguucggcgacccgggggacaucaugagcccccgggacaagggcuuccucugccccgaguuccccggguccuuccgcaagaagugcaacuucgccaccaccccgcugugcgaguacgacggcaacauggugagcggcuacaagaaggucauggccaccaucgacuccuuccagagcuucaacaccuccaccaugcacuucaccgacgagcggaucgaguggaaggaccccgacgggaugcugcgcgaccacaucaacauccucgugacgaaggacaucgacuucgacaaccugggcgagaaccccugcaagaucgggcugcagaccagcuccaucgagggcgcgugggggagcggcgugggcuucacccugaccugccugaucucccugacggagugccccaccuuccucaccagcaucaaggccugcgacaaggccaucugcuacggggccgaguccgucacccugacgcggggccagaacaccgugaaggugagcgggaagggcgggcacagcggcuccaccuucaagugcugccacggcgaggagugcagccagaucgggcugcacgcggccgccccgcaccucgacaaggucaacggcaucuccgagaucgagaacaacaagguguacgacgacggggcgccccagugcggcgugaagugcugguucgucaagagcggcgaguggaucuccgggaucuucagcggcaacuggaucgugcugaucguccugugcguguuccuccuguucucccuggugcuccugagcguccugugccccgugcgcaagcacaagaaguccuga

SEQ ID NO: 11708 - RNA, 3408 nt, Artificial Sequence
  derived and/or modified CDS sequence (opt1) from HTNV(LongquanAa-09-698)__JQ912854.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugccgcccaugccccucgccgacacggcccagauggugcccgaguccagcugcaacauggacaaccaccaguccaugaacaccaucaccaaguacacccaggucagcuggcggggcaaggccgaccaggcccaggccucccagaacagcuucgaggcgguguccgccgagguggaccugaaggggacgugcauccugaagcacaagaugcucgaggagagcuaccgcucccgcaagagcaucacgugcuacgaccuguccugcaacagcaccuacugcaagcccacccuguacaugaucguccccauccacgccugcaacaugaugaaguccugccucaucgcccugggccccuaccgcguccagguggucuacgagcggacguacugcaugaccggggugcugaucgagggcaagugcuucgugccggaccagagcgucguguccaucaucaagcacggcaucuucgacaucgcgagcgugcacaucgucugcuucuucguggccgugaaggggaacaccuacaagcuguucgagcaggucaagaaguccuuccaguccacgugcaacggcaccgagaacaaggugcagggguacuacaucugcaucgugggcgggaacagcgcccccaucuacguccccacccuggacgacuuccgcuccauggaggccuucagcggcaucuuccggagcccccacggcgaggaccacgaccuggccggggaggagaucgcguccuacuccaucgugggcccggccaacgccaaggucccccacagcgccuccagcgacacccucucccugaucgccuacagcgggauccccuccuacagcucccugagcauccucgcguccagcaccgaggccaagcacguguucucccccggcuucuucccgcagcugaaccacacgaagugcgacaagaccgccaucccccugaccuggaccggcaugaucgaccuccccggguacuacgaggccauccaccccugcacgguguucugcgugcucagcggcccgggggccagcugcgaggcguucagcgagggcgggaucuucaacaucaccagccccaugugccugguguccaagcagaaccgguuccggcucaccgagcagcaggucaacuucgugugccagcgcguggacauggacaucaucguguacugcaacggccagcggaaggucauccugaccaagacccuggugaucggccagugcaucuacaccaucaccagccucuucucccugcugcccgggguggcccacagcaucgccgucgagcucugcgugcccggcuuccacgggugggccaccgccgcgcugcuggugacguucugcuucggcuggguccucaucccggcccugacccugaucauccucaccauccugaaguucaucgccaacaucuuccacaccuccaaccaggagaaccgccugaaguccgugcuccggaagaucaaggaggaguucgagaagacgaaggggagcauggugugcgacgucugcaaguacgagugcgagaccuacaaggagcugaaggcccacggcgugagcugcccccagucccagugccccuacugcuucacccacugcgagcccaccgaggcggccuuccaggcccacuaccgcgugugccaggucacgcaccgguuccgcgacgaccugaagaagaccgugaccccgcagaacuucacccccggcugcuaccggacccucaaccuguuccgcuacaagagccggugcuacaucuucacgaugugggugugccugcucguccuggaguccauccugugggccgccagcgcguccgaggugccccucaacccgguguggaacgacaacgcccacggggucggcagcgugcccaugcacaccgaccuggagcuggacuucucccugaccagcuccagcaaguacaccuaccgccggcgccucacgaacccccuggaggagacccagagcaucaaccugcacaucgagaucgaggagcagaccaucgggguggacguccacgcccucggccacugguucgacgggcgccugaaccugaagaccuccuuccacugcuacggcgccugcacgaaguacgaguaccccuggcacaccgccaagugccacuacgagcgggacuaccaguacgagaccagcuggggcugcaacccggcggacugccccggggugggcaccgggugcacggccugcggccucuaccuggaccagcugaagcccgugggcuccgccuacaagaucaucaccauccgcuacagccggaaggucugcgugcaguucggggaggagaaccucugcaaggugaucgacaugaacgacugcuucgucacccgccacgugaaggugugcaucaucggcaccgucuccaaguucagccagggggacacgcugcuguucuucggcccccucgagggcgggggccugaucuucaagcacuggugcaccuccacgugccaguucggggacccgggcgacaucaugagcccccgggacaagggguuccugugccccgaguuccccggcuccuuccgcaagaagugcaacuucgccaccaccccgcucugcgaguacgacgggaacauggugagcggcuacaagaaggugauggccaccaucgacuccuuccagagcuucaacaccuccaccaugcacuucacggacgagcggaucgaguggaaggaccccgacggcaugcugcgcgaccacaucaacauccuggucaccaaggacaucgacuucgacaaccucggggagaaccccugcaagaucggccugcagaccagcuccaucgagggggcguggggcagcggggugggcuucacccugacgugccucaucucccugaccgagugccccaccuuccugaccagcaucaaggccugcgacaaggccaucugcuacggcgccgaguccgugacgcucacccgggggcagaacaccgucaaggugagcggcaagggcgggcacagcggguccaccuucaagugcugccacggcgaggagugcagccagaucggccugcacgcggccgccccgcaccuggacaaggugaacgggaucuccgagaucgagaacaacaaggucuacgacgacggcgcgccccagugcggggugaagugcugguucgucaagagcggcgaguggaucuccggcaucuucagcgggaacuggaucgugcucaucgugcugugcgucuuccugcuguucucccucgugcugcucagcgugcugugccccguccgcaagcacaagaaguccuga

SEQ ID NO: 11709 - RNA, 3408 nt, Artificial Sequence
  derived and/or modified CDS sequence (opt1) from HTNV(LongquanAa-10-393)__JQ912859.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugccgcccaugccccucgccgacacggcccagauggugcccgaguccagcugcaacauggacaaccaccaguccaugaacaccaucaccaaguacacccaggucagcuggcggggcaaggccgaccaggcccaggccucccagaacagcuucgaggcgguguccgccgagguggaccugaaggggacgugcguccugaagcacaagaugcucgaggagagcuaccgcucccggaaguccaucacgugcuacgaccuguccugcaacagcaccuacugcaagcccacccuguacaugaucgugcccauccacgccugcaacaugaugaaguccugccucaucgcccugggccccuaccgcgugcaggucguguacgagcggaccuacugcaugaccggggugcugaucgagggcaagugcuucgucccggaccagagcgugguguccaucaucaagcacggcaucuucgacaucgcgagcguccacaucgugugcuucuucguggccgucaaggggaacaccuacaagcuguucgagcaggucaagaaguccuuccagagcacgugcaacggcaccgagaacaaggugcagggguacuacaucugcaucgugggcgggaacagcgcccccaucuacgugcccacccuggacgacuuccgcuccauggaggccuucagcggcaucuuccggagcccccacggcgaggaccacgaccuggccggggaggagaucgcgagcuacuccaucgucggcccggccaacgccaaggugccccacagcgccuccagcgacacccucucccugaucgccuacagcgggauccccuccuacagcucccugagcauccucgcguccagcaccgaggccaagcacguguucucccccggcuucuucccgcagcugaaccacacgaagugcgacaagaccgccaucccccugaccuggaccggcaugaucgaccuccccggguacuacgaggccauccaccccugcacggucuucugcgugcugagcggcccgggggccuccugcgaggcguucagcgagggcgggaucuucaacaucaccagccccaugugccugguguccaagcagaaccgcuuccggcucaccgagcagcaggucaacuucgugugccagcgcguggacauggacaucaucgucuacugcaacggccagcggaaggugauccugaccaagacgcuggugaucggccagugcaucuacaccaucaccagccucuucucccugcugcccggggucgcccacagcaucgccguggagcucugcgugcccggcuuccacgggugggccaccgccgcgcugcuggucacguucugcuucggccgcgugcucaucccggcccugacccugaucauccucaccauccugaaguucaucgccaacaucuuccacaccuccaaccaggagaaccggcucaagagcgugcuccgcaagaucaaggaggaguucgagaagacgaagggguccauggucugcgacgugugcaaguacgagugcgagaccuacaaggagcugaaggcccacggcgugagcugcccccagucccagugccccuacugcuucacccacugcgagcccaccgaggcggccuuccaggcccacuaccgggucugccaggugacgcaccgcuuccgggacgaccugaagaagaccgugaccccgcagaacuucacccccggcugcuaccgcacccucaaccuguuccgguacaagagccgcugcuacaucuucacgaugugggucugccugcucgugcuggaguccauccugugggccgccagcgcguccgaggugccccucaacccggucuggaacgacaacgcccacggggugggcagcgugcccaugcacaccgaccuggagcuggacuucucccugaccagcuccagcaaguacaccuaccggcgccgccucacgaacccccuggaggagacccagagcaucaaccugcacaucgagaucgaggagcagaccaucggggucgacgugcacgcccucggccacugguucgacgggcggcugaaccugaagaccuccuuccacugcuacggcgccugcacgaaguacgaguaccccuggcacaccgccaagugccacuacgagcgcgacuaccaguacgagaccagcuggggcugcaacccggcggacugccccggggugggcaccgggugcacggccugcggccucuaccuggaccagcugaagcccgucggcuccgccuacaagaucaucaccauccgguacagccgcaaggugugcgugcaguucggggaggagaaccucugcaaggucaucgacaugaacgacugcuucgugacccggcacgugaaggucugcaucaucggcaccguguccaaguucagccagggggacacgcugcuguucuucggcccccucgagggcgggggccugaucuucaagcacuggugcaccuccacgugccaguucggggacccgggcgacaucaugagcccccgcgacaagggguuccugugccccgaguuccccggcuccuuccggaagaagugcaacuucgccaccaccccgcucugcgaguacgacgggaacauggugagcggcuacaagaaggucauggccaccaucgacuccuuccagagcuucaacaccuccaccaugcacuucacggacgagcgcaucgaguggaaggaccccgacggcaugcugcgggaccacaucaacauccuggugaccaaggacaucgacuucgacaaccucggggagaaccccugcaagaucggccugcagaccagcuccaucgagggggcguggggcagcggggugggcuucacccugacgugccucaucucccugaccgagugccccaccuuccugaccagcaucaaggccugcgacaaggccaucugcuacggcgccgaguccgucacgcucacccgcgggcagaacaccgugaaggugagcggcaagggcgggcacagcggguccaccuucaagugcugccacggcgaggagugcagccagaucggccugcacgcggccgccccgcaccuggacaaggucaacgggaucuccgagaucgagaacaacaagguguacgacgacggcgcgccccagugcggggugaagugcugguucgucaagagcggcgaguggaucuccggcaucuucagcgggaacuggaucgugcucaucguccugugcguguuccuccuguucucccuggugcugcucagcguccugugccccgugcggaagcacaagaaguccuga

SEQ ID NO: 11710 - RNA, 3408 nt, Artificial Sequence
  derived and/or modified CDS sequence (opt1) from HTNV(LongquanAa-10-58)__JQ912861.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugccgcccaugccccucgccgacacggcccagauggugcccgaguccagcugcaacauggacaaccaccaguccaugaacaccaucaccaaguacacccaggucagcuggcggggcaaggccgaccaggcccaggccucccagaacagcuucgaggcgguguccgccgagguggaccugaaggggacgugcguccugaagcacaagaugcucgaggagagcuaccgcucccggaaguccaucacgugcuacgaccuguccugcaacagcaccuacugcaagcccacccuguacaugaucgugcccauccacgccugcaacaugaugaaguccugccucaucgcccugggccccuaccgcgugcaggucguguacgagcggaccuacugcaugaccggggugcugaucgagggcaagugcuucgucccggaccagagcgugguguccaucaucaagcacggcaucuucgacaucgcgagcguccacaucgugugcuucuucguggccgucaaggggaacaccuacaagcuguucgagcaggucaagaaguccuuccagagcacgugcaacggcaccgagaacaaggugcagggguacuacaucugcaucgugggcgggaacagcgcccccaucuacgugcccacccuggacgacuuccgcuccauggaggccuucagcggcaucuuccggagcccccacggcgaggaccacgaccuggccggggaggagaucgcgagcuacuccaucgucggcccggccaacgccaaggugccccacagcgccuccagcgacacccucucccugaucgccuacagcgggauccccuccuacagcucccugagcauccucgcguccagcaccgaggccaagcacguguucucccccggcuucuucccgcagcugaaccacacgaagugcgacaagaccgccaucccccugaccuggaccggcaugaucgaccuccccggguacuacgaggccauccaccccugcacggucuucugcgugcugagcggcccgggggccuccugcgaggcguucagcgagggcgggaucuucaacaucaccagccccaugugccugguguccaagcagaaccgcuuccggcucaccgagcagcaggucaacuucgugugccagcgcguggacauggacaucaucgucuacugcaacggccagcggaaggugauccugaccaagacgcuggugaucggccagugcaucuacaccaucaccagccucuucucccugcugcccggggucgcccacagcaucgccguggagcucugcgugcccggcuuccacgggugggccaccgccgcgcugcuggucacguucugcuucggcugggugcucaucccggcccugacccugaucauccucaccauccugaaguucaucgccaacaucuuccacaccuccaaccaggagaaccgccucaagagcgugcuccggaagaucaaggaggaguucgagaagacgaagggguccauggucugcgacgugugcaaguacgagugcgagaccuacaaggagcugaaggcccacggcgugagcugcccccagucccagugccccuacugcuucacccacugcgagcccaccgaggcggccuuccaggcccacuaccgcgucugccaggugacgcaccgguuccgcgacgaccugaagaagaccgugaccccgcagaacuucacccccggcugcuaccggacccucaaccuguuccgcuacaagagccggugcuacaucuucacgaugugggucugccugcucgugcuggaguccauccugugggccgccagcgcguccgaggugccccucaacccggucuggaacgacaacgcccacggggugggcagcgugcccaugcacaccgaccuggagcuggacuucucccugaccagcuccagcaaguacaccuaccgccggcgccucacgaacccccuggaggagacccagagcaucaaccugcacaucgagaucgaggagcagaccaucggggucgacgugcacgcccucggccacugguucgacgggcgccugaaccugaagaccuccuuccacugcuacggcgccugcacgaaguacgaguaccccuggcacaccgccaagugccacuacgagcgggacuaccaguacgagaccagcuggggcugcaacccggcggacugccccggggugggcaccgggugcacggccugcggccucuaccuggaccagcugaagcccgucggcuccgccuacaagaucaucaccauccgcuacagccggaaggugugcgugcaguucggggaggagaaccucugcaaggucaucgacaugaacgacugcuucgugacccgccacgugaaggucugcaucaucggcaccguguccaaguucagccagggggacacgcugcuguucuucggcccccucgagggcgggggccugaucuucaagcacuggugcaccuccacgugccaguucggggacccgggcgacaucaugagcccccgggacaagggguuccugugccccgaguuccccggcuccuuccgcaagaagugcaacuucgccaccaccccgcucugcgaguacgacgggaacauggugagcggcuacaagaaggucauggccaccaucgacuccuuccagagcuucaacaccuccaccaugcacuucacggacgagcggaucgaguggaaggaccccgacggcaugcugcgcgaccacaucaacauccuggugaccaaggacaucgacuucgacaaccucggggagaaccccugcaagaucggccugcagaccagcuccaucgagggggcguggggcagcggggugggcuucacccugacgugccucaucucccugaccgagugccccaccuuccugaccagcaucaaggccugcgacaaggccaucugcuacggcgccgaguccgucacgcucacccgggggcagaacaccgugaaggugagcggcaagggcgggcacagcggguccaccuucaagugcugccacggcgaggagugcagccagaucggccugcacgcggccgccccgcaccuggacaaggucaacgggaucuccgagaucgagaacaacaagguguacgacgacggcgcgccccagugcggggugaagugcugguucgucaagagcggcgaguggaucuccggcaucuucagcgggaacuggaucgugcucaucguccugugccuguuccuccuguucucccuggugcuccugagcgugcugugccccguccgcaagcacaagaaguccuga

SEQ ID NO: 11711 - RNA, 3408 nt, Artificial Sequence
  derived and/or modified CDS sequence (opt1) from HTNV(LongquanAa-10-74)__JQ912864.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugccgcccaugccccucgccgacacggcccagauggugcccgaguccagcugcaacauggacaaccaccaguccaugaacaccaucaccaaguacacccaggucagcuggcggggcaaggccgaccaggcccaggccucccagaacagcuucgaggcgguguccgccgagguggaccugaaggggacgugcguccugaagcacaagaugcucgaggagagcuaccgcucccggaaguccaucacgugcuacgaccuguccugcaacagcaccuacugcaagcccacccuguacaugaucgugcccauccacgccugcaacaugaugaaguccugccucaucgcccugggccccuaccgcgugcaggucguguacgagcggaccuacugcaugaccggggugcugaucgagggcaagugcuucgucccggaccagagcgugguguccaucaucaagcacggcaucuucgacaucgcgagcguccacaucgugugcuucuucguggccgucaaggggaacaccuacaagcuguucgagcaggucaagaaguccuuccagagcacgugcaacggcaccgagaacaaggugcagggguacuacaucugcaucgugggcgggaacagcgcccccaucuacgugcccacccuggacgacuuccgcuccauggaggccuucagcggcaucuuccggagcccccacggcgaggaccacgaccuggccggggaggagaucgcgagcuacuccaucgucggcccggccaacgccaaggugccccacagcgccuccagcgacacccucucccugaucgccuacagcgggauccccuccuacagcucccugagcauccucgcguccagcaccgaggccaagcacguguucucccccggcuucuucccgcagcugaaccacacgaagugcgacaagaccgccaucccccugaccuggaccggcaugaucgaccuccccggguacuacgaggccauccaccccugcacggucuucugcgugcugagcggcccgggggccuccugcgaggcguucagcgagggcgggaucuucaacaucaccagccccaugugccugguguccaagcagaaccgcuuccggcucaccgagcagcaggucaacuucgugugccagcgcguggacauggacaucaucgucuacugcaacggccagcggaaggugauccugaccaagacgcuggugaucggccagugcaucuacaccaucaccagccucuucucccugcugcccggggucgcccacagcaucgccguggagcucugcgugcccggcuuccacgggugggccaccgccgcgcugcuggucacguucugcuucggcugggugcucaucccggcccugacccugaucauccucaccauccugaaguucaucgccaacaucuuccacaccuccaaccaggagaaccgccucaagagcgugcuccggaagaucaaggaggaguucgagaagacgaagggguccauggucugcgacgugugcaaguacgagugcgagaccuacaaggagcugaaggcccacggcgugagcugcccccagucccagugccccuacugcuucacccacugcgagcccaccgaggcggccuuccaggcccacuaccgcgucugccaggugacgcaccgguuccgcgacgaccugaagaagaccgugaccccgcagaacuucacccccggcugcuaccggacccucaaccuguuccgcuacaagagccggugcuacaucuucacgaugugggucugccugcucgugcuggaguccauccugugggccgccagcgcguccgaggugccccucaacccggucuggaacgacaacgcccacggggugggcagcgugcccaugcacaccgaccuggagcuggacuucucccugaccagcuccagcaaguacaccuaccgccggcgccucacgaacccccuggaggagacccagagcaucaaccugcacaucgagaucgaggagcagaccaucggggucgacgugcacgcccucggccacugguucgacgggcgccugaaccugaagaccuccuuccacugcuacggcgccugcacgaaguacgaguaccccuggcacaccgccaagugccacuacgagcgggacuaccaguacgagaccagcuggggcugcaacccggcggacugccccggggugggcaccgggugcacggccugcggccucuaccuggaccagcugaagcccgucggcuccgccuacaagaucaucaccauccgcuacagccggaaggugugcgugcaguucggggaggagaaccucugcaaggucaucgacaugaacgacugcuucgugacccgccacgugaaggucugcaucaucggcaccguguccaaguucagccagggggacacgcugcuguucuucggcccccucgagggcgggggccugaucuucaagcacuggugcaccuccacgugccaguucggggacccgggcgacaucaugagcccccgggacaagggguuccugugccccgaguuccccggcuccuuccgcaagaagugcaacuucgccaccaccccgcucugcgaguacgacgggaacauggugagcggcuacaagaaggucauggccaccaucgacuccuuccagagcuucaacaccuccaccaugcacuucacggacgagcggaucgaguggaaggaccccgacggcaugcugcgcgaccacaucaacauccuggugaccaaggacaucgacuucgacaaccucggggagaaccccugcaagaucggccugcagaccagcuccaucgagggggcguggggcagcggggugggcuucacccugacgugccucaucucccugaccgagugccccaccuuccugaccagcaucaaggccugcgacaaggccaucugcuacggcgccgaguccgucacgcucacccgggggcagaacaccgugaaggugagcggcaagggcgggcacagcggguccaccuucgagugcugccacggcgaggagugcagccagaucggccugcacgcggccgccccgcaccuggacaaggucaacgggaucuccgagaucgagaacaacaagguguacgacgacggcgcgccccagugcggggugaagugcugguucgucaagagcggcgaguggaucuccggcaucuucagcgggaacuggaucgugcucaucguccugugcguguuccuccuguucucccuggugcugcucagcguccugugccccgugcgcaagcacaagaaguccuga

SEQ ID NO: 11712 - RNA, 3408 nt, Artificial Sequence
  derived and/or modified CDS sequence (opt1) from HTNV(LongquanAa-10-98)__JQ912866.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugccgcccaugccccucgccgacacggcccagauggugcccgaguccagcugcaacauggacaaccaccaguccaugaacaccaucaccaaguacacccaggucagcuggcggggcaaggccgaccaggcccaggccucccagaacagcuucgaggcgguguccgccgagguggaccugaaggggacgugcguccugaagcacaagaugcucgaggagagcuaccgcucccgcaagagcaucacgugcuacgaccuguccugcaacagcaccuacugcaagcccacccuguacaugaucgugcccauccacgccugcaacaugaugaaguccugccucaucgcccugggccccuaccgggugcaggucguguacgagcggaccuacugcaugaccggggugcugaucgagggcaagugcuucgucccggaccagagcgugguguccaucaucaagcacggcaucuucgacaucgcgagcguccacaucgugugcuucuucguggccgucaaggggaacaccuacaagcuccuggagcaggucaagaaguccuuccagagcacgugcaacgacaccgagaacaaggugcagggcuacuacaucugcaucgucgggggcaacagcgcccccaucuacgugcccacccuggacgacuuccgcuccauggaggccuucagcgggaucuuccggagcccccacggcgaggaccacgaccucgccggcgaggagaucgcguccuacuccaucguggggccggccaacgccaaggugccccacagcgccuccagcgacacccugucccugaucgccuacagcggcauccccuccuacagcucccucagcauccuggcguccagcaccgaggccaagcacguguucucccccggguucuucccgcagcugaaccacacgaagugcgacaagaccgccaucccccucaccuggaccggcaugaucgaccugcccggcuacuacgaggccauccaccccugcacggucuucugcgugcugagcgggccgggcgccuccugcgaggcguucagcgagggcgggaucuucaacaucaccagccccaugugccucguguccaagcagaaccgcuuccggcugaccgagcagcaggucaacuucgugugccagcgcguggacauggacaucaucgucuacugcaacgggcagcggaaggugauccugaccaagacgcucgugaucggccagugcaucuacaccaucaccagccuguucucccugcuccccggcgucgcccacagcaucgccguggagcugugcgugcccggguuccacggcugggccaccgccgcgcugcucgucacguucugcuucgggugggugcugaucccggcccugacccucaucauccugaccauccugaaguucaucgccaacaucuuccacaccuccaaccaggagaaccgccucaagagcgugcugcggaagaucaaggaggaguucgagaagacgaagggcuccauggucugcgacgugugcaaguacgagugcgagaccuacaaggagcugaaggcccacggggugagcugcccccagucccagugccccuacugcuucacccacugcgagcccaccgaggcggccuuccaggcccacuaccgcgucugccaggugacgcaccgguuccgcgacgaccucaagaagaccgugaccccgcagaacuucacccccggcugcuaccggacccugaaccuguuccgcuacaagagccggugcuacaucuucacgaugugggucugccuccuggugcuggaguccauccucugggccgccagcgcguccgaggugccccugaacccggucuggaacgacaacgcccacggcguggggagcgugcccaugcacaccgaccuggagcuggacuucucccucaccagcuccagcaaguacaccuaccgccggcgccugacgaacccccuggaggagacccagagcaucaaccuccacaucgagaucgaggagcagaccaucggcgucgacgugcacgcccuggggcacugguucgacggccgccugaaccucaagaccuccuuccacugcuacggggccugcacgaaguacgaguaccccuggcacaccgccaagugccacuacgagcgggacuaccaguacgagaccagcuggggcugcaacccggcggacugccccggcguggggaccggcugcacggccugcgggcuguaccuggaccagcucaagcccgucggcuccgccuacaagaucaucaccauccgcuacagccggaaggugugcgugcaguucggcgaggagaaccugugcaaggucaucgacaugaacgacugcuucgugacccgccacgugaaggucugcaucaucgggaccguguccaaguucagccagggcgacacgcuccuguucuucgggccccuggagggcgggggccugaucuucaagcacuggugcaccuccacgugccaguucggcgacccgggggacaucaugagcccccgggacaagggcuuccucugccccgaguuccccggguccuuccgcaagaagugcaacuucgccaccaccccgcugugcgaguacgacggcaacauggugagcggguacaagaaggucauggccaccaucgacuccuuccagagcuucaacaccuccaccaugcacuucacggacgagcggaucgaguggaaggaccccgacggcaugcugcgcgaccacaucaacauccucgugaccaaggacaucgacuucgacaaccugggcgagaaccccugcaagaucgggcugcagaccagcuccaucgagggcgcgugggggagcggcgugggguucacccucacgugccugaucucccugaccgagugccccaccuuccucaccagcaucaaggccugcgacaaggccaucugcuacggcgccgaguccgucacgcugacccggggccagaacaccgugaaggugagcgggaagggcgggcacagcggcuccaccuucaagugcugccacggggaggagugcagccagaucggccugcacgcggccgccccgcaccucgacaaggucaacggcaucuccgagaucgagaacaacaagguguacgacgacggggcgccccagugcggcgugaagugcugguucgucaagagcggggaguggaucuccggcaucuucagcggcaacuggaucgugcugaucguccugugcguguuccuccuguucucccuggugcuccugagcguccugugccccgugcgcaagcacaagaaguccuga

SEQ ID NO: 11713 - RNA, 3408 nt, Artificial Sequence
  derived and/or modified CDS sequence (opt1) from HTNV(LongquanAa-11-452)__KC344264.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugccgcccaugccccucgccgacacggcccagauggugcccgaguccagcugcaacauggacaaccaccaguccaucaacaccaucaccaaguacacccaggucagcuggcggggcaaggccgaccaggcccaggccucccagaacagcuucgaggcgguguccgccgagguggaccugaaggggacgugcguccugaagcacaagaugcucgaggagagcuaccgcucccgcaagagcaucacgugcuacgaccuguccugcaacagcaccuacugcaagcccacccuguacaugaucgugcccauccacgccugcaacaugaugaaguccugccucaucgcccugggccccuaccgggugcaggucguguacgagcggaccuacugcaugaccggggugcugaucgagggcaagugcuucgucccggaccagagcgugguguccaucaucaagcacggcaucuucgacaucgcgagcguccacaucgugugcuucuucguggccgucaaggggaacaccuacaagcuccuggagcaggucaagaaguccuuccagagcacgugcaacgacaccgagaacaaggugcagggcuacuacaucugcaucgucgggggcaacagcgcccccaucuacgugcccacccuggacgacuuccgcuccauggaggccuucagcgggaucuuccggagcccccacggcgaggaccacgaccucgccggcgaggagaucgcguccuacuccaucaucgggccggccaacgccaaggugccccacagcgccuccagcgacacccugucccugaucgccuacagcggcauccccuccuacagcucccucagcauccuggcguccagcaccgaggccaagcacguguucucccccggguucuucccgcagcugaaccacacgaagugcgacaagaccgccaucccccucaccuggaccggcaugaucgaccugcccggcuacuacgaggccauccaccccugcacgguguucugcguccugagcgggccgggcgccuccugcgaggcguucagcgagggcgggaucuucaacaucaccagccccaugugccucguguccaagcagaaccgcuuccggcugaccgagcagcaggucaacuucgugugccagcgcguggacauggacaucaucguguacugcaacgggcagcggaaggucauccugaccaagacgcucgugaucggccagugcaucuacaccaucaccagccuguucucccugcuccccggcguggcccacagcaucgccgucgagcugugcgugcccggguuccacggcugggccaccgccgcgcugcucgugacguucugcuucggguggguccugaucccggcccugacccucaucauccugaccauccugaaguucaucgccaacaucuuccacaccuccaaccaggagaaccgccucaagagcgugcugcggaagaucaaggaggaguucgagaagacgaagggcuccauggugugcgacgucugcaaguacgagugcgagaccuacaaggagcugaaggcccacggggugagcugcccccagucccagugccccuacugcuucacccacugcgagcccaccgaggcggccuuccaggcccacuaccgcgugugccaggucacgcaccgguuccgcgacgaccucaagaagaccgugaccccgcagaacuucacccccggcugcuaccggacccugaaccuguuccgcuacaagagccggugcuacaucuucacgaugugggugugccuccugguccuggaguccauccucugggccgccagcgcguccgaggugccccugaacccgguguggaacgacaacgcccacggcgucgggagcgugcccaugcacaccgaccuggagcuggacuucucccucaccagcuccagcaaguacaccuaccgccggcgccugacgaacccccuggaggagacccagagcaucaaccuccacaucgagaucgaggagcagaccaucggcguggacguccacgcccuggggcacugguucgacggccgccugaaccucaagaccuccuuccacugcuacggggccugcacgaaguacgaguaccccuggcacaccgccaagugccacuacgagcgggacuaccaguacgagaccagcuggggcugcaacccggcggacugccccggcguggggaccggcugcacggccugcgggcuguaccuggaccagcucaagcccgugggcuccgccuacaagaucaucaccauccgcuacagccggaaggucugcgugcaguucggcgaggagaaccugugcaaggugaucgacaugaacgacugcuucgucacccgccacgugaaggugugcaucaucgggaccgucuccaaguucagccagggcgacacgcuccuguucuucgggccccuggagggcgggggccugaucuucaagcacuggugcaccuccacgugccaguucggcgacccgggggacaucaugagcccccgggacaagggcuuccucugccccgaguuccccggguccuuccgcaagaagugcaacuucgccaccaccccgcugugcgaguacgacggcaacauggugagcggguacaagaaggugauggccaccaucgacuccuuccagagcuucaacaccuccaccaugcacuucacggacgagcggaucgaguggaaggaccccgacggcaugcugcgcgaccacaucaacauccucgucaccaaggacaucgacuucgacaaccugggcgagaaccccugcaagaucgggcugcagaccagcuccaucgagggcgcgugggggagcggcgugggguucacccucacgugccugaucucccugaccgagugccccaccuuccucaccagcaucaaggccugcgacaaggccaucugcuacggcgccgaguccgugacgcugacccggggccagaacaccgucaaggugagcgggaagggcgggcacagcggcuccaccuucaagugcugccacggggaggagugcagccagaucggccugcacgcggccgccccgcaccucgacaaggugaacggcaucuccgagaucgagaacaacaaggucuacgacgacggggcgccccagugcggcgugaagugcugguucgucaagagcggggaguggaucuccggcaucuucagcggcaacuggaucgugcugaucgugcugugcgucuuccuccuguucucccuggugcuccugagcgugcugugccccguccgcaagcacaagaaguccuga

SEQ ID NO: 11714 - RNA, 3408 nt, Artificial Sequence
  derived and/or modified CDS sequence (opt1) from HTNV(LongquanAa-11-473)__KC344263.1__GP
augggcaucuggaaguggcuggugauggccagccucgucuggcccgccuucacccugcgcaacguguacgacaugaagaucgagugcccgcacaccguguccuucggggagaacagcgucaucggcuacguggagcugccgcccaugccccucgccgacacggcccagauggugcccgaguccagcugcaacauggacaaccaccaguccaugaacaccaucaccaaguacacccaggucagcuggcgggggaaggccgaccaggcccaggccucccagaacagcuucgaggcgguguccgccgagguggaccugaagggcaucugcguccugaagcacaagaugcucgaggagagcuaccgcucccggaaguccaucacgugcuacgaccuguccugcaacagcaccuacugcaagcccacccuguacaugaucgugcccauccacgccugcaacaugaugaaguccugccucaucgcccuggggcccuaccgcgugcaggucguguacgagcggaccuacugcaugacgggcgugcugcucgagggcaagugcuucgucccggaccagagcgugguguccaucaucaagcacgggaucuucgacaucgcgagcguccacaucgugugcuucuucguggccgucaagggcaacaccuacaagcuguucgagcaggucaagaaguccuuccagagcacgugcaacgacaccgagaacaaggugcagggguacuacaucugcaucgugggcgggaacagcgcccccaucuacgugcccacccuggacgacuuccgcuccauggaggccuucagcggcaucuuccggagcccccacggcgaggaccacgaccucgccggggaggagaucgcgagcuacuccaucgucggcccggccaacgccaaggugccccacagcgccuccagcgacacccugucccugaucgccuacagcgggauccccuccuacagcucccucagcauccuggcgaacuccaccgaggccaagcacguguucagccccggcuucuucccgcagcugaaccacaccaagugcgacaagacggccaucccccucaucuggaccggcaugaucgaccugcccggguacuacgaggccauccaccccugcaccgucuucugcgugcuguccggcccgggggccagcugcgaggcguucuccgagggcgggaucuucaacaucaccagccccaugugccucgugagcaagcagaaccgcuuccggcugacggagcagcagaucaacuucgucugccagcgcguggacguggacaucaucgucuacugcaacggccagcggaaggugauccugaccaagacccucgugaucggccagugcaucuacaccaucacgucccuguucagccugcuccccggggucgcccacuccaucgccguggagcugugcgugcccggcuuccacgggugggccaccgccgcgcugcucgucaccuucugcuucggcugggugcugaucccggcccugacccucaucauccugacgauccugaaguucaucgccaacaucuuccacaccagcaaccaggagaaccgccucaaguccgugcugcggaagaucaaggaggaguucgagaagaccaaggggagcauggucugcgacgugugcaaguacgagugcgagaccuacaaggagcugaaggcccacggcguguccugcccccagagccagugccccuacugcuucacgcacugcgagcccaccgaggcggccuuccaggcccacuaccgcgucugccaggugacccaccgguuccgcgacgaccucaagaagaccgugacgccgcagaacuucacccccggcugcuaccggacccugaaccuguuccgcuacaagucccggugcuacaucuucaccaugugggucugccuccuggugcuggagagcauccucugggccgccuccgcgagcgaggugccccugaacccggucuggaacgacaacgcccacggggugggcuccgugcccaugcacaccgaccuggagcuggacuucagccucacguccagcuccaaguacaccuaccgccggcgccugaccaacccccuggaggagacccagagcaucaaccuccacaucgagaucgaggagcagacgaucggggucgacgugcacgcccugggccacugguucgacgggcgccugaaccucaagaccagcuuccacugcuacggcgccugcaccaaguacgaguaccccuggcacaccgccaagugccacuacgagcgggacuaccaguacgagacguccuggggcugcaacccggcggacugccccggggugggcaccgggugcaccgccugcggccuguaccuggaccagcucaagcccgucggcagcgccuacaagaucaucaccauccgcuacucccggaaggugugcgugcaguucggggaggagaaccugugcaaggucaucgacaugaacgacugcuucgugacgcgccacgugaaggucugcaucaucggcaccgugagcaaguucucccagggggacacccuccucuucuucggcccccuggagggcgggggccugaucuucaagcacuggugcaccagcacgugccaguucggggacccgggcgacaucaugagcccccgggacaagggguuccucugccccgaguuccccggcagcuuccgcaagaagugcaacuucgccaccaccccgcugugcgaguacgacgggaacaugguguccggcuacaagaaggucauggccaccaucgacagcuuccaguccuucaacacgagcaccaugcacuucaccgacgagcggaucgaguggaaggaccccgacggcaugcugcgcgaccacaucaacauccucgugaccaaggacaucgacuucgacaaccugggggagaaccccugcaagaucggccugcagacguccagcaucgagggggcguggggcuccggggugggcuucacccugaccugccugaucagccugaccgagugccccacguuccucaccuccaucaaggccugcgacaaggccaucugcuacggcgccgagagcgucacccugacccgggggcagaacacggugaagguguccggcaagggcgggcacagcgggagcaccuucaagugcugccacggcgaggagugcucccagaucggccugcacgcggccgccccgcaccucgacaaggucaacgggaucagcgagaucgagaacaacaagguguacgacgacggcgcgccccagugcggggugaagugcugguucgucaaguccggcgaguggaucagcggcaucuucuccgggaacuggaucgugcugaucguccugugcguguuccuccuguucagccuggugcuccuguccguccugugccccgugcgcaagcacaagaaguccuga

SEQ ID NO: 11715 - RNA, 3408 nt, Artificial Sequence
  derived and/or modified CDS sequence (opt1) from HTNV(LongquanAa-11-642)__KC344262.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugccgcccaugccccucgccgacacggcccagauggugcccgaguccagcugcaacauggacaaccaccaguccaugaacaccaucaccaaguacacccaggucagcuggcggggcaaggccgaccaggcccaggccucccagaacagcuucgaggcgguguccgccgagguggaccugaaggggacgugcguccugaagcacaagaugcucgaggagagcuaccgcucccgcaagagcaucacgugcuacgaccuguccugcaacagcaccuacugcaagcccacccuguacaugaucgugcccauccacgccugcaacaugaugaaguccugccucaucgcccugggccccuaccgggugcaggucguguacgagcggaccuacugcaugaccggggugcugcucgagggcaagugcuucgucccggaccagagcgugguguccaucaucaagcacggcaucuucgacaucgcgagcguccacaucgugugcuucuucguggccgucaaggggaacaccuacaagcuguucgagcaggucaagaaguccuuccagagcacgugcaacgacaccgagaacaaggugcagggcuacuacaucugcaucgucgggggcaacagcgcccccaucuacgugcccacccuggacgacuuccgcuccauggaggccuucagcgggaucuuccggagcccccacggcgaggaccacgaccucgccggcgaggagaucgcguccuacuccaucguggggccggccaacgccaaggugccccacagcgccuccagcgacacccugucccugaucgccuacagcggcauccccuccuacagcucccucagcauccuggcguccagcaccgaggccaagcacguguucucccccggguucuucccgcagcugaaccacacgaagugcgacaagaccgccaucccccucaucuggaccggcaugaucgaccugcccggcuacuacgaggccauccaccccugcaccgucuucugcgugcugagcgggccgggcgccuccugcgaggcguucagcgagggcgggaucuucaacaucacgagccccaugugccucguguccaagcagaaccgcuuccggcugaccgagcagcaggucaacuucgugugccagcgcguggacgucgacaucaucguguacugcaacgggcagcggaaggugauccugaccaagacccucgucaucggccagugcaucuacacgaucaccagccuguucucccugcuccccggcguggcccacagcaucgccguggagcugugcguccccggguuccacggcugggccaccgccgcgcugcucgugaccuucugcuucgggugggugcugaucccggcccugacgcucaucauccugaccauccugaaguucaucgccaacaucuuccacaccuccaaccaggagaaccgccucaagagcguccugcggaagaucaaggaggaguucgagaagaccaagggcuccauggugugcgacgugugcaaguacgagugcgagacguacaaggagcugaaggcccacggggucagcugcccccagucccagugccccuacugcuucacccacugcgagcccaccgaggcggccuuccaggcccacuaccgcgugugccaggugacccaccgguuccgcgacgaccucaagaagacggucaccccgcagaacuucacccccggcugcuaccggacccugaaccuguuccgcuacaagagccggugcuacaucuucaccaugugggugugccuccuggugcuggaguccauccucugggccgccagcgcguccgaggucccccugaacccgguguggaacgacaacgcccacggcguggggagcguccccaugcacacggaccuggagcuggacuucucccucaccagcuccagcaaguacaccuaccgccggcgccugaccaacccccuggaggagacgcagagcaucaaccuccacaucgagaucgaggagcagaccaucggcguggacgugcacgcccuggggcacugguucgacggccgccugaaccucaagaccuccuuccacugcuacggggccugcaccaaguacgaguaccccuggcacacggccaagugccacuacgagcgggacuaccaguacgagaccagcuggggcugcaacccggcggacugccccggcgucgggaccggcugcaccgccugcgggcuguaccuggaccagcucaagcccgugggcuccgccuacaagaucaucacgauccgcuacagccggaaggugugcguccaguucggcgaggagaaccugugcaaggugaucgacaugaacgacugcuucgugacccgccacgucaaggugugcaucaucgggaccguguccaaguucagccagggcgacacccuccucuucuucgggccccuggagggcgggggccugaucuucaagcacuggugcacguccacgugccaguucggcgacccgggggacaucaugagcccccgggacaagggcuuccucugccccgaguuccccggguccuuccgcaagaagugcaacuucgccaccaccccgcugugcgaguacgacggcaacauggucagcggguacaagaaggugauggccaccaucgacuccuuccagagcuucaacaccuccaccaugcacuucaccgacgagcggaucgaguggaaggaccccgacggcaugcugcgcgaccacaucaacauccucgugacgaaggacaucgacuucgacaaccugggcgagaaccccugcaagaucgggcugcagaccagcuccaucgagggcgcgugggggagcggcgucggguucacccugaccugccugaucucccugacggagugccccaccuuccucaccagcaucaaggccugcgacaaggccaucugcuacggcgccgaguccgugacccugacgcggggccagaacaccgugaaggucagcgggaagggcgggcacagcggcuccaccuucaagugcugccacggggaggagugcagccagaucggccugcacgcggccgccccgcaccucgacaaggugaacggcaucuccgagaucgagaacaacaagguguacgacgacggggcgccccagugcggcgucaagugcugguucgucaagagcggggaguggaucuccggcaucuucagcggcaacuggaucgugcugaucgugcugugcguguuccuccuguucucccugguccuccugagcgugcugugccccgugcgcaagcacaagaaguccuga

SEQ ID NO: 11716 - RNA, 3408 nt, Artificial Sequence
  derived and/or modified CDS sequence (opt1) from HTNV(LongquanAa-11-774)__KC344257.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugccgcccaugccccucgccgacacggcccagauggugcccgaguccagcugcaacauggacaaccaccaguccaugaacaccaucaccaaguacacccaggucagcuggcggggcaaggccgaccaggcccaggccucccagaacagcuucgaggcgguguccgccgagguggaccugaaggggacgugcguccugaagcacaagaugcucgaggagagcuaccgcucccggaaguccaucacgugcuacgaccuguccugcaacagcaccuacugcaagcccacccuguacaugaucgugcccauccacgccugcaacaugaugaaguccugccucaucgcccugggccccuaccgcgugcaggucguguacgagcggaccuacugcaugaccggggugcugaucgagggcaagugcuucgucccggaccagagcgugguguccaucaucaagcacggcaucuucgacaucgcgagcguccacaucgugugcuucuucguggccgucaaggggaacaccuacaagcuguucgagcaggucaagaaguccuuccagagcacgugcaacggcaccgagaacaaggugcagggguacuacaucugcaucgugggcgggaacagcgcccccaucuacgugcccacccuggacgacuuccgcuccauggaggccuucagcggcaucuuccggagcccccacggcgaggaccacgaccuggccggggaggagaucgcgagcuacuccaucgucggcccggccaacgccaaggugccccacagcgccuccagcgacacccucucccugaucgccuacagcgggauccccuccuacagcucccugagcauccucgcguccagcaccgaggccaagcacguguucucccccggcuucuucccgcagcugaaccacacgaagugcgacaagaccgccaucccccugaccuggaccggcaugaucgaccuccccggguacuacgaggccauccaccccugcacggucuucugcgugcugagcggcccgggggccuccugcgaggcguucagcgagggcgggaucuucaacaucaccagccccaugugccugguguccaagcagaaccgcuuccggcucaccgagcagcaggucaacuucgugugccagcgcguggacauggacaucaucgucuacugcaacggccagcggaaggugauccugaccaagacgcuggugaucggccagugcaucuacaccaucaccagccucuucucccugcugcccggggucgcccacagcaucgccguggagcucugcgugcccggcuuccacgggugggccaccgccgcgcugcuggucacguucugcuucggcugggugcucaucccggcccugacccugaucauccucaccauccugaaguucaucgccaacaucuuccacaccuccaaccaggagaaccgccucaagagcgugcuccggaagaucaaggaggaguucgagaagacgaagggguccauggucugcgacgugugcaaguacgagugcgagaccuacaaggagcugaaggcccacggcgugagcugcccccagucccagugccccuacugcuucacccacugcgagcccaccgaggcggccuuccaggcccacuaccgcgucugccaggugacgcaccgguuccgcgacgaccugaagaagaccgugaccccgcagaacuucacccccggcugcuaccggacccucaaccuguuccgcuacaagagccggugcuacaucuucacgaugugggucugccugcucgugcuggaguccauccugugggccgccagcgcguccgaggugccccucaacccggucuggaacgacaacgcccacggggugggcagcgugcccaugcacaccgaccuggagcuggacuucucccugaccagcuccagcaaguacaccuaccgccggcgccucacgaacccccuggaggagacccagagcaucaaccugcacaucgagaucgaggagcagaccaucggggucgacgugcacgcccucggccacugguucgacgggcgccugaaccugaagaccuccuuccacugcuacggcgccugcacgaaguacgaguaccccuggcacaccgccaagugccacuacgagcgggacuaccaguacgagaccagcuggggcugcaacccggcggacugccccggggugggcaccgggugcacggccugcggccucuaccuggaccagcugaagcccgucggcuccgccuacaagaucaucaccauccgcuacagccggaaggugugcgugcaguucggggaggagaaccucugcaaggucaucgacaugaacgacugcuucgugacccgccacgugaaggucugcaucaucggcaccguguccaaguucagccagggggacacgcugcuguucuucggcccccucgagggcgggggccugaucuucaagcacuggugcaccuccacgugccaguucggggacccgggcgacaucaugagcccccgggacaagggguuccugugccccgaguuccccggcuccuuccgcaagaagugcaacuucgccaccaccccgcucugcgaguacgacgggaacauggugagcggcuacaagaaggucauggccaccaucgacuccuuccagagcuucaacaccuccaccaugcacuucacggacgagcggaucgaguggaaggaccccgacggcaugcugcgcgaccacaucaacauccuggugaccaaggacaucgacuucgacaaccucggggagaaccccugcaagaucggccugcagaccagcuccaucgagggggcguggggcagcggggugggcuucacccugacgugccucaucucccugaccgagugccccaccuuccugaccagcaucaaggccugcgacaaggccaucugcuacggcgccgaguccgucacgcucacccgggggcagaacaccgugaaggugagcggcaagggcgggcacagcggguccaccuucaagugcugccacggcgagaagugcagccagaucggccugcacgcggccgccccgcaccuggacaaggucaacgggaucuccgagaucgagaacaacaagguguacgacgacggcgcgccccagugcggggugaagugcugguucgucaagagcggcgaguggaucuccggcaucuucagcgggaacuggaucgugcucaucguccugugcguguuccuccuguucucccuggugcugcucagcguccugugccccgugcgcaagcacaagaaguccuga

SEQ ID NO: 11717 - RNA, 3408 nt, Artificial Sequence
  derived and/or modified CDS sequence (opt1) from HTNV(LongquanMf-09-8)__JQ912875.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugccgcccaugccccucgccgacacggcccagauggugcccgaguccagcugcaacauggacaaccaccaguccaugaacaccaucaccaaguacacccaggucagcuggcggggcaaggccgaccaggcccaggccucccagaacagcuucgaggcgguguccgccgagguggaccugaaggggacgugcguccugaagcacaagaugcucgaggagagcuaccgcucccggaaguccaucacgugcuacgaccuguccugcaacagcaccuacugcaagcccacccuguacaugaucgugcccauccacgccugcaacaugaugaaguccugccucaucgcccugggccccuaccgcgugcaggucguguacgagcggaccuacugcaugaccggggugcugaucgagggcaagugcuucgucccggaccagagcgugguguccaucaucaagcacggcaucuucgacaucgcgagcguccacaucgugugcuucuucguggccgucaaggggaacaccuacaagcuguucgagcaggucaagaaguccuuccagagcacgugcaacggcaccgagaacaaggugcagggguacuacaucugcaucgugggcgggaacagcgcccccaucuacgugcccacccuggacgacuuccgcuccauggaggccuucagcggcaucuuccggagcccccacggcgaggaccacgaccuggccggggaggagaucgcgagcuacuccaucgucggcccggccaacgccaaggugccccacagcgccuccagcgacacccucucccugaucgccuacagcgggauccccuccuacagcucccugagcauccucgcguccagcaccgaggccaagcacguguucucccccggcuucuucccgcagcugaaccacacgaagugcgacaagaccgccaucccccugaccuggaccggcaugaucgaccuccccggguacuacgaggccauccaccccugcacggucuucugcgugcugagcggcccgggggccuccugcgaggcguucagcgagggcgggaucuucaacaucaccagccccaugugccugguguccaagcagaaccgcuuccggcucaccgagcagcaggucaacuucgugugccagcgcguggacauggacaucaucgucuacugcaacggccagcggaaggugauccugaccaagacgcuggugaucggccagugcaucuacaccaucaccagccucuucucccugcugcccggggucgcccacagcaucgccguggagcucugcgugcccggcuuccacgggugggccaccgccgcgcugcuggucacguucugcuucggcugggugcucaucccggcccugacccugaucauccucaccauccugaaguucaucgccaacaucuuccacaccuccaaccaggagaaccgccucaagagcgugcuccggaagaucaaggaggaguucgagaagacgaagggguccauggucugcgacgugugcaaguacgagugcgagaccuacaaggagcugaaggcccacggcgugagcugcccccagucccagugccccuacugcuucacccacugcgagcccaccgaggcggccuuccaggcccacuaccgcgucugccaggugacgcaccgguuccgcgacgaccugaagaagaccgugaccccgcagaacuucacccccggcugcuaccggacccucaaccuguuccgcuacaagagccggugcuacaucuucacgaugugggucugccugcucgugcuggaguccauccugugggccgccagcgcguccgaggugccccucaacccggucuggaacgacaacgcccacggggugggcagcgugcccaugcacaccgaccuggagcuggacuucucccugaccagcuccagcaaguacaccuaccgccggcgccucacgaacccccuggaggagacccagagcaucaaccugcacaucgagaucgaggagcagaccaucggggucgacgugcacgcccucggccacugguucgacgggcgccugaaccugaagaccuccuuccacugcuacggcgccugcacgaaguacgaguaccccuggcacaccgccaagugccacuacgagcgggacuaccaguacgagaccagcuggggcugcaacccggcggacugccccggggugggcaccgggugcacggccugcggccucuaccuggaccagcugaagcccgucggcuccgccuacaagaucaucaccauccgcuacagccggaaggugugcgugcaguucggggaggagaaccucugcaaggucaucgacaugaacgacugcuucgugacccgccacgugaaggucugcaucaucggcaccguguccaaguucagccagggggacacgcugcuguucuucggcccccucgagggcgggggccugaucuucaagcacuggugcaccuccacgugccaguucggggacccgggcgacaucaugagcccccgggacaagggguuccugugccccgaguuccccggcuccuuccgcaagaagugcaacuucgccaccaccccgcucugcgaguacgacgggaacauggugagcggcuacaagaaggucauggccaccaucgacuccuuccagagcuucaacaccuccaccaugcacuucacggacgagcggaucgaguggaaggaccccgacggcaugcugcgcgaccacaucaacauccuggugaacaaggacaucgacuucgacaaccucggggagaaccccugcaagaucggccugcagaccagcuccaucgagggggcguggggcagcggggugggcuucacccugaccugccucaucucccugacggagugccccaccuuccugaccagcaucaaggccugcgacaaggccaucugcuacggcgccgaguccgucacccucacgcgggggcagaacaccgugaaggugagcggcaagggcgggcacagcggguccaccuucaagugcugccacggcgaggagugcagccagaucggccugcacgcggccgccccgcaccuggacaaggucaacgggaucuccgagaucgagaacaacaagguguacgacgacggcgcgccccagugcggggugaagugcugguucgucaagagcggcgaguggaucuccggcaucuucagcgggaacuggaucgugcucaucguccugugcguguuccuccuguucucccuggugcugcucagcguccugugccccgugcgcaagcacaagaaguccuga

SEQ ID NO: 11718 - RNA, 3408 nt, Artificial Sequence
  derived and/or modified CDS sequence (opt1) from HTNV(ROKA14-11)__KU207203.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagaacuccuucgagacggugagcaccgaggucgaccugaagggcaccugcgugcugaagcacaagaugguggaggaguccuaccgcagccggaaguccaucaccugcuacgaccucagcugcaacuccacguacugcaagcccacccuguacaugaucguccccauccacgccugcaacaugaugaagagcugccugaucgcccucgggcccuaccgcgugcagguggucuacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcaccugcaacgacaccgagaacaaggugcagggguacuacaucugcaucgucggcgggaacuccgcccccaucuacgugcccacccuggacgacuuccgcagcauggaggccuucacgggcaucuuccgguccccccacggcgaggaccacgaccucgccggggaggagaccgcgaccuacagcaucgugggcccggccaacgccaaggucccccacuccgccagcuccgacacccugagccugaucgccuucuccgggauccccagcuacuccagccucuccauccugacgagcuccaccgaggcgaagcacguguucagccccggccuguucccgaagcucaaccacaccaacugcgacaagggcgccaucccccugauguggaccgggaugaucgaccugcccggcuacuacgaggccauccaccccugcacgguguucugcguccucuccgggccgggcgccagcugcgaggccuucagcgaggggggcaucuucaacaucaccucccccaugugccuggugagcaagcagaaccgcuuccggcugaccgagcagcaggugaacuucgucugccagcgcguggacguggacaucgucguguacugcaacggccagcggaaggugauccucaccaagacgcuggucaucgggcagugcaucuacaccaucaccucccuguucagccuccugcccggcguggcgcacuccaucgccguggagcugugcguccccggguuccacggcugggccaccgccgcccuccuggugacguucugcuucgggugggugcugaucccggcgaucaccuucaucauccucaccauccugaaguucaucgccaacaucuuccacaccagcaaccaggagaaccgccugaaguccguccuccggaagaucaaggaggaguucgagaagacgaagggcagcauggugugcgacgugugcaaguacgagugcgagaccuacaaggagcugaaggcccacggcgucuccugcccccagagccagugccccuacugcuucacccacugcgagcccaccgaggccgccuuccaggcgcacuacaaggugugccaggugacccaccgcuuccgggacgaccugaagaagacggucaccccgcagaacuucacccccgggugcuaccgcacccucaaccuguuccgguacaagucccgcugcuacaucuucacgauguggaucuuccugcucgugcuggagagcauccugugggccgccuccgccagcgagaccccccucaccccgguguggaacgacaacgcgcacggcgucggguccgugcccaugcacaccgaccuggagcuggacuucagccugacguccagcagcaaguacaccuaccggcgcaagcucaccaacccccuggaggaggcccaguccaucgaccugcacaucgagaucgaggagcagaccaucggcguggacguccacgcccucgggcacugguucgacggccggcugaaccugaagacgagcuuccacugcuacggcgccugcaccaaguacgaguaccccuggcacaccgccaagugccacuacgagcgcgacuaccaguacgagaccuccugggggugcaacccgagcgacugccccggcguggggacgggcugcaccgcgugcggccucuaccuggaccgccugaagcccgugggguccgccuacaagaucaucaccauccgguacagccgccgggucugcgugcaguucggcgaggagaaccucugcaagaucaucgacaugaacgacugcuucgugucccgccacgucaaggugugcaucaucgggaccgugagcaaguucucccagggcgacacgcugcuguucuucgggccccucgagggcggcgggcugaucuucaagcacuggugcaccagcaccugccaguucggcgacccgggggacaucauguccccccgggacaagggcuuccugugccccgaguuccccgggagcuuccgcaagaagugcaacuucgccaccacgccgaucugcgaguacgacggcaacauggucuccggcuacaagaaggugauggccaccaucgacagcuuccaguccuucaacaccagcaccaugcacuucacggacgagcggaucgaguggaaggaccccgacgggaugcuccgcgaccacaucaacauccuggugaccaaggacaucgacuucgacaaccugggcgagaaccccugcaagaucgggcuccagaccuccagcaucgagggcgccuggggguccggcgucggcuucaccagcacgugccuggugagccugaccgagugccccaccuuccucaccuccaucaaggcgugcgacaaggccaucugcuacggggccgagagcgugacgcugacccggggccagaacaccgucaagguguccgggaagggcgggcacagcggcuccaccuucaagugcugccacggcgaggacugcagccagaucgggcugcacgccgccgcgccgcaccucgacaaggugaacggcaucuccgagauggagaacagcaaggucuacgacgacggggccccccagugcggcaucaagugcugguucgugaaguccggcgaguggaucagcgggaucuucuccggcaacuggaucguccugaucgugcugugcguguuccuccuguucagccugguccuccuguccauccugugccccgugcgcaagcacaagaagagcuga

SEQ ID NO: 11719 - RNA, 3408 nt, Artificial Sequence
  derived and/or modified CDS sequence (opt1) from HTNV(US8A15-1)__KU207205.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagaacuccuucgagacggugagcaccgaggucgaccugaagggcaccugcgugcugaagcacaagaugguggaggaguccuaccgcagccggaaguccaucaccugcuacgaccucagcugcaacuccacguacugcaagcccacccuguacaugaucguccccauccacgccugcaacaugaugaagagcugccugaucgcccucgggcccuaccgcgugcagguggucuacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcaccugcaacgacaccgagaacaaggugcagggguacuacaucugcaucgucggcgggaacuccgcccccaucuacgugcccacccuggacgacuuccgcagcauggaggccuucacgggcaucuuccgguccccccacggcgaggaccacgaccucgccggggaggagaccgcgaccuacagcaucgugggcccggccaacgccaaggucccccacuccgccagcuccgacacccugagccugaucgccuucuccgggauccccagcuacuccagccucuccauccugacgagcuccaccgaggcgaagcacguguucagccccggccuguucccgaagcucaaccacaccaacugcgacaagggcgccaucccccugauguggaccgggaugaucgaccugcccggcuacuacgaggccauccaccccugcacgguguucugcguccucuccgggccgggcgccagcugcgaggccuucagcgaggggggcaucuucaacaucaccucccccaugugccuggugagcaagcagaaccgcuuccggcugaccgagcagcaggugaacuucgucugccagcgcguggacguggacaucgucguguacugcaacggccagcggaaggugauccucaccaagacgcuggucaucgggcagugcaucuacaccaucaccucccuguucagccuccugcccggcguggcgcacuccaucgccguggagcugugcguccccggguuccacggcugggccaccgccgcccuccuggugacguucugcuucgggugggugcugaucccggcgaucaccuucaucauccucaccauccugaaguucaucgccaacaucuuccacaccagcaaccaggagaaccgccugaaguccguccuccggaagaucaaggaggaguucgagaagacgaagggcagcauggugugcgacgugugcaaguacgagugcgagaccuacaaggagcugaaggcccacggcgucuccugcccccagagccagugccccuacugcuucacccacugcgagcccaccgaggccgccuuccaggcgcacuacaaggugugccaggugacccaccgcuuccgggacgaccugaagaagacggucaccccgcagaacuucacccccgggugcuaccgcacccucaaccuguuccgguacaagucccgcugcuacaucuucacgauguggaucuuccugcucgugcuggagagcauccugugggccgccuccgccagcgagaccccccucaccccgguguggaacgacaacgcgcacggcgucggguccgugcccaugcacaccgaccuggagcuggacuucagccugacguccagcagcaaguacaccuaccggcgcaagcucaccaacccccuggaggaggcccaguccaucgaccugcacaucgagaucgaggagcagaccaucggcguggacguccacgcccucgggcacugguucgacggccggcugaaccugaagacgagcuuccacugcuacggcgccugcaccaaguacgaguaccccuggcacaccgccaagugccacuacgagcgcgacuaccaguacgagaccuccugggggugcaacccgagcgacugccccggcguggggacgggcugcaccgcgugcggccucuaccuggaccgccugaagcccgugggguccgccuacaagaucaucaccauccgguacagccgccgggucugcgugcaguucggcgaggagaaccucugcaagaucaucgacaugaacgacugcuucgugucccgccacgucaaggugugcaucaucgggaccgugagcaaguucucccagggcgacacgcugcuguucuucgggccccucgagggcggcgggcugaucuucaagcacuggugcaccagcaccugccaguucggcgacccgggggacaucauguccccccgggacaagggcuuccugugccccgaguuccccgggagcuuccgcaagcacugcaacuucgccaccacgccgaucugcgaguacgacggcaacauggucuccggcuacaagaaggugauggccaccaucgacagcuuccaguccuucaacaccagcaccaugcacuucacggacgagcggaucgaguggaaggaccccgacgggaugcuccgcgaccacaucaacauccuggugaccaaggacaucgacuucgacaaccugggcgagaaccccugcaagaucgggcuccagaccuccagcaucgagggcgccuggggguccggcgucggcuucacccugacgugccuggugagccucaccgagugccccaccuuccugaccagcaucaaggcgugcgacaaggccaucugcuacggggccgaguccgugacgcugacccggggccagaacaccgucaaggugagcgggaagggcgggcacuccggcagcaccuucaagugcugccacggcgaggacugcucccagaucgggcuccacgccgccgcgccgcaccuggacaaggugaacggcaucagcgagauggagaacuccaaggucuacgacgacggggccccccagugcggcaucaagugcugguucgugaagagcggcgaguggaucuccgggaucuucagcggcaacuggaucguccugaccgugcucugcguguuccugcuguucucccucguccugcugagcauccucugccccgugcgcaagcacaagaaguccuga

SEQ ID NO: 11720 - RNA, 3408 nt, Artificial Sequence
  derived and/or modified CDS sequence (opt1) from HTNV(Lee)__D00377.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagacguccuucgagaccgugagcaccgaggucgaccugaagggcaccugcgugcugaagcacaagaugguggaggaguccuaccgcagccggaaguccaucacgugcuacgaccucagcugcaacuccaccuacugcaagcccacccuguacaugaucguccccauccacgccugcaacaugaugaagagcugccugaucgcccucgggcccuaccgcgugcagguggucuacgagcggaccuacugcaugacgggcgugcugaucgagggcaagugcuucgugccggaccaguccgucgugagcaucaucaagcacgggaucuucgacaucgccagcgugcacaucgucugcuucuucguggcggugaagggcaacaccuacaagaucuucgagcaggucaagaaguccuucgagagcaccugcaacgacaccgagaacaaggugcagggguacuacaucugcaucgucggcgggaacuccgcccccaucuacgugcccacgcuggacgacuuccgcagcauggaggccuucaccggcaucuuccgguccccccacggcgaggaccacgaccucgccggggaggagaccgcgaccuacagcaucgugggcccggccaacgccaaggucccccacuccgccagcuccgacacgcugagccugaucgccuucuccgggauccccagcgacuccagccucuccauccugaccagcuccaccgaggcgaagcacguguucagccccggccuguucccgaagcucaaccacaccaacugcgacaagggcgccaucccccugauguggacggggaugaucgaccugcccggcuacuacgaggccauccaccccugcaccguguucugcguccucuccgggccgggcgccagcugcgaggccuucagcgaggggggcaucuucaacaucaccuaccccaugugccugguguccaagcagaaccgcuuccggcugaccgagcagcaggugaacuucgucugccagcgcguggacguggacaucgucguguacugcaacggccagcggaaggugauccucacgaagacccuggucaucgggcagugcaucuacaccaucaccagccuguucucccuccugcccggcguggcgcacagcaucgccguggagcugugcguccccggguuccacggcugggccacggccgcccuccuggugaccuucugcuucgggugggugcugaucccggcgaucaccuucaucauccucaccauccugaaguucaucgccaacaucuuccacacguccaaccaggagaaccgccugaagagcguccuccggaagaucaaggaggaguucgagaagaccaagggcuccauggugugcgacgugugcaaguacgagugcgagaccuacaaggagcugaaggcccacggcgucagcugcccccagucccagugccccuacugcuucacccacugcgagcccaccgaggccgccuuccaggcgcacuacaaggugugccaggugacgcaccgcuuccgggacgaccugaagaagaccgucaccccgcagaacuucacccccgggugcuaccgcacgcucaaccuguuccgguacaagagccgcugcuacaucuucaccauguggaucuuccugcucgugcuggaguccauccugugggccgccagcgccuccgagaccccccucaccccgguguggaacgacaacgcgcacggcgucgggagcgugcccaugcacacggaccuggagcuggacuucucccugaccagcuccagcaaguacaccuaccggcgcaagcucaccaacccccuggaggaggcccagagcaucgaccugcacaucgagaucgaggagcagacgaucggcguggacguccacgcccucgggcacugguucgacggccggcugaaccugaagaccuccuuccacugcuacggcgccugcaccaaguacgaguaccccuggcacaccgccaagugccacuacgagcgcgacuaccaguacgagacgagcugggggugcaacccguccgacugccccggcguggggaccggcugcaccgcgugcggccucuaccuggaccgccugaagcccguggggagcgccuacaagaucaucaccauccgguacucccgccgggucugcgugcaguucggcgaggagaaccucugcaagaucaucgacaugaacgacugcuucgugagccgccacgucaaggugugcaucaucgggacgguguccaaguucagccagggcgacacccugcuguucuucgggccccucgagggcggcgggcugaucuucaagcacuggugcaccuccaccugccaguucggcgacccgggggacaucaugagcccccgggacaagggcuuccugugccccgaguuccccggguccuuccgcaagaagugcaacuucgccacgaccccgaucugcgaguacgacggcaacauggucagcggcuacaagaaggugauggccaccaucgacuccuuccagagcuucaacaccuccacgaugcacuucaccgacgagcggaucgaguggaaggaccccgacgggaugcuccgcgaccacaucaacauccuggugaccaaggacaucgacuucgacaaccugggcgagaaccccugcaagaucgggcuccagaccagcuccaucgagggcgccugggggagcggcgucggcuucacgcugaccugccuggugucccucaccgagugccccaccuuccugacgagcaucaaggcgugcgacaaggccaucugcuacggggccgagagcgugacccugacccggggccagaacaccgucaagguguccgggaagggcgggcacagcggcuccaccuucaagugcugccacggcgaggacugcagccagaucgggcuccacgccgccgcgccgcaccuggacaaggugaacggcaucuccgagauggagaacagcaaggaguacgacgacggggccccccagugcggcaucaagugcugguucgucaaguccggcgaguggaucagcgggaucuucuccggcaacuggaucgugcugaucguccucugcguguuccugcuguucagccucgugcugcuguccauccucugccccguccgcaagcacaagaagagcuga

SEQ ID NO: 11721 - RNA, 3384 nt, Artificial Sequence
  derived and/or modified CDS sequence (opt1) from HTNV(M)__U38177.1__GP
auggccagccugguguggcccguccucacccugcgcaacguguacgacaugaagaucgagugcccgcacaccguguccuucggcgagaacagcgucaucggguacguggagcugccgcccgugccccucgccgacacggcccagaugguccccgaguccagcugcaacauggacaaccaccagucccugaacaccaucaccaaguacacccaggugagcuggcggggcaaggccgaccagucccagagcucccagaacagcuucgagacgguguccaccgaggucgaccugaaggggaccugcgugcucaagcacaagaugguggaggagagcuaccgcucccgcaagagcgucacgugcuacgaccuguccugcaacagcacguacugcaagcccacccuguacaugaucgugcccauccacgccugcaacaugaugaaguccugccucaucgcccugggccccuaccgcgugcaggucguguacgagcggagcuacugcaugaccggggugcugaucgagggcaagugcuucgucccggaccaguccguggugagcaucaucaagcacggcaucuucgacaucgccagcguccacaucgugugcuucuucguggcggucaaggggaacaccuacaagaucuucgagcaggucaagaaguccuucgagagcacgugcaacgacaccgagaacaagguccagggcuacuacaucugcaucgucgggggcaacuccgcccccaucuacgugcccacccucgacgacuuccgcagcauggaggccuucaccgggaucuuccggagcccccacggcgaggaccacgaccuggccggcgaggagaucgcguccuacuccaucgugggggccgccaacgccaaggugccgcacagcgccuccagcgacacgcugcgccucaucgcguacuccggcauccccagcuacuccagccuguccauccugaccagcuccaccgaggccaagcacguguucagccccggccucuuccccaagcugaaccacaccaacugcgacaaguccgccaucccgcugaucuggacgggcaugaucgaccuccccggcuacuacgaggccguccaccccugcaccguguucugcgugcugagcgggcccggggccagcugcgaggcguucuccgagggcgggaucuucaacaucaccagcccgaugugccugguguccaagcagaaccgguuccggcucaccgagcagcaggucaacuucgugugccagcggguggacauggacaucgugguguacugcaacgggcagcgcaaggucauccugaccaagacccuggugaucggccagugcaucuacaccaucaccagccucuucucccugcugcccggcguggcccacagcaucgccgucgagcucugcgugcccggguuccacggcugggccacggccgcgcugcuggugaccuucugcuucggguggguccucauccccgccaucaccuucaucauccugaccgugcugaaguucaucgccaacaucuuccacacguccaaccaggagaaccggcucaagagcgugcugcgcaagaucaaggaggaguucgagaagaccaagggcuccauggucugcgacgugugcaaguacgagugcgagaccuacaaggagcugaaggcccacggggugagcugcccgcagucccagugccccuacugcuucacccacugcgagcccacggaggccgcguuccaggcccacuacaaggucugccaggugacccaccgguuccgcgacgaccucaagaagaccgugacgccccagaacuucaccccgggcugcuaccggacccugaaccuguuccgcuacaagagccggugcuacaucuucaccauguggaucuuccuccugguccuggaguccauccucugggccgccagcgcguccgagacgccccugacccccguguggaacgacaacgcccacggcguggggagcgucccgaugcacaccgaccuggagcucgacuucucccugaccagcagcuccaaguacaccuaccgccggaagcugaccaacccccuggaggaggcccagagcaucgaccuccacaucgagaucgaggagcagacgaucggcguggacgugcacgcccuggggcacugguucgacggccgccugaaccucaagaccuccuuccacugcuacggggccugcaccaaguacgaguaccccuggcacaccgcgaagugccacuacgagcgcgacuaccaguacgagacgagcuggggcugcaaccccuccgacugcccgggcgucgggaccggcugcaccgccugcgggcuguaccuggaccagcucaagcccgugggcagcgccuacaagaucaucaccauccgguacucccgccgggugugcguccaguucggcgaggagaaccugugcaagaucaucgacaugaacgacugcuucgugagccgccacgugaaggucugcaucaucgggacgguguccaaguucagccagggcgacacccuccuguucuucgggccccuggagggcgggggccugaucuucaagcacuggugcaccagcacgugccaguucggcgaccccggggacaucaugagcccgcgggacaagggcuuccucugccccgaguuccccggguccuuccgcaagaagugcaacuucgccaccacccccaucugcgaguacgacggcaacauggugagcggguacaagaaggucauggccaccaucgacuccuuccagagcuucaacaccuccacgaugcacuucaccgacgagcggaucgaguggaaggacccggacggcaugcugcgcgaccacaucaacauccuggugaccaaggacaucgacuucgacaaccucggcgagaaccccugcaagaucgggcugcagaccagcuccaucgagggcgcgugggggagcggcgugggguucacgcugaccugccucgucagccugaccgagugccccaccuuccugacguccaucaaggccugcgacaaggccaucugcuacggcgccgagagcgugacccucacccggggccagaacaccgugaaggucuccgggaagggcgggcacagcggcuccacguucaagugcugccacggggaggacugcagccagaucggccugcacgccgcggcgccccaccuggacaaggugaacggcaucuccgagaucgagaacagcaaggucuacgacgacggggccccgcagugcggcaucaagugcugguucgugaaguccggggaguggaucagcggcaucuucuccggcaacuggaucgugcucaucguccugugcguguuccuccuguucagccuggugcugcucuccauccugugccccguccgcaagcacaagaaguccuga

SEQ ID NO: 11722 - RNA, 3408 nt, Artificial Sequence
  derived and/or modified CDS sequence (opt1) from HTNV(N8)__EF077656.1__GP
augggcaucuggaaguggcuggugauggccagccucgucuggcccgccuacacccugcgcaacguguacgacaugaagaucgagugcccgcacaccgugagcuucggggagaacagcgucaucggcuacguggagcugccgcccaugccccucgcggacacggcccagauggugcccgaguccagcugcaacauggacaaccaccaguccaugaacaccaucaccaaguacacccaggucagcuggcgggggaaggccgaccaggcccaggccucccagaacagcuucgaggcgguguccgccgagguggaccugaagggcacgugcguccugaagcacaagaugcucgaggagagcuaccgcucccgcaagagcaucacgugcuacgaccuguccugcaacaacaccuacugcaagcccacccuguacaugaucgugcccauccacgccugcaacaugaugaaguccugccucaucgcccuggggcccuaccgggugcaggucaucuacgagcggaccuacugcaugaccggcgugcugaucgagggcaagugcuucgugccggaccaguccgucgugagcaucaucaagcacgggaucuucgacaucgcguccgugcacaucgucugcuucuucguggccgugaagggcaacaccuacaagcuguucgagcaggucaagaaguccuuccagagcacgugcaacgacaccgagaacaaggugcagggguacuacaucugcaucgugggcgggaacagcgcccccaucuacguccccacccuggacgacuuccgcagcauggaggccuucuccggcaucuuccggagcccccacggcgaggaccacgaccuggccggggaggagaucgcguccuacagcaucgugggcccggccaacgccaaggucccccacuccgccagcuccgacacccucagccugaucgccuacuccgggauccccagcuacuccagccuguccauccucaccggcagcacggaggcgaagcacguguucucccccggcuucuucccgcagcugaaccacaccaagugcgacaagaccgccaucccccugaccuggacggggaugaucgaccuccccggcuacuacgaggccauccaccccugcaccguguucugcguccugagcgggccgggcgccuccugcgaggccuucagcgagggcgggaucuucaacaucaccucccccaugugccuggugagcaagcagaaccgcuuccggcucaccgagcagcaggucaacuucgugugccagcgcguggacauggacaucaucguguacugcaacggccagcggaaggucauccugacgaagacccuggugaucgggcagugcaucuacaccaucaccagccucuucucccugcugcccggcguggcgcacagcaucgccgucgagcucugcgugcccggguuccacggcugggccacggccgcccugcuggugaccuucugcuucggguggguccucaucccggcgaucaccuucaucauccugaccgugcugaaguucaucgccaacaucuuccacacguccaaccaggagaaccgccuccgggccgugcugcgcaagaucaaggaggaguucgagaagaccaagggcagcauggucugcgacgugugcaaguacgagugcgagaccuacaaggagcugaaggcccacggcguguccugcccccagagccagugccccuacugcuucacccacugcgagcccacggaggcggccuuccaggcccacuaccgggucugccaggugacccaccgcuuccgggacgaccucaagaagaccgugaccccgcagaacuucacccccgggugcuaccgcacgcugaaccuguuccgguacaagucccgcugcuacaucuucaccaugugggucugccuccuggugcuggagagcauccucugggccgccuccgcgagcgaggugccccugaacccggucuggaacgacaacgcccacggcgugggguccgugcccaugcacaccgaccuggagcucgacuucagccugaccuccagcuccaaguacacguaccggcgccgccugaccaacccccuggaggagacccaggccaucaaccuccacaucgagaucgaggagcagaccaucggcgucgacgugcacgcccuggggcacugguucgacggccggcugaaccucaagacgagcuuccacugcuacggcgccugcaccaaguacgaguaccccuggcacaccgcgaagugccacuacgagcgcgacuaccaguacgagaccuccugggggugcaacccggccgacugccccggcguggggacgggcugcaccgccugcggccuguacaucgaccagcugaagcccgucgggagcgccuacaagaucaucaccauccgguacagccgcaaggugugcgugcaguucggcgaggagaaccucugcaaggucaucgacaugaacgacugcuucgugucccggcacgugaaggucugcaucaucgggaccgugagcaaguucucccagggcgacacgcugcuguucuucgggccccucgagggcggcgggcugaucuucaagcacuggugcaccagcacgugccaguucggcgacccgggggacaucaugagcccccgcgacaagggcuuccugugccccgaguuccccgggagcuuccggaagaagugcaacuucgccaccaccccgcucugcgaguacgacggcaacaugguguccggcuacaagaaggucauggcgaccaucgacagcuuccaguccuucaacaccagcaccaugcacuucacggacgagcgcaucgaguggaaggaccccgacgggaugcugcgggaccacaucaacauccuggugaccaaggacaucgacuucgacaaccucggcgagaaccccugcaagaucgggcugcagaccuccagcaucgagggcgccuggggguccggcgugggcuucacccugacgugccucgucagccugaccgagugccccaccuuccugaccuccaucaaggccugcgacaaggccaucugcuacggggcggagagcguggcccucacgcgcggccagaacaccgugaaggucuccgggaagggcgggcacagcggcuccaccuucaagugcugccacggcgaggagugcagccagaucgggcugcacgccgccgccccgcaccuggacaaggugaacggcaucagcgagguggagaacaacaaggucuacgacgacggggcgccccagugcggcgugaagugcugguucgucaaguccggcgaguggaucagcgggaucuucuccggcaacuggaucgugcucaucgugcugugcgucuuccuccucuucagccuggugcugcucuccgugcugugccccguccggaagcacaagaaguccuga

SEQ ID NO: 11723 - RNA, 3408 nt, Artificial Sequence
  derived and/or modified CDS sequence (opt1) from HTNV(Q32)__DQ371905.1__GP
augggcaucuggaaguggcuggugauggccagccucgucuggcccgccuucgcgcugcgcaacguguacgacaugaagaucgagugcccgcacaccguguccuucggggagaacagcgucaucggcuacguggagcugccgcccaugccccucgccgacaccacgcagauggugcccgaguccagcugcuccauggacaaccaccagagccugaacaccaucaccaaguacacccagaucaucuggcgggggaaggccgaccagucccagagcucccagaacagcuucgagacggucuccaccgagguggaccugaaggggaccugcgugcucaagcacaagaugaucgaggagagcuaccgcucccgcaagagcaucacgugcuacgaccuguccugcaacagcaccuacugcaagcccacccuguacaugaucguccccauccacgccugcaacaugaugaaguccugccucaucgcccuggggcccuaccggguccaggugguguacgagcggaccuacugcaugaccggcgugcugaucgagggcaagugcuucgugccggaccagagcgucguguccaucaucaagcacgggaucuucgacaucgcgagcgugcacaucgucugcuucuucguggccgugaagggcaacacguacaagaucuucgagcaggucaagaaguccuucgaguccaacugcaacgacaccgagaacaaggugcagggguacuacaucugcaucaucggcgggaacagcucccccguguacguccccacccucgacgacuuccgcagcauggaggccuucuccggcaucuuccggagcccccacggcgaggaccacgaccuggccggggaggagguggcguccuacagcaucgucggcccggccaacgccaaggugccccacuccgccagcuccgacacccuggggcucaucgccuacuucggcauccccagcuacuccagccuguccauccugacgagcuccaccgaggcgaagcacguguucagccccggccucuucccgcagcugaaccacaccaagugcgacaagaccgccaucccccugacguggaccgggaugaucgaccuccccggcuacuacgaggccauccaccccugcaccgucuucugcgugcuguccgggccgggcgccagcugcgaggccuucagcgagggcggcaucuucaacaucaccucccccaugugccuggugagcaagcagaaccgcuuccggcucacggagcagcaggucaacuucgugugccagcgcguggacgucgacaucaucguguacugcaacggccagcggaaggugauccugaccaagacccuggucaucgggcagugcaucuacaccaucacgucccucuucagccugcugcccggcguggcgcacuccaucgccguggagcucugcguccccggguuccacggcugggccaccgccgcccugcuggugaccuucugcuucgggugggugcucaucccggcgaucaccuucaucauccugacgauccugaaguucaucgccaacaucuuccacaccagcaaccaggagaaccgccucaaguccguccugcggaagaucaaggaggaguucgagcgcaccaagggcagcauggugugcgacaucugcaaguacgagugcgagaccuacaaggagcugaaggcccacggcguguccugcccccagagccagugccccuacugcuucacgcacugcgagcccaccgaggccgccuuccaggcgcacuacaaggucugccaggugacccaccgguuccgcgacgaccucaagaagaccgugaccccgcagaacuucacgcccgggugcuaccggacccugaaccuguuccgcuacaagucccggugcuacaucuucaccaugugggucuuccuccuggugcuggagagcauccucugggccgccuccgccagcgagaucccccugaacccgguguggaacgacaacgcgcacggcgucggguccauccccaugcacaccgaccuggagcucgacuucagccugacguccagcagcaaguacaccuaccgccggaagcugaccaacccccuggaggagucccaggccaucgaccuccacguggagaucgaggagcagaccaucggcguggacguccacgcccuggggcacugguucgacggccgccugaaccucaagacgagcuuccacugcuacggcgccugcaccaaguacgaguaccccuggcacaccgccaagugccacuacgagcgcgacuaccaguacgagaccuccugggggugcaacccgagcgacugccccggcguggggacgggcugcaccgcgugcggccuguaccuggaccagcucaagcccgugggguccgccuacaagaucaucaccauccgguacagccgccgggucugcgugcaguucggcgaggagaaccugugcaagaucaucgacaugaacgacugcuucgugucccgccacgucaaggugugcaucaucgggaccgugagcaaguucucccagggcgacacgcugcuguucuucgggccccuggagggcggcgggcugaucuucaagcacuggugcaccagcacgugccaguucggcgacccgggggacaucaugagcccccgggacaagggcuuccucugccccgaguuccccgggagcuuccgcaagaagugcaacuucgccaccaccccggucugcgaguacgacggcaacaugguguccggcuacaagaaggugauggccaccaucgacagcuuccaguccuucaacaccagcaccaugcacuucacggacgagcggaucgaguggaaggaccccgacgggaugcugcgcgaccacaucaacauccuggucaccaaggacaucgacuucgacaaccucggcgagaaccccugcaagaucgggcugcagaccuccagcaucgagggcgccuggggguccggcgugggcuucacccugacgugccucaucagccugaccgagugcagcaccuuccugaccuccaucaaggcgugcgacaaggccaucugcuacggggccgagagcgugacgcucauccggggccagaacaccgucaagguguccgggaagggcgggcacagcggcuccagcuucaagugcugccacggcgaggagugcucccagaucgggcugcacgccgccgcgccccaccuggacaaggugaacggcaucagcgagauggagaacuccaaggucuucgacgacggggccccgcagugcggcaucaagugcugguucgucaagagcggcgaguggaucuccgggaucuucagcggcaacuggaucgugcucaucgugcugugcguguuccuccucuucucccugguccugcucagcauccugugccccgugcgcaagcacaagaaguccuga

SEQ ID NO: 11724 - RNA, 3408 nt, Artificial Sequence
  derived and/or modified CDS sequence (opt1) from HTNV(Bao14)__AB127995.1__GP
augggcauguggaaguggcuggugaucgccagccucgucuggcccgcccuggcgcugcgcaacguguacgacaugaagaucgagugcccgcacaccguguccuucggggagaacagcgucaucggcuacguggagcucccccccaugccccuggccgacaccgcccagauggugccggaguccagcugcuccauggacaaccaccagagcaucaacacgaucaccaaguacacccaggucaucuggcgggggaaggccgaccccggccaguccagccagaacuccuucgagaccgugagcacggagguggaccugaaggggaccugcguccucaagcacaagaugguggaggaguccuaccgcagccggaaguccaucaccugcuacgaccugagcugcaacuccaccuacugcaagcccacgcuguacaugaucgugcccauccacgccugcaacaugaugaagagcugccucaucgcgcugggcccguaccgcguccaggugguguacgagcggaccuacugcaugaccggcguccugaucgaggggaagugcuucgugcccgaccaguccguggucagcaucaucaagcacggcaucuucgacaucgccuccgugcacaucgugugcuucuucgucgccgugaaggggaacaccuacaagcucuucgagcaggugaagaagagcuucgagagcacgugcaacgacaccgagaacaagguccagggcuacuacaucugcaucguggggggcaacuccgcccccaucuacguccccacccuggacgacuuccgcagcauggaggcguucaccggcaucuucaaguccccgcacggggaggaccacgaccuggccggcgaggagaucgccagcuacuccaucguggggcccgccaacgccaaggugccccacagcgcguccagcgacacgcucucccugaucgccuacagcggcauccccuccuacagcucccugagcauccucaccuccagcaccgacgccaagcacgucuucuccccgggccuguuccccaagcugaaccacaccaacugcgacaagagcgccaucccccucacguggaccgggaugaucgaccugcccggcuacuacgaggccauccacccgugcaccguguucugcgugcuguccgggcccggcgcgagcugcgaggccuucagcgaggggggcaucuucaacaucaccucccccaugugccucgucagcaagcagaaccgguuccgccugacggagcagcaggugaacuucgugugccagcgggucgacauggacaucgugguguacugcaacggccagcgcaaggucauccugaccaagacccucgugaucgggcagugcaucuacaccaucacgucccuguucagccugcuccccggcguggcccacuccaucgccgucgagcugugcgugccgggguuccacggcugggccaccgcggcccugcucgugaccuucugcuucggguggguccugauccccgccgugaccuucaucauccugacggugcucaaguucaucgccaacaucuuccacaccagcaaccaggagaaccggcugaaguccguccugcgcaagaucaaggaggaguucgagaagaccaagggcagcauggugugcgacgugugcaaguacgagugcgagaccuacaaggagcucaaggcccacggcgucuccugcccccagagccagugccccuacugcuucacgcacugcgagccgaccgaggcggccuuccaggcccacuacaaggugugccaggugacccaccgguuccgcgacgaccugaagaagaccgucaccccccagaacuucacgcccgggugcuaccggacccugaaccucuuccgcuacaagucccggugcuacaucuucaccauguggguguuccugcugauccucgagagcgugcugugggccgcguccgccagcgagaccccgcugacgcccgucuggaacgacaacgcccacggcgugggguccgugcccaugcacaccgaccucgagcuggacuucagccugaccuccagcagcaaguacaccuaccgccggaagcugacgaacccccucgaggaggcccaguccaucgaccugcacaucgagaucgaggagcagaccaucggcgucgacgugcacgcccuggggcacugguucgacggccgccucaaccugaagaccagcuuccacugcuacggcgcgugcaccaaguacgaguacccguggcacacggccaagugccacuacgagcgggacuaccaguacgagaccuccugggggugcaaccccagcgacugccccggcguggggaccggcugcaccgccugcggccuguaccucgaccagcugaagcccgucggguccgccuacaagaucaucacgauccgcuacagccgccgggugugcgugcaguucggcgaggagaaccugugcaagaucaucgacaugaacgacugcuucgucucccgccacgugaaggugugcaucaucgggaccgucagcaaguucucccagggcgacacccuccuguucuucgggccgcuggagggcggcgggcucaucuucaagcacuggugcaccagcacgugccaguucggcgaccccggggacaucauguccccccgggacaagggcuuccugugccccgaguucccggggagcuuccgcaagaagugcaacuucgccaccacccccaucugcgaguacgacggcaacaugguguccggcuacaagaaggugauggcgaccaucgacagcuuccaguccuucaacacgagcaccaugcacuucaccgacgagcggaucgaguggaaggaccccgacgggaugcugcgcgaccacaucaacauccucgucaccaaggacaucgacuucgacaaccugggcgagaaccccugcaagaucgggcugcagacguccagcaucgagggcgccuggggguccggcgugggcuucacccucaccugccuggugagccugaccgagugcccgacguuccucaccagcaucaaggccugcgacaaggccaucugcuacggggccgaguccgucacccugacccggggccagaacacggugcgcgugagcgggaagggcgggcacuccggcagcaccuucaagugcugccacggcgaggacugcuccaagaucgggcugcacgcggccgccccccaccucgacaaggucaacggcaucagcgagaucgagaacuccaagguguacgacgacggggccccccagugcggcaucaagugcugguucgucaagagcggcgaguggaucuccgggaucuucagcggcaacuggaucgugcugaucgugcugugcgucuuccuccuguucucccuggugcuccugagcauccugugccccgugcggaagcacaagaaguccuga

SEQ ID NO: 11725 - RNA, 3408 nt, Artificial Sequence
  derived and/or modified CDS sequence (opt1) from HTNV(HubeiHu02)__JQ665881.1__GP
augggcaucuggaaguggcuggugauggccagccucgucuggcccgccuucgcccugcgcaacguguacgacaugaagaucgagugcccgcacaccguguccuucggggagaacagcgucaucggcuacguggagcugccgcccaugccccucgccgacaccgcccagauggugcccgaguccagcugcuccauggacaaccaccagagccugaacacgaucaccaaguacacccagaucgucuggcgggggaaggccgaccagucccagagcucccagaacagcuucgagaccguguccacggagguggaccugaaggggaccugcguccucaagcacaagaugguggaggagagcuaccgcucccgcaagagcaucacgugcuacgaccuguccugcaacagcaccuacugcaagcccacccuguacaugaucgugcccauccacgccugcaacaugaugaaguccugccucaucgcgcuggggcccuaccggguccaggugguguacgagcggaccuacugcaugaccggcguccugaucgagggcaagugcuucgugccggaccagagcguggucuccaucaucaagcacgggaucuucgacaucgccagcgugcacaucgugugcuucuucgucgccgugaagggcagcaccuacaagcuguucgagcaggucaagaaguccuucgagagcaacugcaacgacacggagaacaaggugcaggggcacuacaucugcaucgugggcgggaacuccgcccccaucuacguccccacccuggacgacuuccgcagcauggaggcguucuccggcaucuucaagagcccccacggcgaggaccacgaccuggccggggaggagguggccuccuacagcaucgugggcccggccaacgccaaggucccccacuccgcgagcuccgacacccucagccugaucgccuacuccgggauccccagcuacuccagccuguccauccucaccagccugacggaggccaagcacguguucucccccggccuguucccgcagcucaaccacaccaagugcgacaagaccgccaucccccugaccuggacgggcaugaucgaccugcccggguacuacgaggccgugcaccccugcaccgucuucugcgugcucagcggcccgggggcgagcugcgaggccuucuccgagggcgggauccugaacaucaccagccccaugugccugguguccaagcagaaccgguuccgccucaccgagcagcaggucaacuucgugugccagcggguggacgucgacaucgugguguacugcaacggccagcgcaaggucauccugacgaagacccuggugaucggccagugcaucuacaccaucaccagccucuucucccugcugcccgggguggcccacagcaucgccgucgagcucugcgugcccggcuuccacgggugggccacggcggcccugcuggugaccuucugcuucggcuggguccucaucccggccaucaccuucaucauccugaccauccugaaguucaucgccaacaucuuccacacguccaaccaggagaaccggcucaagagcgugcugcgcaagaucaaggaggaguucgagcggaccaagggguccauggugugcgacgucugcaaguacgagugcgagaccuacaaggagcugaaggcccacggcgugagcugcccccagucccagugccccuacugcuucacccacugcgagcccacggaggcggccuuccaggcccacuacaaggugugccaggucacccaccgcuuccgggacgaccucaagaagaccgugaccccgcagaacuucacccccggcugcuaccgcacgcugaaccuguuccgguacaagagccgcugcuacaucuucaccauguggguguuccuccugguccuggaguccauccucugggccgcgagcgccuccgagacgccccugaacccgguguggaacgacaacgcccacggggugggcagcguccccaugcacaccgaccuggagcuggacuucucccucaccagcagcuccaaguacaccuaccggcgcaagcugaccaacccccuggaggagagccaggccaucaaccuccacaucgagaucgaggagcagaccaucgggguggacgugcacgcccugggccacugguucgacgggcggcugaaccucaagacguccuuccacugcuacggcgcgugcaccaaguacgaguaccccuggcacaccgccaagugccacuacgagcgcgacuaccaguacgagaccagcuggggcugcaacccguccgacugccccggggucggcacggggugcaccgccugcggccuguaccuggaccagcucaagcccgugggcagcgccuacaagaucaucaccauccgcuacucccggcgcgugugcguccaguucggggaggagaaccugugcaagaucaucgacaugaacgacugcuucgugagccggcacgugaaggucugcaucaucggcaccguguccaaguucagccagggggacacgcuccucuucuucggcccccuggagggcggcggccugaucuucaagcacuggugcaccuccacgugccaguucggggacccgggcgacaucaugagcccccgcgacaagggguuccucugccccgaguuccccggcuccuuccggaagaagugcaacuucgccaccaccccgaucugcgaguacgacgggaacauggugagcggcuacaagaaggucauggcgaccaucgacuccuuccagagcuucaacaccuccaccaugcacuucacggacgagcgcaucgaguggaaggaccccgacggcaugcugcgggaccacaucagcauccuggugaccaaggacaucgacuucgacaaccucggggagaaccccugcaagaucggccugcagaccuccagcaucgagggggccuggggcagcggggugggcuacacccugacgugccucaucucccugaccgagugccccaccuuccugaccagcaucaaggccugcgacaaggccaucugcuacggcgccgaguccgucacgcucacccgcgggcagaacaccgugaaggugagcggcaagggcgggcacuccgggagcuccuucaagugcugccacggcgaggacugcagccagaucggccugcacgcggccgccccgcaccuggacaaggucaacgggaucuccgagaucgagaacagcaagguguucgacgacggcgcgccccagugcgggaucaagugcugguucgucaaguccggcgaguggaucagcggcaucuucaacgggaacuggaucgugcucaucgugcugugcgucuuccuccuguucucccuggugcugcucagcauccugugccccgugcggaagcacaagaaguccuga

SEQ ID NO: 11726 - RNA, 3408 nt, Artificial Sequence
  derived and/or modified CDS sequence (opt1) from HTNV(HV004)__JQ083394.1__GP
augggcaucuggaaguggcuggugauggccagccucgucuggcccgccuucgcccugcgcaacguguacgacaugaagaucgagugcccgcacaccguguccuucggggagaacagcgucaucggcuacguggagcugccgcccaugccccucgccgacaccgcccagauggugcccgaguccagcugcuccauggacaaccaccagagccugaacacgaucaccaaguacacccagaucaucuggcgggggaaggccgaccagucccagagcucccagaacagcuucgagaccgucuccacggagguggaccugaaggggaccugcgugcucaagcacaagauggucgaggagagcuaccgcucccggaaguccaucacgugcuacgaccuguccugcaacagcaccuacugcaagcccacccuguacaugaucgugcccauccacgccugcaacaugaugaaguccugccucaucgcgcuggggcccuaccgcgugcaggucguguacgagcggaccuacugcaugaccggcgugcugaucgagggcaagugcuucgucccggaccagagcgugguguccaucaucaagcacgggaucuucgacaucgccagcguccacaucgugugcuucuucguggccgucaagggcagcaccuacaagcuguucgagcaggucaagaaguccuucgagagcaacugcaacgacacggagaacaaggugcagggguacuacaucugcaucgugggcgggaacuccgcccccaucuacgugcccacccucgacgacuuccgcagcauggaggcguucuccggcaucuucaagagcccccacggcgaggaccacgaccuggccggggaggaggucgccuccuacagcaucgugggcccggccaacgccaaggugccccacuccgcgagcuccgacacccucagccugaucgccuacuccgggauccccagcuacuccagccuguccauccucaccagcuccacggaggccaagcacgucuucagccccggccuguucccgcagcugaaccacaccaagugcgacaagaccgccaucccccucaccuggacgggcaugaucgaccugcccggguacuacgaggccauccaccccugcaccguguucugcgugcugagcggcccgggggcguccugcgaggccuucagcgagggcgggaucuucaacaucaccucccccaugugccucgucagcaagcagaaccgguuccgccugaccgagcagcaggucaacuucgugugccagcggguggacguggacaucguggucuacugcaacggccagcgcaaggugauccugacgaagacccucgugaucggccagugcaucuacaccaucaccucccuguucagccugcuccccggggucgcccacuccaucgccguggagcugugcgugcccggcuuccacgggugggccacggcggcccugcucgucaccuucugcuucggcugggugcugaucccggccaucaccuucaucauccugaccauccucaaguucaucgccaacaucuuccacacgagcaaccaggagaacaagcugaaguccgugcugcggaagaucaaggaggaguucgagcgcaccaaggggagcauggucugcgacgugugcaaguacgagugcgagaccuacaaggagcucaaggcccacggcguguccugcccccagagccagugccccuacugcuucacccacugcgagcccacggaggcggccuuccaggcccacuacaaggucugccaggugacccaccgguuccgcgacgaccugaagaagaccgugaccccgcagaacuucacccccggcugcuaccggacgcugaaccucuuccgcuacaagucccggugcuacaucuucaccaugugggucuuccugcuggugcucgagagcauccugugggccgcguccgccagcgagacgccccugaacccgguguggaacgacaacgcccacggggucggcuccgugcccaugcacaccgaccucgagcuggacuucagccugaccagcuccagcaaguacaccuaccgccggaagcugaccaacccccucgaggagucccaggccaucaaccugcacaucgagaucgaggagcagaccaucgggguggacguccacgcccugggccacugguucgacgggcgccucaaccugaagacgagcuuccacugcuacggcgcgugcaccaaguacgaguaccccuggcacaccgccaagugccacuacgagcgggacuaccaguacgagaccuccuggggcugcaacccgagcgacugccccggggugggcacggggugcaccgccugcggccuguaccucgaccagcugaagcccgugggcuccgccuacaagaucaucaccauccgcuacagccgccgggucugcgugcaguucggggaggagaaccugugcaagaucaucgacaugaacgacugcuucgugucccgccacgucaaggugugcaucaucggcaccgugagcaaguucucccagggggacacgcuccuguucuucggcccccuggagggcggcggccucaucuucaagcacuggugcaccagcacgugccaguucggggacccgggcgacaucaugagcccccgggacaagggguuccugugccccgaguuccccggcagcuuccgcaagaagugcaacuucgccaccaccccgaucugcgaguacgacgggaacauggucuccggcuacaagaaggugauggcgaccaucgacagcuuccaguccuucaacaccagcaccaugcacuucacggacgagcggaucgaguggaaggaccccgacggcaugcugcgcgaccacaucaacauccucgugaccaaggacaucgacuucgacaaccugggggagaaccccugcaagaucggccugcagaccuccagcaucgagggggccuggggcagcggggucggcuucacccucacgugccugaucucccugaccgagugccccaccuuccucaccagcaucaaggccugcgacaaggccaucugcuacggcgccgaguccgugacgcugacccgggggcagaacaccgugaaggucagcggcaagggcgggcacuccgggagcuccuucaagugcugccacggcgaggacugcagccagaucggccugcacgcggccgccccgcaccucgacaaggugaacgggaucuccgagaucgagaacagcaagguguucgacgacggcgcgccccagugcgggaucaagugcugguucgucaaguccggcgaguggaucagcggcaucuucaacgggaacuggaucgugcugaucguccugugcguguuccuccuguucucccuggugcuccugagcauccugugccccguccgcaagcacaagaaguccuga

SEQ ID NO: 11727 - RNA, 3405 nt, Artificial Sequence
  derived and/or modified CDS sequence (opt1) from HTNV(NC167)__AB027115.2__GP
auguggggccugcucguggucgccgggcugaucggccccugcaucagccugcgcaacguguacgacaugaagaucgagugcccgcacaccgugaacuucggggagaacagcgucaucggcuacguggagcucccgcccgugcccaucgccgacaucacccagaugguccccgagagcuccugcaacauggacaaccaccagagccuguccacguucaccaaguacacccagcugaucuggcggaagaaggcggagcaggcccaggccagccagaacuccuucgagaccgugagccgcgagguggacuucaaggggacgugcgucuucaagcacaagaugguggaggaguccuacaagaaccgcaagagcaucaucugcuacgaccucuccugcaacaucacccacugcaagcccacccuguacaugaucauccccgugcacgccugcaacaugaugaaguccugccugaucgcccucggccccuuccggguccaggugguguacgagcggaccuacugcaugagcggcauccugacggaggggcgcugcuucgucccguaccagagcgugguguccaucaucaagcacggcaucuucgacaucgcgagcauccacaucaucugcuucuucaucgccgucgaggggaacaccuacaagcuguucgaggaggugaagaaguccuucgcccucaacugcaacgacaccgagaacaagauccagggcuacuacaucugcaucaucgggggcaacagcgcccccguguacgcgcccucccccgacgacuuccggagcauggaggccuucagcggcaucuuccgcuccccgcacggggagaaccacgaccugaacggcgggcggaacgcccccuacagcaucgucggccccaccgacggcaaggugccccacuccagcaagcacuacaacaucgaguucgacuccaucuuccagaaguucccgacguacagcuccuucagcauccuggccggguccguggagcccaagcacgucuuccagcccggccucuuccccaagcugaaccacaccaagugcaccaagagcgccaucccgcugguguggaccgggcgcaucgacauccccggcuacuacgaggcgguccacccccucacgguguacugcgagcuguccgggcccggcgccagcugcgaggccuucuccgagggcgggaucuucaacaucaccagcccgaugugccugguguccaagcagaaccgguuccgcagccuccggcagcaggucuccuucgugugccagcgcguggacauggacaucgucguguacugcaacggccagaagaagaccauccugaccaagacgcuggugaucgggcagugcaucuacaccaucaccagccucuucucccugcugcccagcgucgcccacagcaucgccguggagcucugcgugcccggcuuccacgggugggcgaccgccgcccugcugaucacguucugcuucggcuggguccucauccccgcccugaccuucaucauccugaccauccucaaguucaucgccaacaucuuccacaccuccaaccaggagaacaagcugaaggcggugcugcggaagaucaaggaggaguucgagaagacgaagggcagcauggugugcgacaucugcaaguacgagugcgacaccuacaaggagcucaaggcccacgggcuguccugcccgcagagccagugccccuacugcuucacccacugcgagcccaccgaguccgccuuccaggcccacuacaaggucugccaggugacgcaccgcuuccgggaggagcugaagaagaccgugaccccgcagaacuucacccccggcugcuaccgcacgcucaaccuguuccgguacaagagccgcugcuacaucuucaccauguggauccugcuccuggucuucgaguccauccugugggccgcgagcgccuccgacgugccccucagcaccgacuggaacgacaacgcccacggggugggcuccguccccaugcacaccgaccuggagcuggacuucagccucaccuccagcuccaaguacacguaccggcgcaagcugaccaacccgguggacaccagccaggccguggaccugcacaucgagcuggaggagcagaccaucgggcucgacguccacgcgcugggccacugguucgacggccgccugaaccucaagacguccuuccacugcuacggggccugcaccaaguacgaguaccccuggcacaccgccaagugccacuucgagcgggacuuccaguacgagaccagcuggggcugcaacccgcccgacugccccggggugggcacgggcugcaccgccugcgggcuguacaucgaccagcugcgccccgugggcaacgccuacaagaucaucaccauccgguacagccgcaaggucugcgugcaguucggggacgagaaccucugcaagaccaucgacaugaacgacugcuucguguccaagcacgucaaggugugcaucaucggcacggugagcaaguucucccagggggacacccugcuguuccucggccccauggagggcgggggcaucaucuucaagcacuggugcaccagcacgugccaguucggggaccccggcgacaucauguccccgaaggacaagggguucagcugccccgaguucuccggcagcuuccggaagaagugcaacuucgcgaccacccccgccugcgaguacggcgggaacauggucuccggcuaccgcaaggugauggccaccaucgacagcuuccaggccuucaacaccuccacgauccacuucaccgacgagcggaucgaguggaaggaccccgacgggaugcugcgcgaccacaucaacauccuggugacccgggacaucgacuucgacaaccucgccgagaacccgugcaagaucggccugcaggucagcgcgaucgagggggccuggggcuccggcgugggguucacccugacgugccaggugagccucaccgagugcuccaccuuccugaccagcaucaaggccugcgacaaggccaucugcuacggcgcccaguccgucacgcuggugcgcgggcagaacaccgugaagaucagcggcaagggcgggcacuccggcagcgcguucaagugcugccacggggaggacugcagccagaccggccuccaggccgacgcgccccaccuggacaaggucaacgggaucuccgagguggagaacgacaagguguacgacgacggcgcccccgagugcggcaucaagugcugguucgucaagagcggggaguggguggccggcaucuucuccgggaacuggaucgugcuggucgugcucugcaucuuccugaucaucagccugauccuccuguccauccugugccccgugcggaagcacaagaaguccuga

SEQ ID NO: 11728 - RNA, 3408 nt, Artificial Sequence
  derived and/or modified CDS sequence (opt1) from HTNV(WuhanAaJ10)__JQ665882.1__GP
augggcaucuggaaguggcuggugauggccagccucgucuggcccgccuucgcgcugcgcaacguguacgacaugaagaucgagugcccgcacaccguguccuucggggagaacagcgucaucggcuacguggagcugccgcccaugccccucgccgacaccgcccagauggugcccgaguccagcugcuccauggacaaccaccagagccugaacacgaucaccaaguacacccagaucaucuggcgggggaaggccgaccagucccagagcucccagaacagcuucgagaccgucuccacggagguggaccugaaggggaccugcgugcucaagcacaagauggucgaggagagcuaccgcucccgcaagagcaucacgugcuacgaccuguccugcaacagcaccuacugcaagcccgcccuguacaugaucgugcccauccacgcgugcaacaugaugaaguccugccucaucgcccuggggcccuaccgcgugcaggucguguacgagcggacguacugcaugaccggcgugcugaucgagggcaagugcuucgucccggaccagagcgugguguccaucaucaagcacgggaucuucgacaucgccagcguccacaccgugugcuucuucguggccgucaagggcagcaccuacaagcuguucgagcaggcgaagaaguccuuccagagcaacugcaacgacacggagaacaaggugcagggguacuacaucugcaucgugggcggguccagcgcccccaucuacguccccacccuggacgacuuccgcuccauggaggccuucagcggccuguucaagagcccccacggcgaggaccacgaccucgccggggaggagguggccuccuacuccaucgucggcccggcgaacgccaaggugccccacagcgccuccagcgacacccugucccugaucgccuacagcgggauccccuccuacagcucccucagcauccugaccuccagcacggaggccaagcacguguucagccccggccuguucccgcagcucaaccacaccaagugcgacaagaccgcgaucccccugaccuggacgggcaugaucgaccugcccggguacuacgaggccguccaccccugcaccguguucugcgugcucagcggcccgggcgccagcugcgaggccuucuccgagggcgggaucuucaacaucaccagccccaugugccucgucuccaagcagaaccgguuccggcugaccgagcagcaggucaacuucgugugccagcggguggacguggacaucaucguguacugcaacggccagcgcaaggucauccucaccaagacccuggugaucggccagugcaucuacaccaucaccagccugaucucccuccugcccgggguggcccacagcaucgcggucgagcugugcgugcccggcucccacgggugggccacggccgcccuccuggugaccuucugcuucggcuggguccugaucccggccaucaccuucaucauccucaccauccugaaguucaucgcgaacaucuuccacacgagcaaccaggagaaccggcugaaguccgugcuccgcaagaucaaggaggaguucgagcggaccaaggggagcauggugugcgacgucugcaaguacgagugcgagaccuacaaggagcugaaggcccacggcguguccugcccccagagccagugccccuacugcuucacccacugcgagcccacggaggccgccuuccaggcgcacuacaaggugugccaggucacccaccgcuuccgggacgaccugaagaagaccgugaccccgcagaacuucacccccggcugcuaccgcacgcucaaccuguuccgguacaagucccgcugcuacaucuucaccauguggguguuccugcucguccuggagagcauccugugggccgccuccgccagcgagacgccccucaacccgguguggaacgacaacgcccacggggugggcagcguccccaugcacaccgaccuggagcuggacuucucccugaccagcuccagcaaguacaccuaccggcgcaagcucaccaacccccuggaggagucccaggcgaucgaccugcacaucgagaucgaggaccagaccaucgggguggacgugcacgcccucggccacugguucgacgggcggcugaaccuggagacgagcuuccacugcuacggcgccugcaccaaguacgaguaccccuggcacaccgccaagugccacuacgagcgcgacuaccaguacgagaccuccuggggcugcagcccguccgacugccccggggucggcacggggugcaccgccugcggccucuaccuggaccagcugaagcccgugggcagcgcguacaagaucaucaccauccgcuacucccggcgcgugugcguccagagcggggaggagaaccucugcaagaucaucgacaugaacgacugcuucgugucccggcacgugaaggucugcaucaucggcaccgugagcaaguucucccagggggacacgcugcuguucuucggcccccucgagggcgggggccugaucuucaagcacuggugcaccuccacgugccaguucggggacccgggcgacaucaugagcccccgcgacaagggguuccugugccccgaguuccccggcagcuuccggaagaagugcaacuucgccaccaccccgaucugcgaguacgacgggaacaugguguccggcuacaagaaggucauggccaccaucgacagcuuccagagcuucaacaccuccaccaugcacuucacggacgagcgcaucgaguggaaggaccgggacggcaugcuccgcgaccacaucaacauccuggugaccaaggacaucgacuucgacaaccugggggagaaccccugcaagaucggccuccagaccagcuccaucgagggggccuggggcagcggggugggcuucacccugacgugccugaucucccucaccgagugccccaccuuccugaccagcaucaaggccugcgacaaggcgaucugcuacggcgccgaguccgucacgcugacccgggggcagaacaccgugaaggugagcggcaagggcgggcacuccgggagcuccuucaagugcugccacggcgaggacugcagccagaucggccuccacgccgccgcgccccaccuggacaaggucaacgggaucuccgagaucgagaacagcaagguguucgacgacggcgccccgcagugcgggaucaagugcugguccgucaagagcggcgaguggaucuccggcaucuucagcgggaacuggaucgugcugaucgugcucugcgucuuccugcuguucucccucgugcugcugagcauccucugccccgugcgcaagcacaagaaguccuga

SEQ ID NO: 11729 - RNA, 3408 nt, Artificial Sequence
  derived and/or modified CDS sequence (opt1) from HTNV(Z5)__EU074224.1__GP
augggcaucuggaaguggcuggugauggccagccucgucuggcccgccugcacccugcgcaacguguacgacaugaagaucgagugcccgcacaccguguccuucggggagaacagcgucaucggcuacguggagcugccgcccaugccccucgccgacacggcccagcuggugcccgaguccagcugcaacauggacaaccaccaguccaugaacaccaucaccaaguacacccaggucagcuggcgguccaagguggaccaggcccaggccagccagaacuccuucgaggccgugagcgcggaggucgaccugaaggggacgugcgugcucaagcacaagaugcuggaggaguccuaccgcagccggaaguccaucacgugcuacgaccugagcugcaacuccaccuacugcaagcccacccucuacaugaucgugcccauccacgccugcaacaugaugaagggcugccugaucgcccuggggcccuaccgcguccaggugguguacgagcggaccuacugcaugaccggcguccucaucgagggcaagugcuucgugccggaccagagcguggucuccaucaucaagcacgggaucuucgacaucgccagcgugcacaucgugugcuucuucgucgcggugaagggcaacaccuacaagcuguucgagcaggucaagaaguccuuccagagcacgugcaacgacaccgagaacaaggugcagggguacuacaucugcaucgugggcgggaacagcgcccccaucugcguccccacccuggacgacuuccgcuccauggaggccuucagcggcaucuuccggagcccccacggcgaggaccacgaccucgccggggaggagaucgccagcuacuccaucgugggcccggcgaacgccaaggugccccacagcgccuccagcgacacccugucccugaucgccuacagcgggauccccuccuacagcucccucagcauccuggccggcuccaccgaggcgaagcacgucuucagccccggcuucuucccgcagcugaaccacacgaagugcgacaagaccgccaucccccucaccuggaccgggaugaucgaccugcccggcuacuacgaggccauccaccccugcacgguguucugcgugcuguccgggccgggcgccagcugcgaggccuucuccgagggcgggaucuucaacaucaccagccccaugugccucgucagcaagcagaaccgcuuccggcugaccgagcagcaggucaacuucgugugccagcgcguggacauggacaucaucguguacugcaacggccagcggaaggugauccugaccaagacgcucgucaucgggcagugcaucuacaccaucaccucccuguucagccugcuccccggcguggcgcacuccaucgccguggagcugugcguccccggguuccacggcugggccaccgccgcccugcucgugacguucugcuucgggugggugcugaucccggcgaucaccuucgucauccugaccauccucaaguucaucgccaacaucuuccacaccagcaaccagggcaaccgccugaaguccgugcugaagaagaucaaggaggaguucgagaagacgaagggcagcauggugugcgacgucugcaaguacgagugcgagaccuacaaggagcucaaggcccacgggguguccugcccccagagccagugccccuacugcuucacccacugcgagcccaccgaggccgcguuccaggcccacuaccgggugugccaggucacgcaccgcuuccgggacgaccugaagaagaccgugaccccgcagaacuucacccccggcugcuaccgcacccugaaccucuuccgguacaagucccgcugcuacaucuucacgaugugggugugccugcugguccucgagagcauccugugggccgccuccgccagcgaggugccccugaacccgaucuggaacgacaacgcgcacggggugggcuccguccccaugcacaccgaccucgagcuggacuucagccugaccuccagcuccaaguacaccuaccggcgccggcugacgaacccccucgaggagacccaggccaucaaccugcacaucgagaucgaggagcagaccaucgggguggacgugcacgcccugggccacugguucgacggccgccucaaccugaagaccagcuuccacugcuacggggccugcacgaaguacgaguaccccuggcacaccgccaagugccacuacgagcgcgacuaccaguacgagaccagcuggggcugcaacccggcggacugccccggggucggcaccggcugcacggccugcgggcuguaccucgaccagcugaagcccgugggcuccgccuacaagaucaucaccauccgguacagccgcaaggugugcguccaguucggggaggagaaccugugcaaggugaucgacaugaacgacugcuucgugucccggcacgucaaggugugcaucaucggcaccgugagcaaguucucccagggggacacccuccuguucuucggcccccuggagggcgggggccucaucuucaagcacuggugcacgagcacgugccaguucggggacccgggcgacaucaugagcccccgcgacaagggguuccugugccccgaguuccccggcuccuuccggaagaagugcaacuucgccaccaccccgcugugcgaguacgacggcaacauggucuccggguacaagaaggugauggccaccaucgacagcuuccaguccuucaacaccagcaccaugcacuucaccgacgagcgcaucgaguggaaggaccccgacggcaugcuccgggaccacaucaacauccuggugacgaaggacaucgacuucgacaaccugggggagaaccccugcaaggucggccuccagaccuccagcaucgagggggcguggggcuccggcgugggguucacccugaccugccuggugagccucacggagugccccaccuuccugaccuccaucaaggccugcgacaaggccaucugcuacggcgccgagagcgucacccugacgcgcgggcagaacaccgugaagguguccggcaagggcgggcacagcggcagcaccuucaagugcugccacggggaggagugcucccagaucggccuccacgcggccgccccgcaccuggacaaggucaacgggaucagcgagaucgagaacaacaagguguacgacgacggcgcgccccagugcggcgucaagugcugguucgugaaguccggggaguggaucagcggcaucuucuccgggaacuggaucgugcugaucguccucugcguguuccugcuguucagccucgcccugcuguccgugcucugccccguccggcgccacaagaaguccuga

SEQ ID NO: 11730 - RNA, 3408 nt, Artificial Sequence
  derived and/or modified CDS sequence (opt1) from HTNV(ZLS-12)__FJ753399.1__GP
augggcaucuggaaguggcugaucauggccagccucguguggcccgccuacacccugcgcaacgucuacgacaugcggaucgagugcccgcacaccgugagcuucggggagaacagcgugaucggcuacgucgagcugccgcccaugccccucgccgacacgucccagauggugcccgagagcuccugcagcauggacaaccaccagucccugaacaccaucaccaaguacacccaggugagcuggcgcgggaaggccgaccagucccaggccagccagaacuccuucgaggccgucagcgccgagguggaccugaagggcacgugcgugcucaagcacaagaugcuggaggaguccuaccggagccgcaaguccaucacgugcuacgaccugagcugcaacuccaccuacugcaagcccacccucuacaugaucguccccauccacgcgugcaacaugaugaaguccugccugaucgcccuggggcccuaccggguccaggugguguacgagcgcaccuacugcaugaccggcauccucaucgagggcaagugcuucgugccggaccagagcguggucagcaucaucaagcacgggaucuucgacaucgccagcgugcacaucgugugcuucuucgucgccgugaagggcaacaccuacaagcuguucgagcaggucaagaaguccuuccagagcacgugcaacgacaccgaggacaaggugcagggguacuacaucugcaucgcgggcgggaacuccgcccccaucuacgugcccacccuggacgacuuccggagcauggaggccuucuccggcaucuucaagagcccccacggcgaggaccacgaccucgccggggaggagaucgccuccuacagcaucgugggcccggcgaacgccaaggucccccacuccgccagcuccgacacccugagccugaccgccuacuccgggauccccagcuacuccagccucuccauccugacgagcuccaccgaggccaagcacguguucagccccggcuucuucccgcagcugaaccacaccaagugcgacaagaccgcgaucccccucauguggacgggcaugaucgaccugcccggguacuacgaggccauccaccccugcaccgucuucugcgugcugagcggcccgggggccuccugcgaggccuucagcgagggcgggaucuucaacaucaccucccccaugugccucgugagcaagcagaaccgcuuccggcugaccgagcagcaggucaacuucgugugccagcgcguggacauggacaucgucguguacugcaacggccagcggaaggugauccugacgaagacccucgucaucggccagugcaucuacaccaucaccucccuguucagccugcuccccgggguggcccacuccaucgcgguggagcugugcguccccggcuuccacgggugggccacggccgcccugcucgugaccuucugcuucggcugggugcugaucccggccaucaccuucaucauccugaccauccucaaguucaucgcgaacaucuuccacacgagcaaccaggagaaccgccugaaguccguccugcggaagaucaaggaggaguucgagaagaccaaggggagcauggugugcgacgugugcaaguacgagugcgagaccuacaaggagcucaaggcccacggcgucuccugcccccagagccagugccccuacugcuucacccacugcgagcccacggaggccgccuuccaggcgcacuaccgcgugugccaggugacccaccgguuccgcgacgaccugaagaagaccgucaccccgcagaacuucacccccggcugcuaccggacgcugaaccucuuccgcuacaagucccggugcuacaucuucaccauguggguguuccugcuggugcucgagagcauccugugggccgccuccgccagcgaggucccccuguccccgguguggaacgacaacgcccacggggugggcagcauccccaugcacaccgaccucgagcuggacuucagccugaccuccagcuccaaguacacguaccgccggaagcugaccaacccccucgaggagacccaggcgaucaaccugcacaucgagaucgaggagcagaccaucggggucgacgugcacgcccugggccacugguucgacgggcgccucaaccugaagacgagcuuccacugcuacggcgccugcaccaaguacgaguaccccuggcacaccgccaagugccacuacgagcgcgacuaccaguacgagaccuccuggggcugcaacccggccgacugccccggggugggcacggggugcaccgcgugcggccuguaccucgaccagcugaagcccgucggcagcgccuacaagaucaucaccauccgguacucccgccgggugugcgugcagcugggggaggagaaccucugcaagaucaucgacaugaacgacugcuucgucagccgccacgugaaggugugcaucaucggcaccgucuccaaguucagccagggggacacgcugcuguucuucggcccccucgagggcgggggccugaucuucaagcacuggugcaccuccacgugccaguucggggacccgggcgacaucaugagcccccgggacaagggguuccugugccccgaguuccccggcuccuuccgcaagaagugcaacuucgccaccaccccgcucugcgaguacgacgggaacauggugagcggcuacaagaaggugauggccaccaucgacuccuuccagagcuucaacaccuccaccaugcacuucacggacgagcggaucaaguggaaggaccccgacggcaugcugcgcgaccacaucaacauccuggucaccaaggacaucgacuucgacaaccucggggagaaccccugcaagaucggccugcagaccagcgccaucgagggggcguggggcuccggggugggcuucacccugacgugccucgugagccugaccgagugccccaccuuccugaccagcaucaaggccugcgacaaggccaucugcuacggcgccgaguccgucacgcucacccgggggcagaacaccgugaaggugagcggcaagggcgggcacuccgggagccuguucaagugcugccacggcgaggagugcucccagaucggccugcacgcggccgccccgcaccucgacaaggucaacgggaucagcgagaucgagaacaacaagguguacgacgacggcgcgccccagugcggggugaagugcugguucgucaaguccggcgaguggaucagcggcaucuucuccgggaacuggaucgugcugaucgugcugugcgucuuccuccuguucagccuggugcuccuguccguccugugccccgugcgcaagcacaagaaguccuga

SEQ ID NO: 11731 - RNA, 3408 nt, Artificial Sequence
  derived and/or modified CDS sequence (opt1) from HTNV(ZLS6-11)__FJ753397.1__GP
augggcaucuggaaguggcugaucauggccagccucguguggcccgccuacacccugcgcaacgucuacgacaugcggaucgagugcccgcacaccgugagcuucggggagaacagcgugaucggcuacgucgagcugccgcccaugccccucgccgacacgucccagauggugcccgagagcuccugcagcauggacaaccaccagucccugaacaccaucaccaaguacacccaggugagcuggcgcgggaaggccgaccagucccaggccagccagaacuccuucgaggccgucagcgccgagguggaccugaagggcacgugcgugcucaagcacaagaugcuggaggaguccuaccggagccgcaaguccaucacgugcuacgaccugagcugcaacuccaccuacugcaagcccacccucuacaugaucguccccauccacgcgugcaacaugaugaaguccugccugaucgcccuggggcccuaccggguccaggugguguacgagcgcaccuacugcaugaccggcauccucaucgagggcaagugcuucgugccggaccagagcguggucagcaucaucaagcacgggaucuucgacaucgccagcgugcacaucgugugcuucuucgucgccgugaagggcaacaccuacaagcuguucgagcaggucaagaaguccuuccagagcacgugcaacgacaccgaggacaaggugcagggguacuacaucugcaucgcgggcgggaacuccgcccccaucuacgugcccacccuggacgacuuccggagcauggaggccuucuccggcaucuucaagagcccccacggcgaggaccacgaccucgccggggaggagaucgccuccuacagcaucgugggcccggcgaacgccaaggucccccacuccgccagcuccgacacccugagccugaccgccuacuccgggauccccagcuacuccagccucuccauccugacgagcuccaccgaggccaagcacguguucagccccggcuucuucccgcagcugaaccacaccaagugcgacaagaccgcgaucccccucauguggacgggcaugaucgaccugcccggguacuacgaggccauccaccccugcaccgucuucugcgugcugagcggcccgggggccuccugcgaggccuucagcgagggcgggaucuucaacaucaccucccccaugugccucgugagcaagcagaaccgcuuccggcugaccgagcagcaggucaacuucgugugccagcgcguggacauggacaucgucguguacugcaacggccagcggaaggugauccugacgaagacccucgucaucggccagugcaucuacaccaucaccucccuguucagccugcuccccgggguggcccacuccaucgcgguggagcugugcguccccggcuuccacgggugggccacggccgcccugcucgugaccuucugcuucggcugggugcugaucccggccaucaccuucaucauccugaccauccucaaguucaucgcgaacaucuuccacacgagcaaccaggagaaccgccugaaguccguccugcggaagaucaaggaggaguucgagaagaccaaggggagcauggugugcgacgugugcaaguacgagugcgagaccuacaaggagcucaaggcccacggcgucuccugcccccagagccagugccccuacugcuucacccacugcgagcccacggaggccgccuuccaggcgcacuaccgcgugugccaggugacccaccgguuccgcgacgaccugaagaagaccgucaccccgcagaacuucacccccggcugcuaccggacgcugaaccucuuccgcuacaagucccggugcuacaucuucaccauguggguguuccugcuggugcucgagagcauccugugggccgccuccgccagcgaggucccccuguccccgguguggaacgacaacgcccacggggugggcagcauccccaugcacaccgaccucgagcuggacuucagccugaccuccagcuccaaguacacguaccgccggaagcugaccaacccccucgaggagacccaggcgaucaaccugcacaucgagaucgaggagcagaccaucggggucgacgugcacgcccugggccacugguucgacgggcgccucaaccugaagacgagcuuccacugcuacggcgccugcaccaaguacgaguaccccuggcacaccgccaagugccacuacgagcgcgacuaccaguacgagaccuccuggggcugcaacccggccgacugccccggggugggcacggggugcaccgcgugcggccuguaccucgaccagcugaagcccgucggcagcgccuacaagaucaucaccauccgguacucccgcaaggugugcgugcaguucggggaggagaaccugugcaagaucaucgacaugaacgacugcuucgucagccggcacgugaaggugugcaucaucggcaccgucuccaaguucagccagggggacacgcuccuguucuucggcccccuggagggcgggggccucaucuucaagcacuggugcaccuccacgugccaguucggggacccgggcgacaucaugagcccccgcgacaagggguuccugugccccgaguuccccggcuccuuccggaagaagugcaacuucgccaccaccccgcugugcgaguacgacgggaacauggugagcggcuacaagaaggugauggccaccaucgacuccuuccagagcuucaacaccuccaccaugcacuucacggacgagcgcaucgaguggaaggaccccgacggcaugcuccgggaccacaucaacauccuggucaccaaggacaucgacuucgacaaccugggggagaaccccugcaagaucggccuccagaccagcgccaucgagggggcguggggcuccggggugggcuucacccugacgugccuggugagccucaccgagugccccaccuuccugaccagcaucaaggccugcgacaaggccaucugcuacggcgccgaguccgucacgcugacccgcgggcagaacaccgugaaggugagcggcaagggcgggcacuccgggagccucuucaagugcugccacggcgaggagugcucccagaucggccugcacgcggccgccccgcaccuggacaaggucgacgggaucagcgagaucgagaacaacaagguguacgacgacggcgcgccccagugcggggugaagugcugguucgucaaguccggcgaguggaucagcggcaucuucuccgggaacuggaucgugcucaucgugcugugcgucuuccuccuguucagccuggugcugcucuccguccugugccccgugcggaagcacaagaaguccuga

SEQ ID NO: 11732 - RNA, 3408 nt, Artificial Sequence
  derived and/or modified CDS sequence (opt1) from HTNV__AB030232.1__GP
augggccuguggaaguggcucaucauggccgugcuggucuggcccugcuucgcccugcgcaacguguacgacaugaagaucgagugcccgcacaccgugaacuucggggagaacagcgucgugggcuacguggagcucccgcccaugcccaucgcggacaucacccagaugaugcccgaguccagcugcuccauggacaaccaccagagccugaacacgaucaccaaguacacccaggucuccuggcggaagaaggccgaccgcgcccagagcucccagaccagcuucgagacgguguccagcgagguggacuucaaggggaccugcguccugaagcacaagaugguggaggacuccuaccggagccgcaaguccaucaucugcuacgaccucagcugcaacuccaccuucugcaagcccacccuguaccugaucgugcccguccacgccugcaacaugaugaaguccugccucaucgcccugggccccuaccgggugcaggacguguacgagcgcacguacugcaugagcgggguccugcucgagggcaagugcuucgugccggaccggagcguggucuccaucaucaagcacggcaucuucgacaucgcgagcgugcacaucgugugcuucuucgucgccaucaaggggagcaccuacaagauccuggagcaggucaagaaguccuucgagcugaccugcaacgacaccgacaacaagauccagggcuacuacaucugccucgucgggggcaacagcgcccccaucuacgugcccacgcuggacgacuuccgcuccauggaggccuucgcggggaucuucaagagcccccacggcgaggaccacgaccuggccggcgaggagguggccuccuacagcaucguggggccggccaacgccaaggugccccacuccgcgagcgccgacacccucucccugguggccuucagcggcauccccuccuacagcuccuucagcguccugaccggguccaccgacgcccggcacguguucagccccggcuucuucccgcagcucaaccagacgcgcugcgacaagaccgccaucccccugaccuggaccggcaugaucgaccugcccggguacuacgaggcggugcaccccugcacggucuucugcgugcucuccggcccgggggccagcugcgaggccuucuccgagggcgggaucuucaacaucaccagccccaugugccuggugagcgagcagaaccgguuccgcuccagcgagcagcaggucaacuucgugugccagcggguggacauggacaucgucguguacugcaacggccagaagaaggugauccugaccaagacccucgucaucggccagugcaucuacacgaucaccucccuguucagccugcuccccgggguggcccacuccaucgccguggagcugugcguccccggcuuccacgggugggcgaccgccgcccugcucgugaccuucugcuucggcugggugcugaucccggccgucacgcuggugauccucaccauccugaaguucaucgccaacaucuuccacaccagcaaccaggagaaccgccugaaguccgugcucaagaagaucaaggaggaguucgagaagaccaaggggagcauggucugcgacgugugcaaguacgagugcgagacguacaaggagcugaaggcgcacggcguguccugcccccagagccagugccccuacugcuucacccacugcgagcccaccgaggccgccuuccaggcccacuacaaggucugccaggugacccaccgguuccgcgacgaccugaagaagacggugaccccgcagaacuucacccccggcugcuaccggacccucaaccuguuccgcuacaagucccggugcuacaucuucaccaugugggucuuccugcucauccuggagagcauccugugggcggccuccgccagcgagacgcccuccaccccgaucuggaacgacaacgcccacggggugggcagcauccccaugcacaccgaccucgagcuggacuucucccugaccagcagcuccaaguacacguaccgccggaagcugaccaacccccucgagaagacccaggccguggaccugcacaucgagcuggcgguccagaccaucgggguggacgugcacgcccucggccacugguucgacgggcgccugaaccugaagacgagcuuccacugcuacggcgccugcaccaaguacgaguaccccuggcacaccgccaagugccacuacgagcgcgacuaccaguacgagaccuccuggggcugcaacccggccgacugccccggggucggcacggggugcaccgcgugcggccucuaccuggaccagcugaagcccgugggcagcgccuacaagaucaucaccaucaaguacucccggcgcgugugcguccaguucggggaggagaaccucugcaaggugaucgacaugaacgacugcuucgugagccggcacgucaagaucugcaucaucggcaccguguccaaguucagccagggggacacgcugcuguucuucggcccccucgagggcgggggccugaucuucaagcacuggugcaccuccacgugccaguucggggacccgggcgacaucaugagcccccgcgacaagggguuccugugccccgaguuccccggcuccuuccggaagaagugcaacuucgccaccaccccggugugcgaguacgacgggaacauggucagcggcuacaagaaggugauggccaccaucgacuccuuccagagcuucaacaccuccaugaugcacuucaccgacgagcgcaucgaguggaaggaccccgacggcaugcuccgggaccacaucaacauccuggugacgaaggacaucgacuucgacaaccugggggacaaccccugcaaggucggccuccagaccagcgccaucgagggggcguggggcuccggggugggcuucacccugaccugccaggugagccugacggagugccccaccuuccucaccuccaucaaggccugcgacaaggccaucugcuacggcgccgagagcaucacccugacgcgcgggcagaacaccgucaaggugagcggcaagggcgggcacuccgggagcaccuucaagugcugccacggcgaggagugcucccagaucggccugcacgcggccgccccgcaccucgacaaggucaacgggaucagcgagauggagaacuccaagguguacgacgacggcgcccccgagugcgggaucaagugcugguucgucaagagcggcgaguggaucuccggcaucuucaacgggaacuggaucgugcugaucgugcugugcgccuuccucaucuucagccuggugcugcucucccugcugugccccguccggaagcacaagaaggcguga

SEQ ID NO: 11733 - RNA, 3408 nt, Artificial Sequence
  derived and/or modified CDS sequence (opt1) from HTNV__AB620032.1__GP
augggcauguggaaguggcuggugaucgccagccucgucuggcccgugcuggcccugcgcaacguguacgacaugaagaucgagugcccgcacaccgucuccuucggggagaacagcgugaucggcuucguggagcucccccccaugccccuggcggacaccgcccagauggucccggaguccagcugcuccauggacaaccaccagagcaucaacacgaucaccaaguacacccaggugaccuggcgggggaaggccgaccccggccaguccagccagaacuccuucgagacggugagcaccgaggucgaccugaaggggaccugcgugcucaagcacaagaugguggaggaguccuaccgcagccggaaguccaucaccugcuacgaccugagcugcaacuccacguacugcaagcccacccuguacaugaucguccccauccacgccugcaacaugaugaagagcugccucaucgcccugggcccguaccgcgugcagguggucuacgagcggaccuacugcaugaccggcgugcugaucgaggggaagugcuucgugcccgaccaguccgucgugagcaucaucaagcacggcaucuucgacaucgcguccgugcacaucgucugcuucuucguggccaucaaggggaacacguacaagcucuucgagcaggugaagaagagcuucgagagcaccugcaacgacaccgagaacaagguccagggcuacuacaucugcaucguggggggcaacuccgcccccaucuacguccccacccuggacgacuuccgcagcauggaggccuucacgggcaucuucaaguccccgcacggggaggaccacgaccuggcgggcgaggagaucgccagcuacuccaucguggggcccgccaacgccaaggugccccacagcgccuccagcgacacccucucccugaucgcguacagcggcauccccuccuacagcucccugagcauccucaccuccagcaccgacgccaagcacgucuucuccccgggccuguuccccaagcugaaccacacgaacugcgacaagagcgccaucccccucaccuggaccgggaugaucgaccugcccggcuacuacgaggccauccacccgugcaccguguucugcgugcuguccgggcccggcgccagcugcgaggcguucagcgaggggggcaucuucaacaucacgucccccaugugccucgucagcaagcagaaccgguuccgccugaccgagcagcaggugaacuucgugugccagcgggucgacauggacaucgugguguacugcaacggccagcgcaaggucauccugaccaagacccucgugaucgggcagugcaucuacacgaucaccucccuguucagccugcuccccggcguggcccacuccaucgccgucgagcugugcgugccgggguuccacggcugggccaccgccgcgcugcucgugaccuucugcuucggguggguccugauccccgccgugacguucgugauccugaccauccucaaguucgucgccaacaucuuccacaccagcaaccaggagaaccggcugaaguccgugcugcgcaagaucaaggaggaguucgagaagaccaagggcagcauggugugcgacgucugcaaguacgagugcgagacguacaaggagcucaaggcccacggcguguccugcccccagagccagugccccuacugcuucacccacugcgagccgaccgaggccgcguuccaggcccacuacaaggugugccaggucacccaccgguuccgcgacgaccugaagaagaccgugacgccccagaacuucacccccgggugcuaccggacccugaaccucuuccgcuacaagucccggugcuacaucuucaccauguggguguuccugcugauccucgagagcguccugugggccgccuccgcgagcgagacgccgcuggcccccguguggaacgacaacgcccacggcgugggguccguccccaugcacaccgaccucgagcuggacuucagccugaccuccagcagcaaguacaccuaccgccggaagcugacgaacccccucgaggaggcccaguccaucgaccugcacaucgagaucgaggagcagaccaucggcguggacgugcacgcccuggggcacugguucgacggccgccucaaccugaagaccagcuuccacugcuacggcgcgugcaccaaguacgaguacccguggcacacggccaagugccacuacgagcgggacuaccaguacgagaccuccugggggugcaaccccagcgacugccccggcgucgggaccggcugcaccgccugcggccuguaccucgaccagcugaagcccgugggguccgccuacaagaucaucacgauccgcuacagccgccgggugugcguccaguucggcgaggagaaccugugcaagaucaucgacaugaacgacugcuucgugucccgccacgugaaggucugcaucaucgggaccgugagcaaguucucccagggcgacacccuccuguucuucgggccgcuggagggcggcgggcucaucuucaagcacuggugcaccagcacgugccaguucggcgaccccggggacaucauguccccccgggacaagggcuuccugugccccgaguucccggggagcuuccgcaagaagugcaacuucgccaccacccccaucugcgaguacgacggcaacaccguguccggcuacaagaaggucauggcgacgaucgacagcuuccaguccuucaacaccagcaccaugcacuucaccgacgagcggaucgaguggaaggaccccgacgggaugcugcgcgaccacaucaacauccucgugacgaaggacaucgacuucgacaaccugggcgagaaccccugcaagaucgggcugcagaccuccagcaucgagggcgccuggggguccggcgugggcuucacccucaccugccuggucagccugacggagugcccgaccuuccucaccagcaucaaggccugcgacaaggccaucugcuacggggccgaguccgugacccugacgcggggccagaacaccgugaaggucagcgggaagggcgggcacuccggcagcaccuucaagugcugccacggcgaggacugcucccagaucgggcugcacgcggccgccccccaccucgacaaggugaacggcaucagcgagaucgagaacuccaaggucuacgacgacggggccccccagugcggcaucaagugcugguucgugaagagcggcgaguggaucuccgggaucuucagcggcaacuggaucgugcugaucguccugugcguguuccuccuguucucccuggugcuccugagcauccugugccccguccgcaagcacaagaaguccuga

SEQ ID NO: 11734 - RNA, 3408 nt, Artificial Sequence
  derived and/or modified CDS sequence (opt1) from HTNV__D25532.1__GP
augggcaucuggaaguggcuggugauggccagccucgucuggcccgugcugacccugcgcaacguguacgacaugaagaucgagugcccgcacaccgucagcuucgggggcaacagcgugaucggguacguggagcucccgcccgucccccuggccgacacggcgcagauggugcccgaguccagcugcuccauggacaaccaccagagccugaacaccaucaccaaguacacccagguguccuggcggggcaaggccgaccagagccaguccagccagaacuccuucgagacggucagcaccgagguggaccucaaggggaccugcgugcugaagcacaagauggucgaggaguccuaccgcagccggaaguccgugaccugcuacgaccugagcugcaacuccacguacugcaagcccacccucuacaugaucgugcccauccacgccugcaacaugaugaaguccugccugaucgcccugggccccuaccgcguccaggugguguacgagcggaccuacugcaugaccggcguccucaucgaggggaagugcuucgugccggaccaguccguggucagcaucaucaagcacggcaucuucgacaucgccagcgugcacaucgugugcuucuucgucgcggugaaggggaacacguacaagaucuucgagcaggucaagaaguccuucgagagcacgugcaacgacaccgagaacaaggugcagggcuacuacaucugcaucgucgggggcaacuccgcccccaucuacgugcccacccuggacgacuuccgcagcauggaggccuucaccggcaucuuccggagcccccacggggaggaccacgaccuggccggcgaggagaucgcgagcuacuccaucguggggccggccaacgccaaggugccccacagcgccuccagcgacacccuccgccugaucgccuacuccggcauccccagcuacuccagccuguccauccucaccagcuccaccgaggcgaagcacgucuucagccccggccuguucccgaagcugaaccacacgaacugcgacaaguccgccaucccccucaucuggaccgggaugaucgaccugcccggcuacuacgaggccgugcaccccugcaccguguucugcguccugagcgggccgggcgccagcugcgaggccuucuccgagggcgggaucuucaacaucaccagcuccaugugccucgugagcaagcagaaccgguuccgccugacggagcagcaggucaacuucgugugccagcggguggacauggacaucguggucuacugcaacggccagcgcaaggugauccugaccaagacccucgugaucgggcagugcaucuacaccaucacgucccuguucagccugcuccccggcgucgcgcacuccaucgccguggagcugugcgugcccggguuccacggcugggccaccgccgcccugcucgucaccuucugcuucgggugggugcugauccccgcgaucaccuucaucauccugacggugcucaaguucaucgccaacaucuuccacaccagcaaccaggagaaccggcugaaguccguccugcgcaagaucaaggaggaguucgagaagaccaagggcagcauggugugcgacgugugcaaguacgagugcgagaccuacaaggagcucaaggcccacggcgucuccugcccgcagagccagugccccuacugcuucacgcacugcgagcccaccgaggccgccuuccaggcgcacuacaaggugugccaggugacccaccgguuccgcgacgaccugaagaagaccgucacgccccagaacuucaccccggggugcuaccggacccugaaccucuuccgcuacaagucccggugcuacaucuucaccauguggaucuuccugcuggugcucgagagcauccugugggccgccuccgccagcgagacgccccugacccccguguggaacgacaacgcgcacggcgucggguccgugccgaugcacaccgaccucgagcuggacuucagccugaccagcuccagcaaguacaccuaccgccggaagcugacgaacccccucgaggaggcccaguccaucgaccugcacaucgagaucgaggagcagaccaucggcguggacguccacgcccuggggcacugguucgacggccgccucaaccugaagaccagcuuccacugcuacggcgccugcaccaaguacgaguaccccuggcacacggccaagugccacuacgagcgcgacuaccaguacgagaccuccugggggugcaaccccagcgacugcccgggcguggggaccggcugcaccgcgugcggccuguaccucgaccagcugaagcccgugggguccgccuacaagaucaucacgauccgguacagccgccgggucugcgugcaguucggcgaggagaaccugugcaagaucaucgacaugaacgacugcuucgugucccgccacgucaaggugugcaucaucgggaccgugagcaaguucucccagggcgacacccuccuguucuucgggccccuggagggcggcgggcucaucuucaagcacuggugcaccagcacgugccaguucggcgaccccggggacaucauguccccgcgggacaagggcuuccugugccccgaguuccccgggagcuuccgcaagaagugcaacuucgccaccacccccaucugcgaguacgacggcaacauggucuccggcuacaagaaggugauggccaccaucgacagcuuccaguccuucaacacgagcaccaugcacuucaccgacgagcggaucgaguggaaggacccggacgggaugcugcgcgaccacaucaacauccucgugaccaaggacaucgacuucgacaaccugggcgagaaccccugcaagaucgggcugcagacguccagcaucgagggcgccugggggagcggcgucggcuucacccugaccugccucgugucccugaccgagugccccacguuccucaccagcaucaaggcgugcgacaaggccaucugcuacggggccgaguccgugacccugacccggggccagaacacggucaaggugagcgggaagggcgggcacuccggcagcaccuucaagugcugccacggcgaggacugcucccagaucgggcugcacgccgccgcgccccaccucgacaaggucaacggcaucagcgagaucgagaacuccaagguguacgacgacggggccccgcagugcggcaucaagugcugguucgucaagagcggcgaguggaucuccgggaucuucagcggcaacuggaucgugcugaucgugcugugcguguuccuccuguucucccugguccuccuggggauccugugccccgugcgcaagcacaagaaguccuga

SEQ ID NO: 11735 - RNA, 3408 nt, Artificial Sequence
  derived and/or modified CDS sequence (opt1) from HTNV__L08753.1__GP
augggcaucuggaaguggcuggugauggccagccucgucuggcccgccuacacccugcgcaacguguacgacaugaagaucgagugcccgcacaccguguccuucggggagaacagcgucaucggcuacguggagcugccgcccaucccccucgccgacacgacccagauggugcccgaguccagcugcuccauggacaaccaccagagccugaacaccgucaccaaguacacccagguguccuggcgggggaaggccgaccaggcccaggccagccagaacuccuucgaggccgugagcgcggaggucgaccugaaggggaccugcgugcucaagcacaagaugcuggaggaguccuaccgcagccggaaguccaucgccugcuacgaccugagcugcaacuccaccuacugcaagcccacccucuacaugaucgugcccauccacgccugcaacaugaugaaguccugccugaucgcccuggggccccaccgcguccaggugguguacgagcggacguacugcaugaccggcguccucaucgagggcaagugcuucgugccggaccagagcguggucagcaucaucaagcacgggaucuucgacaucgcguccgugcacaucgugugcuucuucgucgccgugaagggcaacaccuacaagaucuucgagcagaucaagaaguccuucgagagcaccuacaacgacacgaagaacaagguggagggguacuacaucugcaucgucggcgggaacagcgcccccaucuacgugcccacccuggacgacuuccgcagcauggaggccuucuccggcaucuuccggagcccccacggcgaggaccacgaccuggccggggaggagaucgcguccuacagcaucgucggcccggccaacgugaaggugccccacuccgccagcuccgacacccucagccugaccgccuacuccgggauccccagcuacuccagccuguccauccucgccggcagcgcggaggccaagcacgucuucucccccggcuucuucccgcagcugaaccacacgaagugcgacaagaccgccaucccccugauguggaccgggaugaucgaccuccccggcuacuacgaggccauccaccccugcaccguguucugcgugcugagcgggccgggcgccuccugcgaggcguucagcgagggcggcaucuucaacaucacgagccccaugugccuggucuccaagcagaaccgcuuccggcucaccgagcagcaggucaacuucgugugccagcgcguggacauggacaucaucguguacugcaacggccagcggaaggugauccugaccaagacccuggucaucgggcagugcaucuacacgaucaccagccucuucucccugcugcccggcguggcccacagcaucgccguggagcucugcguccccggguuccacggcugggccaccgccgcgcugcuggugaccuucugcuucgggugggugcucaucccggccaugacguucaucguccugaccauccugaaguucaucgccaacaucuuccacaccuccaaccaggagaacaagcucaagagcgugcugcgcaagaucaaggaggaguucgagaagaccaagggcuccauggugugcgacgucugcaaguacgagugcgagacguacaaggagcugaaggcccacggcgugagcugcccccagucccagugccccuacugcuucacccacugcgagcccaccgaggcggccuuccaggcccacuaccgggugugccaggucacccaccgcuuccgggacgaccucaagaagacggugaccccgcagaacuucacccccgggugcuaccgcacccugaaccuguuccgguacaagagccgcugcuacaucuucaccauguggguguuccuccugguccuggaguccauccucugggccgccagcgcguccgagaucccccuguacccgguguggaacgacaacgcccacggcguggggagcguccccaugcacacggaccuggagcucgacuucucccugaccagcuccagcaaguacaccuaccggcgcaagcugaccaacccccuggaggagagccaggccaucaaccuccacaucgagaucgaggagcagacgaucggcguggacgugcacgcccuggggcacugguucgacggccggcugaaccucaagaccuccuuccacugcuacggcgccugcaccaaguacgaguaccccuggcacaccgcgaagugccacuacgaccgcgacuaccaguacgagacgagcugggggugcaacccguccgacugccccggcgucgggaccggcugcaccgccugcggccuguaccuggaccagcucaagcccguggggagcgccuacaagaucaucaccauccgcuacucccggcgcgugugcguccaguucggcgaggagaaccugugcaagaucaucgacaugaacgacugcuucgugagccggcacgugaaggucugcaucaucgggacgguguccaaguucagccagggcgacacccuccucuucuucgggccccuggagggcggcgggcugaucuucaagcacuggugcaccuccacgugccaguucggcgacccgggggacaucaugagcccccgcgacaagggcuuccucugccccgaguuccccggguccuuccggaagaagugcaacuucgccacgaccccgcugugcgaguacgacggcaacauggugagcggcuacaagaaggucauggccaccaucgacuccuuccagagcuucaacaccuccacgaugcacuucaccgacgagcgcaucgaguggaaggaccccgacgggaugcugcgggaccacaucaacauccucgugaccaaggacaucgacuucgagaaccugggcgagaaccccugcaagaucgggcugcagaccagcuccaucgagggcgcgugggggagcggcgugggcuucacgcugaccugccuggucucccugaccgagugccccaccuuccucacgagcaucaaggccugcgacaaggccaucugcuacggggccgagagcgugacccugacccgcggccagaacaccgugaaggucuccgggaagggcggguacagcggcuccacguucaagugcugccacggcgaggagugcagccagaucgggcugcacgcggccgccccgcaccucgacaaggugaacggcaucuccgagaucgagaacaacaagguguacgacgacggggcgccccagugcggcaucaagugcugguucgucaagagcggcgaguggaucuccgggaucuucagcggcaacuggaucgugcugaucguccugugcguguuccuccuguucucccugauccuccugagcauccugugccccgcccggaagcacaagaaguccuga

SEQ ID NO: 11736 - RNA, 3408 nt, Artificial Sequence
  derived and/or modified CDS sequence (opt1) from HTNV__M14627.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccgcccgucccccuggccgacacggcccagauggugcccgaguccagcugcaacauggacaaccaccagucccugaacaccaucaccaaguacacccaggugagcuggcgggggaaggccgaccagucccagagcucccagaacagcuucgagacggucuccaccgagguggaccucaaggggaccugcgugcugaagcacaagauggucgaggagagcuaccgcucccgcaagagcgugaccugcuacgaccuguccugcaacagcacguacugcaagcccacccucuacaugaucgugcccauccacgccugcaacaugaugaaguccugccugaucgcccuggggcccuaccgcguccaggugguguacgagcggagcuacugcaugaccggcguccucaucgagggcaagugcuucgugccggaccaguccguggucagcaucaucaagcacgggaucuucgacaucgccagcgugcacaucgugugcuucuucgucgcggugaagggcaacaccuacaagaucuucgagcaggucaagaaguccuucgagagcacgugcaacgacaccgagaacaaggugcagggguacuacaucugcaucgugggcgggaacuccgcccccaucuacguccccacccuggacgacuuccgcagcauggaggccuucaccggcaucuuccggagcccccacggcgaggaccacgaccuggccggggaggagaucgcguccuacuccaucgugggcccggccaacgccaaggugccccacagcgccuccagcgacacgcucucccugaucgccuacagcgggauccccuccuacagcucccugagcauccucaccuccagcaccgaggcgaagcacgucuucucccccggccuguucccgaagcugaaccacaccaacugcgacaagagcgccaucccccucaucuggacgggcaugaucgaccugcccggguacuacgaggccgugcaccccugcaccguguucugcguccugagcggcccgggcgccuccugcgaggccuucagcgagggcgggaucuucaacaucaccucccccaugugccucgugagcaagcagaaccgguuccggcugaccgagcagcaggucaacuucgugugccagcgcguggacauggacaucguggucuacugcaacggccagcggaaggugauccugacgaagacccucgugaucggccagugcaucuacaccaucaccucccuguucagccugcuccccggggucgcgcacuccaucgccguggagcugugcgugcccggcuuccacgggugggccacggccgcccugcucgucaccuucugcuucggcugggugcugaucccggcgaucaccuucaucauccugaccgugcucaaguucaucgccaacaucuuccacacgagcaaccaggagaaccgccugaaguccguccugcggaagaucaaggaggaguucgagaagaccaaggggagcauggugugcgacgugugcaaguacgagugcgagaccuacaaggagcucaaggcccacggcgucuccugcccccagagccagugccccuacugcuucacccacugcgagcccacggaggccgccuuccaggcgcacuacaaggugugccaggugacccaccgcuuccgggacgaccugaagaagaccgucaccccgcagaacuucacccccggcugcuaccgcacgcugaaccucuuccgguacaagucccgcugcuacaucuucaccauguggaucuuccugcuggugcucgagagcauccugugggccgccuccgccagcgagacgccccugaccccgguguggaacgacaacgcgcacggggucggcuccgugcccaugcacaccgaccucgagcuggacuucagccugaccagcuccagcaaguacaccuaccggcgcaagcugaccaacccccucgaggaggcccaguccaucgaccugcacaucgagaucgaggagcagacgaucgggguggacguccacgcccugggccacugguucgacgggcggcucaaccugaagaccagcuuccacugcuacggcgccugcaccaaguacgaguaccccuggcacaccgccaagugccacuacgagcgcgacuaccaguacgagacguccuggggcugcaacccgagcgacugccccggggugggcaccgggugcaccgcgugcggccuguaccucgaccagcugaagcccgugggcuccgccuacaagaucaucaccauccgcuacagccggcgcgucugcgugcaguucggggaggagaaccugugcaagaucaucgacaugaacgacugcuucgugucccggcacgucaaggugugcaucaucggcacggugagcaaguucucccagggggacacccuccuguucuucggcccccuggagggcgggggccucaucuucaagcacuggugcaccuccacgugccaguucggggacccgggcgacaucaugagcccccgcgacaagggguuccugugccccgaguuccccggcagcuuccggaagaagugcaacuucgccaccaccccgaucugcgaguacgacgggaacauggucuccggcuacaagaaggugauggccaccaucgacagcuuccaguccuucaacaccagcacgaugcacuucaccgacgagcgcaucgaguggaaggaccccgacggcaugcugcgggaccacaucaacauccucgugaccaaggacaucgacuucgacaaccugggggagaaccccugcaagaucggccugcagaccuccagcaucgagggggccuggggcagcggggucggcuucacgcugaccugccucgugucccugaccgagugccccaccuuccucacgagcaucaaggcgugcgacaaggccaucugcuacggcgccgaguccgugacccugacccgcgggcagaacaccgucaaggugagcggcaagggcgggcacuccgggagcacguuccggugcugccacggcgaggacugcucccagaucggccugcacgccgccgcgccgcaccucgacaaggucaacgggaucagcgagaucgagaacuccaagguguacgacgacggcgcgccccagugcgggaucaagugcugguucgucaagagcggcgaguggaucuccggcaucuucagcgggaacuggaucgugcugaucgugcugugcguguuccuccuguucucccugguccuccugagcauccugugccccgugcgcaagcacaagaaguccuga

SEQ ID NO: 11737 - RNA, 3408 nt, Artificial Sequence
  derived and/or modified CDS sequence (opt1) from HTNV__EU074672.1__GP
augggcaucuggaaguggcuggugauggccagccucgucuggcccgccuucgcgcugcgcaacguguacgacaugaagaucgagugcccgcacaccgugagcuucggggagaacagcgucaucggcuacguggagcugccgcccaugccccucgccgacaccacgcagauggugcccgaguccagcugcuccauggacaaccaccagagccugaacaccaucaccaaguacacccagaucaucuggcgggggaaggccgaccagucccagagcucccagaacagcuucgagacggucuccaccgagguggaccugaaggggaccugcgugcucaagcacaagaugaucgaggagagcuaccgcucccgcaagagcaucacgugcuacgaccuguccugcaacagcaccuacugcaagcccacccuguacaugaucguccccauccacgccugcaacaugaugaaguccugccucaucgcccuggggcccuaccggguccaggugguguacgagcggaccuacugcaugaccggcgugcugaucgagggcaagugcuucgugccggaccagagcgucguguccaucaucaagcacgggaucuucgacaucgcgagcgugcacaucgucugcuucuucguggccgugaagggcaacacguacaagaucuucgagcaggucaagaaguccuucgagagcaacugcaacgacaccgagaacaaggugcagggguacuacaucugcaucaucggcgggaacagcucccccguguacguccccacccucgacgacuuccgcagcauggaggccuucuccggcaucuuccggagcccccacggcgaggaccacgaccuggccggggaggagguggcguccuacagcaucgucggcccggccaacgccaaggugccccacuccgccagcuccgacacccuggggcucaucgccuacagcggcauccccuccuacagcucccugagcauccugacguccagcaccgaggcgaagcacguguucucccccggccucuucccgcagcugaaccacaccaagugcgacaagaccgccaucccccugacguggaccgggaugaucgaccuccccggcuacuacgaggccauccaccccugcaccgucuucugcgugcugagcgggccgggcgccagcugcgaggccuucuccgagggcggcaucuucaacaucaccagccccaugugccugguguccaagcagaaccgcuuccggcucacggagcagcaggucaacuucgugugccagcgcguggacgucgacaucaucguguacugcaacggccagcggaaggugauccugaccaagacccuggucaucgggcagugcaucuacaccaucacgagccucuucucccugcugcccggcguggcgcacagcaucgccguggagcucugcguccccggguuccacggcugggccaccgccgcccugcuggugaccuucugcuucgggugggugcucaucccggcgaucaccuucaucauccugacgauccugaaguucaucgccaacaucuuccacaccuccaaccaggagaaccgccucaagagcguccugcggaagaucaaggaggaguucgagcgcaccaagggcuccauggugugcgacaucugcaaguacgagugcgagaccuaccgggagcugaaggcccacggcgugagcugcccccagucccagugccccuacugcuucacgcacugcgagcccaccgaggccgccuuccaggcgcacuacaaggucugccaggugacccaccgcuuccgggacgaccucaagaagaccgugaccccgcagaacuucacgcccgggugcuaccgcacccugaaccuguuccgguacaagagccgcugcuacaucuucaccaugugggucuuccuccuggugcuggaguccauccucugggccgccagcgccuccgagaucccccugaacccgguguggaacgacaacgcgcacggcgucgggagcauccccaugcacaccgaccuggagcucgacuucucccugacgagcagcuccaaguacaccuaccggcgcaagcugaccaacccccuggaggagagccaggccaucgaccuccacguggagaucgaggagcagaccaucggcguggacguccacgcccuggggcacugguucgacggccgccugaaccucaagacguccuuccacugcuacggcgccugcaccaaguacgaguaccccuggcacaccgccaagugccacuacgagcgggacuaccaguacgagaccagcugggggugcaacccguccgacugccccggcguggggacgggcugcaccgcgugcggccuguaccuggaccagcucaagcccguggggagcgccuacaagaucaucaccauccgcuacucccggcgcgucugcgugcaguucggcgaggagaaccugugcaagaucaucgacaugaacgacugcuucgugagccggcacgucaaggugugcaucaucgggaccguguccaaguucagccagggcgacacgcugcuguucuucgggccccuggagggcggcgggcugaucuucaagcacuggugcaccuccacgugccaguucggcgacccgggggacaucaugagcccccgcgacaagggcuuccucugccccgaguuccccggguccuuccggaagaagugcaacuucgccaccaccccggucugcgaguacgacggcaacauggugagcggcuacaagaaggugauggccaccaucgacuccuuccagagcuucaacaccuccaccaugcacuucacggacgagcgcaucgaguggaaggaccccgacgggaugcugcgggaccacaucaacauccuggucaccaaggacaucgacuucgacaaccucggcgagaaccccugcaagaucgggcugcagaccagcuccaucgagggcgccugggggagcggcgugggcuucacccugacgugccucaucagccugaccgagugcuccaccuuccugaccagcaucaaggcgugcgacaaggccaucugcuacggggccgaguccgugacgcucacccgcggccagaacaccgucaaggugagcgggaagggcgggcacuccggcagcuccuucaagugcugccacggcgaggagugcagccagaucgggcugcacgccgccgcgccccaccuggacaaggugaacggcaucuccgagauggagaacagcaaggucuucgacgacggggccccgcagugcggcaucaagugcugguucgugaaguccggcgaguggaucagcgggaucuucuccggcaacuggaucgugcucaucguccugugcguguuccuccucuucagccugguccugcucuccauccugugccccgugcggaagcacaagaaguccuga

SEQ ID NO: 11738 - RNA, 3408 nt, Artificial Sequence
  derived and/or modified CDS sequence (opt1) from HTNV__GQ120966.1__GP
auggagaucuggaaguggcuggugauggccagccucgucuggcccgccuucacccugcgcaacguguacgacaugaagaucgagugcccgcacaccguguccuucggcgagaacagcgucaucggguacguggagcugccccccaugccccucgcggacacggcccagauggugccggaguccagcugcaacauggacaaccaccaguccaugaacaccaucaccaaguacacccaggucagcuggcggggcaaggccgaccaggcccaggccucccagaacagcuucgaggcgguguccgccgagguggaccugaaggggacgugcguccugaagcacaagaugcucgaggagagcuaccgcucccggaagagcaucaccugcuacgaccuguccugcaacagcaccuacugcaagcccacccuguacaugaucgugcccauccacgccugcaacaugaugaaguccugccucaucgcccugggccccuaccgcgugcaggucguguacgagcggacguacugcaugaccggggugcugaucgagggcaagugcuucgucccggaccagagcgugguguccaucaucaagcacggcaucuucgacaucgcgagcguccacaucgugugcuucuucguggccgucaaggggaacaccuacaagcucuucgagcaggugaagaaguccuuccagagcaccugcaacggcacggagaacaaggugcagggguacuacaucugcaucgucggcgggaacagcgcccccaucuacgugcccacccuggacgacuuccgcuccauggaggccuucagcggcaucuuccgguccccccacggcgaggaccacgaccuggccggggaggagaucgcgagcuacuccaucgucggcccggccaacgccaaggugccccacagcgccuccagcgacacccucucccugaucgccuacagcgggauccccuccuacagcucccugagcauccucgcguccagcaccgaggccaagcacguguucucccccggcuucuucccgcagcugaaccacacgaagugcgacaagaccgccaucccccugaccuggaccggcaugaucgaccuccccggguacuacgaggccauccaccccugcacggucuucugcgugcugagcggcccgggggccuccugcgaggcguucagcgagggcgggaucuucaacaucaccagccccaugugccugguguccaagcagaaccgcuuccggcucaccgagcagcaggucaacuucgugugccagcgcguggacauggacaucaucgucuacugcaacggccagcggaaggugauccugaccaagacgcuggugaucggccagugcaucuacaccaucaccagccucuucucccugcugcccggggucgcccacagcaucgccguggagcucugcgugcccggcuuccacgggugggccaccgccgcgcugcuggucacguucugcuucggcugggugcucaucccggcccugacccugaucauccucaccauccugaaguucaucgccaacaucuuccacaccuccaaccaggagaaccgccugaagagcgugcuccggaagaucaaggaggaguucgagaagacgaagggguccauggucugcgacgugugcaaguacgagugcgagaccuacaaggagcugaaggcccacggcgugagcugcccccagucccagugccccuacugcuucacccacugcgagcccaccgaggcggccuuccaggcccacuaccgcgucugccaggugacgcaccgguuccgcgacgaccugaagaagaccgugaccccgcagaacuucacccccggcugcuaccggacccucaaccuguuccgcuacaagagccggugcuacaucuucacgaugugggucugccugcucgugcuggaguccauccugugggccgccagcgcguccgaggugccccucaacccggucuggaacgacaacgcccacggggugggcagcgugcccaugcacaccgaccuggagcuggacuucccccugaccuccagcuccaaguacaccuaccgccggcgccucacgaacccccuggaggagacccagagcaucaaccugcacaucgagaucgaggagcagaccaucggggucgacgugcacgcccucggccacugguucgacgggcgccugaaccugaagaccagcuuccacugcuacggcgccugcacgaaguacgaguacccguggcacaccgccaagugccacuacgagcgggacuaccaguacgagaccuccuggggcugcaaccccgcggacugccccggggugggcaccgggugcacggccugcggccucuaccuggaccagcugaagcccgucggcagcgccuacaagaucaucaccauccgcuacucccggaaggugugcgugcaguucggggaggagaaccucugcaaggucaucgacaugaacgacugcuucgugacccgccacgugaaggucugcaucaucggcaccgugagcaaguucucccagggggacacgcugcuguucuucggcccgcucgaggggggcggccugaucuucaagcacuggugcaccagcaccugccaguucggggaccccggcgacaucauguccccccgggacaagggguuccugugccccgaguucccgggcagcuuccgcaagaagugcaacuucgccaccacgccccucugcgaguacgacgggaacaugguguccggcuacaagaaggucauggccaccaucgacagcuuccaguccuucaacaccagcaccaugcacuucacggacgagcggaucgaguggaaggaccccgacggcaugcugcgcgaccacaucaacauccuggugaccaaggacaucgacuucgacaaccucggggagaaccccugcaagaucggccugcagaccuccagcaucgagggggcguggggcuccggggugggcuucacccugacgugccucaucagccugaccgagugcccgaccuuccugaccuccaucaaggccugcgacaaggccaucugcuacggcgccgagagcgucacgcucacccgggggcagaacaccgugaagguguccggcaaggggggccacagcgggagcaccuucaagugcugccacggcgaggagugcucccagaucggccugcacgcggccgccccccaccuggacaaggucaacgggaucagcgagaucgagaacaacaagguguacgacgacggcgccccccagugcggggugaagugcugguucgucaaguccggcgaguggaucagcggcaucuucuccgggaacuggaucgugcucaucguccugugcguguuccugcucuucagccuggugcugcucuccguccugugccccgugcgcaagcacaagaagagcuga

SEQ ID NO: 11739 - RNA, 3408 nt, Artificial Sequence
  derived and/or modified CDS sequence (opt1) from HTNV(CGAa1011)__EF990927.1__GP
auggagaucuggaaguggcuggugauggccagccucgucuggcccgcccuggcgcugcgcaacgugcacgacaugaagaucgagugcccgcacaccguguccuucggcaagaacagcgucaucggguacguggagcucccccccaugccccuggccgacaccauccagauggugccggaguccagcugcuccauggacaaccaccagagccuguccacggucaccaaguacacccaggugagcuggcggggcaaggccgaccaggcccaguccaaccagaccagcuucgagacgguguccgucgagguggaccucaaggggaccugcgugcugaagcacaagcuggucgaggagagcuaccgcucccggaagagccucaccugcuacgaccuguccugcaacagcaccuacugcaagcccacgcuguacaugaucgugcccauccacgccugcaacaugaugaaguccugcaucaucgcgcucggcccccaccgcgugcaggucguguacgagcggaccuacugcaugaccggggugcugcuggagggcaagugcuucgucccggaccagagcguggugggcaucgucaagcacgggaucuucgacaucgccuccgugcacaucgccugcuucuucguggccaucaccggcaacacguacaagcucuucgagcaggucaagaagagcuucgggaccaccugcaacgacaccgagaacaaggugcagggcuacuacaucugcauccuggggggcaacagcccccccaucuacguccccacgcuggacgacuuccgcuccauggaggcguucagcggcaucuucaaguccccgcacggggaggaccacgaccucgccggcgaggagaucgccagcuacuccaucguggggcccgccaacgccaaggugccccacagcgcguccagcgacacccugucccugaucgccuucagcggcauccccuccuacagcucccucagcauccugaccuccagcaccgaggccaagcacgucuucuccccgggccuguucccccagcucaaccacacgaagugcgacaagaccgccaucccccugaccuggaccgggaucaucgaccugcccggcuacuacgaggccgugcacccgugcacgguguucugcguccucagcgggcccggcgcguccugcgaggccuucagcgaggggggcaucuucaacaucaccagccccaugugccugguguccaagcagaaccgguuccgccugaccgagcagcaggugaacuucgucugccagcggguggacauggacaucguggucuacugcaacggccagcgcaaggugauccucaccaagacgcuggugaucgggcagugcaucuacaccaucaccagccuguucucccuccugcccggcgucgcccacagcaucgccguggagcugugcgugccgggguuccacggcugggccaccgcggcccuccugaucacguucugcuucggguggguccugauccccgcccucaccuucaucgugcugaccgugcugaaguucaucgccaacaucuuccacaccuccaaccaggagaaccggcucaagaugguccugaagaagaucaaggaggaguucgagcgcacgaagggcagcauggugugcgacaucugcaaguacgagugcgagaccuacaaggagcugaaggcccacggcguguccugcccccagagccagugccccuacugcuucacccacugcgagccgaccgaguccgcguuccaggcccacuaccgggucugccaggugacccaccgcuuccgggacgaccucaagaagacggugaccccccagaacuucacccccgggugcuaccgcacccugaaccuguuccgguacaagagccgcugcuacaucuucacgauguggaucugccuccugguccuggaguccauccugugggccgccagcgcguccgagaucccgcucagccccaccuggaacgacaacgcccacggcgugggguccauccccaugcacaccgaccuggagcuggacuucagccucaccuccagcagcaaguacacguaccggcgcaagcugaccaacccccuggaggagucccaggccgugaacuuccacgucgagaucgaggagcaggccaucggcguggacgugcacgcccucgggcacugguucgacggccggcugaaccugaagaccagcuuccacugcuacggcgcgugcaccaaguacgaguacccguggcacacggccaagugccacuacgagcgcgacuaccaguacgagaccuccugggggugcaaccccagcgacugccccggcgucgggaccggcugcaccgccugcggccucuaccuggaccagcugaagcccgugggguccgccuacaagaucaucacgauccgcuacagccggcgcgugugcguccaguucggcgaggagaaccucugcaaggugaucgacaugaacgacugcuucgugucccggcacgucaaggugugcaucaucgggaccgugagcaaguucucccagggcgacacccugcuguucuucgggccgcucgagggcggcgggcugaucuucaagcacuggugcaccagcacgugccaguucggcgaccccggggacaucauguccccccgcgacaagggcuuccugugccccgaguucccggggagcuuccggaagaagugcaacuucgccaccacccccgucugcgaguacgacggcaacaugguguccggcuacaagaaggugauggcgaccaucgacagcuuccaguccagcaacacguccaccaugcacuucaccgacgagcgcaucgaguggaaggaccccgacgggaugcuccgggaccacaucaacauccuggucaccaaggacaucgacuucgacaaccugggcgagaaccccugcaagaucgggcuccagacgagcuccaucgagggcgccugggggagcggcgugggcuucacccugaccugccugaucagccucaccgagugcccgacguuccugaccuccaucaaggccugcgacaaggccaucugcuacggggccgagagcgugacccugacccgcggccagaacacggucaagguguccgggaagggcgggcacagcggcuccaccuucaagugcugccacggcgaggacugcagccaguccgggcuccacgcggccgccccccaccuggacaaggugaacggcaucagcgagaucgagaacuccaaggucuacgacgacggggccccccagugcggcgugaagugcugguucgucaagagcggcgaguggaucuccgggaucuucagcggcaacuggaucgugcugaucgugcucugcgucuuccugcuguucucccucgugcugcugagcauccucugccccgugcggaagcacaagaaguccuga

SEQ ID NO: 11740 - RNA, 3408 nt, Artificial Sequence
  derived and/or modified CDS sequence (opt1) from HTNV(CGAa2)__EU092223.1__GP
auggagaucuggaaguggcuggugauggccagccucgucuggcccgcccuggcgcugcgcaacgugcacgacaugaagaucgagugcccgcacaccguguccuucggcaagaacagcgucaucggguacguggagcucccccccaugccccuggccgacaccauccagauggugccggaguccagcugcuccauggacaaccaccagagccuguccacggucaccaaguacacccaggugagcuggcggggcaaggccgaccaggcccagcccucccagaccagcuucgagacgguguccgucgagguggaccucaaggggaccugcgugcugaagcacaagcuggucgaggagagcuaccgcucccggaagagccucaccugcuacgaccuguccugcaacagcaccuacugcaagcccacgcuguacaugaucgugcccauccacgccugcaacaugaugaaguccugcaucaucgcgcucggcccgcaccgcgugcaggucguguacgagcggaccuacugcaugaccggggugcugcuggagggcaagugcuucguccccgaccagagcgugguguccaucguccgccacggcaucuucgacaucgccagcgugcacaucgccugcuucuucguggccaucaccgggaacacguacaagcucuucgagcaggucaagaagagcuucggcaccaccugcaacgacaccgagaacaaggugcagggguacuacaucugcauccugggcgggaacuccccccccaucuacgucccgacgcuggacgacuuccggagcauggaggcguucuccggcaucuucaagagcccccacggcgaggaccacgaccucgccggggaggagaucgccuccuacagcaucgugggccccgccaacgccaaggugccccacuccgcgagcuccgacacccugagccugaucgccuucuccgggaucccgagcuacuccagccucuccauccugaccagcuccaccgaggccaagcacgucuucagccccggccuguucccccagcucaaccacacgaagugcgacaagaccgccaucccccugaccuggaccggcaucaucgaccugccgggguacuacgaggccgugcaccccugcacgguguucugcguccucuccggccccggggcgagcugcgaggccuucagcgagggcgggaucuucaacaucaccucccccaugugccuggugagcaagcagaaccgcuuccggcugaccgagcagcaggugaacuucgucugccagcgcguggacauggacaucguggucuacugcaacggccagcggaaggugauccucaccaagacgcuggugaucggccagugcaucuacaccaucaccucccuguucagccuccugccgggggucgcccacuccaucgccguggagcugugcgugcccggcuuccacgggugggccaccgcggcccuccugaucacguucugcuucggcuggguccugauccccgcccucaccuucaucgugcugaccgugcugaaguucaucgccaacaucuuccacaccagcaaccaggagaaccgccucaagaugguccugaagaagaucaaggaggaguucgagcggacgaagggguccauggugugcgacaucugcaaguacgagugcgagaccuacaaggagcugaaggcccacggcgugagcugcccccagucccagugcccguacugcuucacccacugcgagcccaccgagagcgcguuccaggcccacuaccgcgucugccaggugacccaccgguuccgcgacgaccucaagaagacggugaccccccagaacuucaccccgggcugcuaccggacccugaaccuguuccgcuacaagucccggugcuacaucuucacgauguggaucugccuccugguccuggagagcauccugugggccgccuccgcgagcgagaucccccucucccccaccuggaacgacaacgcccacggggugggcagcauccccaugcacaccgaccuggagcuggacuucucccucaccagcagcuccaaguacacguaccgccggaagcugaccaacccgcuggaggagagccaggccgugaacuuccacgucgagaucgaggagcaggccaucgggguggacgugcacgcccucggccacugguccgacgggcgccugaaccugaagaccagcuuccacugcuacggcgcgugcaccaaguacgaguaccccuggcacacggccaagugccacuacgagcgcgacuaccaguacgagaccuccuggggcugcaaccccagcgacugccccggggucggcaccgggugcaccgccugcggccucuaccuggaccagcugaagccggugggcuccgccuacaagaucaucacgauccgguacagccgccgggugugcguccaguucggggaggagaaccucugcaaggugaucgacaugaacgacugcuucgugucccgccacgucaaggugugcaucaucggcaccgugagcaaguucucccagggggacacccugcuguucuucggcccccucgaggggggcggccugaucuucaagcacuggugcaccagcacgugccaguucggggaccccggcgacaucauguccccccgggacaagggguuccugugcccggaguuccccggcagcuuccgcaagaagugcaacuucgccaccacccccgucugcgaguacgacgggaacaugguguccggcuacaagaaggugauggcgaccaucgacagcuuccaguccagcaacacguccaccaugcacuucaccgacgagcggaucgaguggaaggaccccgacggcaugcuccgcgaccacaucaacauccuggucaccaaggacaucgacuucgacaaccugggggagaacccgugcaagaucggccuccagacgagcagcaucgagggggccuggggcuccggggugggcuucacccugaccugccugaucagccucaccgagugccccacguuccugaccuccaucaaggccugcgacaaggccaucugcuacggcgccgagagcgugacccugacccgggggcagaacacggucaagguguccggcaaggggggccacagcggguccaccuucaagugcugccacggcgaggacugcagccaguccggccuccacgcggccgccccccaccuggacaaggugaacgggaucagcgagaucgagaacuccaaggucuacgacgacggcgccccccagugcggggugaagugcugguucgucaagagcggcgaguggaucuccggcaucuucagcgggaacuggaucgugcugaucgugcucugcgucuuccugcuguucucccucgugcugcugagcauccucugcccggugcgcaagcacaagaaguccuga

SEQ ID NO: 11741 - RNA, 3408 nt, Artificial Sequence
  derived and/or modified CDS sequence (opt1) from HTNV(CGAa31MP7)__EF990925.1__GP
augggcaucuggaaguggcuggugauggccagccucgucuggcccgccuucgcccugcgcaacguguacgacaugaagaucgagugcccgcacaccguguccuucggggagaacagcgucaucggcuacguggagcugccgcccaugccccucgccgacaccacgcagauggugcccgaguccagcugcuccauggacaaccaccagagccugaacaccaucaccaaguacacccagaucaucuggcgggggaaggccgaccagucccagagcucccagaacagcuucgagacggucuccaccggcguggaccugaaggggaccugcgugcucaagcacaagaugaucgaggagagcuaccgcucccgcaagagcaucacgugcuacgaccuguccugcaacagcaccuacugcaagcccacccuguacaugaucguccccauccacgccugcaacaugaugaaguccugccucaucgcccugggccccuaccggguccaggugguguacgagcggaccuacugcaugaccggcgugcugaucgaggggaagugcuucgugccggaccagagcgucguguccaucaucaagcacggcaucuucgacaucgcgagcgugcacaucgucugcuucuucguggccgugaaggggaacacguacaagaucuucgagcaggucaagaaguccuucgagagcaacugcaacgacaccgagaacaaggugcagggcuacuacaucugcaucaucgggggcaacagcucccccguguacguccccacccucgacgacuuccgcagcauggaggccuucuccggcaucuuccggagcccccacggggaggaccacgaccuggccggcgaggagguggcguccuacagcaucgucgggccggccaacgccaaggugccccacuccgccagcuccgacacccugggccucaucgccuacagcggcauccccuccuacagcucccugagcauccugacguccagcaccgaggcgaagcacguguucucccccgggcuguucccgcagcugaaccacaccaagugcgacaagaccgccaucccccugacguggaccggcaugaucgaccuccccggguacuacgaggccauccaccccugcaccgucuucugcgugcugagcggcccgggggccagcugcgaggccuucuccgagggcggcaucuucaacaucaccagccccaugugccugguguccaagcagaaccgcuuccggcucacggagcagcaggucaacuucgugugccagcgcguggacgucgacaucaucguguacugcaacgggcagcggaaggugauccugaccaagacccuggucaucggccagugcaucuacaccaucacgagccucuucucccugcugcccgggguggcgcacagcaucgccguggagcucugcguccccggcuuccacgggugggccaccgccgcccugcuggugaccuucugcuucggcugggugcucaucccggcgaucaccuucaucauccugacgauccugaaguucaucgccaacaucuuccacaccuccaaccaggagaaccgccucaagagcguccugcggaagaucaaggaggaguucgagcgcaccaagggcuccauggugugcgacaucugcaaguacgagugcgagaccuacaaggagcugaaggcccacggggugagcugcccccagucccagugccccuacugcuucacgcacugcgagcccaccgaggccgccuuccaggcgcacuaccgggucugccaggugacccaccgcuuccgggacgaccucaagaagaccgugaccccgcagaacuucacgcccggcugcuaccgcacccugaaccuguuccgguacaagagccgcugcuacaucuucaccauguggaucugccuccugguccuggaguccauccucugggccgccagcgccuccgagaucccccugaacccgguguggaacgacaacgcgcacggggugggcagcauccccaugcacaccgaccuggagcucgacuucucccugacgagcagcuccaagcacaccuaccggcgcaagcugaccaacccccuggaggagagccaggccaucgaccuccacgucgagaucgaggagcagaccaucgggguggacgugcacgcccugggccacugguucgacggccgccugaaccucaagacguccuuccacugcuacggggccugcaccaaguacgaguaccccuggcacaccgccaagugccacuacgagcgggacuaccaguacgagaccagcuggggcugcaacccguccgacugccccggggucggcacgggcugcaccgcgugcgggcuguaccuggaccagcucaagcccgugggcagcgccuacaagaucaucaccauccgcuacucccggcgcgugugcguccaguucggggaggagaaccugugcaaggugaucgacaugaacgacugcuucgugagccggcacgucaaggugugcaucaucggcaccguguccaaguucagccagggggacacgcuccucuucuucggcccccuggagggcgggggccugaucuucaagcacuggugcaccuccacgugccaguucggggacccgggcgacaucaugagcccccgcgacaagggguuccucugccccgaguuccccggcuccuuccggaagaagugcaacuucgccaccaccccggucugcggcuacgacgggaacauggugagcggcuacaagaaggugauggccaccaucgacuccuuccagagcuucaacaccuccaccaugcacuucacggacgagcgcaucgaguggaaggaccccgacgggaugcugcgggaccacaucaacauccuggucaccaaggacaucgacuucgacaaccucggcgagaaccccugcaagaucgggcugcagaccagcuccaucgagggcgccuggggcagcggggugggcuucacccugacgugccucaucagccugaccgagugccccaccuuccugaccuccaucaaggcgugcgacaaggccaucugcuacggggccgagagcgugacgcucacccgcggccagaacaccgucaagguguccgggaagggcggccacagcggguccaccuucaagugcugccacggcgaggacugcagccaguccgggcugcacgccgccgcgccgcaccuggacaaggugaacggcaucagcgagaucgagaacuccaaggucuacgacgacggcgcgccccagugcgggaucaagugcugguucgucaagagcggcgaguggaucuccgggaucuucagcggcaacuggaucgugcucaucgugcugugcguguuccuccuguucucccugguccugcucagcauccugugccccgugcggaagcacaagaaguccuga

SEQ ID NO: 11742 - RNA, 3408 nt, Artificial Sequence
  derived and/or modified CDS sequence (opt1) from HTNV(CGAa4MP9)__EF990929.1__GP
auggagaucuggaaguggcuggugauggccagccucgucuggcccgcccuggcgcugcgcaacguguacgacaugaagaucgagugcccgcacaccguguccuucggcgagaacagcguccucggguacguggagcugccccccaugccccuggccgacaccauccagauggugccggaguccagcugcuccauggacaaccaccagagcauguccacggccaccaaguacacccaggucagcuggcggggcaaggccgaccaggcccaguccagccagaccuccuucgagacggugagcguggaggucgaccucaaggggaccugcgugcugaagcacaagaugguggagaaguccuaccgcagccggaagucccugaccugcuacgaccucagcugcaacuccaccuacugcaagcccacgcuguacaugaucguccccauccacgcgugcaacaugaugaagagcugcaucaucgcccugggccccuaccgcgugcagguggucuacgagcggaccuacugcaugaccggggugcuccuggagggcaagugcuucgugccggaccaguccgucgugagcaucgugaagcacagcaucuucgacaucgccuccguccacaucgccugcuucuucguggcgaucaccggcaacacguacaagcugaucgagcaggugaagaccagcuucgggaccaccugcaacgacacggaggacaagguccagggcuacuacaucugcauccucgggggcaacuccccccccaucuacgugcccacccuggacgacuuccgcagcauggaggccuucuccgggaucuuccggagcccgcacggcgaggaccacgaccuggccggcgaggagaucgccuccuacagcaucgucgggcccgccaacgcgaagaucccccacuccgccagcuccgacacccucagccugaucgccuucuccggcauccccagcuacuccagccuguccauccucaccagcuccacggaggccaagcacguguucagcccggggcuguucccccagcugaaccacaccaagugcgacaagaccgccaucccccucaccuggacgggcaucaucgaccugcccggcuacuacgaggcggugcacccgugcaccgucuucugcgugcugagcgggcccggcgccuccugcgaggccuucagcgaggggggcaucuucaacaucaccucccccaugugccucgugagcaagcagaaccgcuuccggcugaccgagcagcaggucaacuucgugugccagcgcguggacauggacaucgucguguacugcaacgggcagcggaaggugauccugacgaagacccucgucaucggccagugcaucuacaccaucaccucccuguucagccugcuccccggcguggcccacuccaucgccguggagcugugcgucccgggguuccacggcugggcgacggccgcccugcucgugaccuucugcuucgggugggugcugauccccgccaucaccuucgucgugcugaccgugcucaaguucaucgccaacaucuuccacacgagcaaccaggagaaccgccugaagaugguccugaagaagaucaaggaggaguucgagaagaccaagggcuccauggugugcgacaucugcaaguacgagugcgagaccuacaaggagcucaaggcgcacggggugagcugcccccagucccagugccccuacugcuucacccacugcgagccgaccgagagcgccuuccaggcccacuaccgggucugccaggugacgcaccgcuuccgggaggaccugaagaagaccgugaccccccagaacuucacccccggcugcuaccgcacgcugaaccucuuccgguacaagucccgcugcuacaucuucaccauguggaucuuccugcugguccucgagagcauccugugggccgcguccgccagcgagaccccgcugucccccaccuggaacgacaacgcccacggcguggggagcauccccaugcacacggaccuggagcucgacuucagccugaccuccagcuccaaguacaccuaccggcgcaagcugaccaacccccucgaggaggcccaggccgugagcuuccacgucgagaucgaggagcagacgaucggcguggacgugcacgcgcuggggcacugguucgacggccggcugaaccucaagaccuccuuccacugcuacggggccugcaccaaguacgaguacccguggcacaccgccaagugccacuacgagcgcgacuaccaguacgagacgagcuggggcugcaaccccuccgacugccccggcgucgggaccggcugcaccgccugcgggcuguaccuggaccagcucaagcccgugggcagcgccuacaagaucaucaccauccgcuacucccggcgcgugugcguccaguucggcgaggagaaccugugcaaggugaucgacauggacgacugcuucgugagccggcacgucaaggugugcaucaucgggacgguguccaaguucagccagggcgacacccugcucuucuucgggccgcuggagggcgggggccugaucuacaagcacuggugcaccuccaccugccaguucggcgaccccggggacaucaugagcccccgcgacaagggccuccugugccccgaguucccgggguccuuccggaagaagugcaacuucgcgacgacccccgucugcgaguacgacggcaacauggugagcggguacaagaaggugauggccaccaucgacuccuuccagagcaucaacaccuccacgaugcacuucaccgacgagcgcaucgaguggaaggaccccgacggcaugcugcgggaccacaucaacauccucgucaccaaggacaucgacuucgacaaccugggcgagaaccccugcaagaucgggcugcagaccagcagcaucgagggcgccuggggguccggcgugggguucacgcucaccugccugaucagccugaccgagugcccgaccuuccucacguccaucaaggccugcgacaaggccaucugcuacggcgcggagagcgugacccugacccgcggccagaacaccgucaagguguccgggaagggcgggcacagcggcuccaccuucaagugcugccacggggaggacugcagccaguccggccugcacgccgccgccccccaccucgacaaggugaacggcaucagcgagauggagaacuccaaggucuacgacgacggggcgccccagugcggcaucaagugcugguucgugaagagcggggaguggaucuccggcaucuucagcggcaacuggaucguccugaucgugcugugcguguuccuccuguucucccugguccuccugagcauccugugccccgugcggaagcacaagaaguccuga

SEQ ID NO: 11743 - RNA, 3408 nt, Artificial Sequence
  derived and/or modified CDS sequence (opt1) from HTNV(CGAa4P15)__EF990928.1__GP
auggagaucuggaaguggcuggugauggccagccucgucuggcccgcccuggcgcugcgcaacguguacgacaugaagaucgagugcccgcacaccguguccuucggcgagaacagcguccucggguacguggagcugccccccaugccccuggccgacaccauccagauggugccggaguccagcugcuccauggacaaccaccagagcauguccacggccaccaaguacacccaggucagcuggcggggcaaggccgaccaggcccaguccagccagaccuccuucgagacggugagcguggaggucgaccucaaggggaccugcgugcugaagcacaagaugguggagaaguccuaccgcagccggaagucccugaccugcuacgaccucagcugcaacuccaccuacugcaagcccacgcuguacaugaucguccccauccacgcgugcaacaugaugaagagcugcaucaucgcccugggccccuaccgcgugcagguggucuacgagcggaccuacugcaugaccggggugcuccuggagggcaagugcuucgugccggaccaguccgucgugagcaucgugaagcacagcaucuucgacaucgccuccguccacaucgccugcuucuucguggcgaucaccggcaacacguacaagcuguucgagcaggugaagaccagcuucgggaccaccugcaacgacacggaggacaagguccagggcuacuacaucugcauccucgggggcaacuccccccccaucuacgugcccacccuggacgacuuccgcagcauggaggccuucuccgggaucuuccggagcccgcacggcgaggaccacgaccuggccggcgaggagaucgccuccuacagcaucgucgggcccgccaacgcgaagaucccccacuccgccagcuccgacacccucagccugaucgccuucuccggcauccccagcuacuccagccuguccauccucaccagcuccacggaggccaagcacguguucagcccggggcuguucccccagcugaaccacaccaagugcgacaagaccgccaucccccucaccuggacgggcaucaucgaccugcccggcuacuacgaggcggugcacccgugcaccgucuucugcgugcugagcgggcccggcgccuccugcgaggccuucagcgaggggggcaucuucaacaucaccucccccaugugccucgugagcaagcagaaccgcuuccggcugaccgagcagcaggucaacuucgugugccagcgcguggacauggacaucgucguguacugcaacgggcagcggaaggugauccugacgaagacccucgucaucggccagugcaucuacaccaucaccucccuguucagccugcuccccggcguggcccacuccaucgccguggagcugugcgucccgggguuccacggcugggcgacggccgcccugcucgugaccuucugcuucgggugggugcugauccccgccaucaccuucgucgugcugaccgugcucaaguucaucgccaacaucuuccacacgagcaaccaggagaaccgccugaagaugguccugaagaagaucaaggaggaguucgagaagaccaagggcuccauggugugcgacaucugcaaguacgagugcgagaccuacaaggagcucaaggcgcacggggugagcugcccccagucccagugccccuacugcuucacccacugcgagccgaccgagagcgccuuccaggcccacuaccgggucugccaggugacgcaccgcuuccgggaggaccugaagaagaccgugaccccccagaacuucacccccggcugcuaccgcacgcugaaccucuuccgguacaagucccgcugcuacaucuucaccauguggaucuuccugcugguccucgagagcauccugugggccgcguccgccagcgagaccccgcugucccccaccuggaacgacaacgcccacggcguggggagcauccccaugcacacggaccuggagcucgacuucagccugaccuccagcuccaaguacaccuaccggcgcaagcugaccaacccccucgaggaggcccaggccgugagcuuccacgucgagaucgaggagcagacgaucggcguggacgugcacgcgcuggggcacugguucgacggccggcugaaccucaagaccuccuuccacugcuacggggccugcaccaaguacgaguacccguggcacaccgccaagugccacuacgagcgcgacuaccaguacgagacgagcuggggcugcaaccccuccgacugccccggcgucgggaccggcugcaccgccugcgggcuguaccuggaccagcucaagcccgugggcagcgccuacaagaucaucaccauccgcuacucccggcgcgugugcguccaguucggcgaggagaaccugugcaaggugaucgacauggacgacugcuucgugagccggcacgucaaggugugcaucaucgggacgguguccaaguucagccagggcgacacccugcucuucuucgggccgcuggagggcgggggccugaucuucaagcacuggugcaccuccaccugccaguucggcgaccccggggacaucaugagcccccgcgacaagggcuuccucugccccgaguucccgggguccuuccggaagaagugcaacuucgcgacgacccccgucugcgaguacgacggcaacauggugagcggguacaagaaggugauggccaccaucgacuccuuccagagcaucaacaccuccacgaugcacuucaccgacgagcgcaucgaguggaaggaccccgacggcaugcugcgggaccacaucaacauccuggucaccaaggacaucgacuucgacaaccucggcgagaaccccugcaagaucgggcugcagaccagcagcaucgagggcgccuggggguccggcgugggguucacgcugaccugccucaucagccugaccgagugcccgaccuuccugacguccaucaaggccugcgacaaggccaucugcuacggcgcggagagcgugacccucacccgcggccagaacaccgucaagguguccgggaagggcgggcacagcggcuccaccuucaagugcugccacggggaggacugcagccaguccggccugcacgccgccgccccccaccuggacaaggugaacggcaucagcgagauggagaacuccaaggucuacgacgacggggcgccccagugcggcaucaagugcugguucgugaagagcggggaguggaucuccggcaucuucagcggcaacuggaucguccucaucgugcugugcguguuccugcucuucucccugguccugcucagcauccugugccccgugcggaagcacaagaaguccuga

SEQ ID NO: 11744 - RNA, 3408 nt, Artificial Sequence
  derived and/or modified CDS sequence (opt1) from HTNV(CGAa75)__EU092224.1__GP
auggagaucuggaaguggcuggugauggccagccucgucuggcccgcccuggcgcugcgcaacgugcacgacaugaagaucgagugcccgcacaccguguccuucggcaagaacagcgucaucggguacguggagcucccccccaugccccuggccgacaccauccagauggugccggaguccagcugcuccauggacaaccaccagagccuguccacggucaccaagcacacccaggugagcuggcggggcaaggccgaccaggcccaguccagccagaccuccuucgagacggugagcgucgagguggaccucaaggggaccugcgugcugaagcacaagcuggucgaggaguccuaccgcagccggaagucccucaccugcuacgaccugagcugcaacuccaccuacugcaagcccacgcuguacaugaucgugcccauccacgccugcaacaugaugaagagcugcaucaucgcgcucggcccccaccgcgugcaggucguguacgagcggaccuacugcaugaccggggugcugcuggagggcaagugcuucgucccggaccaguccguggugagcaucguccgccacggcaucuucgacaucgccagcgugcacaucgccugcuucuucguggccaucaccgggaacacguacaagcucuucgagcaggucaagaaguccuucggcaccaccugcaacgacaccgagaacaaggugcagggguacuacaucugcauccugggcgggaacagcccccccaucuacguccccacgcuggacgacuuccgguccauggaggcguucagcggcaucuucaaguccccgcacggcgaggaccacgaccucgccggggaggagaucgccagcuacuccaucgugggccccgccaacgccaaggugccccacagcgcguccagcgacacccugucccugaucgccuucagcgggauccccuccuacagcucccucagcauccugaccuccagcaccgaggccaagcacgucuucuccccgggccuguucccccagcucaaccacacgaagugcgacaagaccgccaucccccugaccuggaccggcaucaucgaccugcccggguacuacgaggccgugcacccgugcacgguguucugcguccucagcggccccggggcgagcugcgaggccuucuccgagggcgggaucuucaacaucaccagccccaugugccugguguccaagcagaaccgcuuccggcugaccgagcagcaggugaacuucgucugccagcgcguggacauggacaucguggucuacugcaacggccagcggaaggugauccucaccaagacgcuggugaucggccagugcaucuacaccaucaccagccuguucucccuccugcccggggucgcccacagcaucgccguggagcugugcgugccgggcuuccacgggugggccaccgcggcccuccugaucacguucugcuucggcuggguccugauccccgcccucaccuucaucgugcugaccgugcugaaguucaucgccaacaucuuccacaccuccaaccaggagaaccgccucaagaugguccugaagaagaucaaggaggaguucgagcggacgaaggggagcauggugugcgacaucugcaaguacgagugcgagaccaacaaggagcugaaggcccacggcguguccugcccccagagccagugccccuacugcuucacccacugcgagccgaccgaguccgcgagccaggcccacuaccgcgucugccaggugacccaccgguuccgcgacgaccucaagaagacggugaccccccagaacuucacccccggcugcuaccggacccugaaccuguuccgcuacaagucccggugcuacaucuucacgauguggaucugccuccugguccuggagagcauccugugggccgccuccgcgagcgagaucccgcucucccccaccuggaacgacaacgcccacggggugggcagcauccccaugcacaccgaccuggagcuggacuucagccucaccuccagcuccaaguacacguaccgccggaagcugaccaacccccuggaggagagccaggccgugaacuuccacgucgagaucgaggagcaggccaucgggguggacgugcacgcccucggccacugguucgacgggcgccugaaccugaagaccuccuuccacugcuacggcgcgugcaccaaguacgaguacccguggcacacggccaagugccacuacgagcgcgacuaccaguacgagaccagcuggggcugcaaccccuccgacugccccggggucggcaccgggugcaccgccugcggccucuaccuggaccagcugaagcccgugggcagcgccuacaagaucaucacgauccgguacucccgccgggugugcguccaguucggggaggagaaccucugcaucgugaucgacaugaacgacugcuucgugagccgccacgucaaggugugcaucaucggcaccguguccaaguucagccagggggacacccugcuguucuucggcccgcucgaggggggcggccugauccugaagcacuggugcaccuccacgugccaguucggggaccccggcgacaucaugagcccccgggacaagggguuccucugccccgaguucccgggcuccuuccgcaagaagugcaacuucgccaccacccccgucugcgaguacgggggcaacauggugagcggcuacaagaaggugauggcgaccaucgacuccuuccagagcuucaacacguccaccaugcacuucaccgacgagcggaucgaguggaaggaccccgacgggaugcugcgcgaccacaucaacauccuggucaccaaggacaucgacuucgacaaccucggcgagaaccccugcaagaucgggcugcagacgagcagcaucgagggcgccuggggguccggcgugggcuucacccugaccugccucaucagccugaccgagugcccgacguuccugaccuccaucaaggccugcgacaaggccaucugcuacggggccgagagcgugacccucacccggggccagaacacggucaagguguccgggaagggcgggcacagcggcuccaccuucaagugcugccacggcgaggacugcagccaguccgggcugcacgcggccgccccccaccuggacaaggugaacggcaucagcgagaucgagaacuccaaggucuacgacgacggggccccccagugcggcaucaagugcugguucgugaagagcggcgaguggaucuccgggaucuucagcggcaacuggaucguccucaucgugcugugcguguuccugcucuucucccugguccugcucagcauccugugccccgugcgcaagcacaaggaguccuga

SEQ ID NO: 11745 - RNA, 3408 nt, Artificial Sequence
  derived and/or modified CDS sequence (opt1) from HTNV(CGHu2)__EU363819.1__GP
augggcaucuggaaguggcuggugauggccagccucgucuggcccgccuucgcccugcgcaacguguacgacaugaagaucgagugcccgcacaccguguccuucggggagaacagcgucaucggcuacguggagcugccgcccaugccccucgccgacaccacgcagauggugcccgaguccagcugcuccauggacaaccaccagagccugaacaccaucaccaaguacacccagaucaucuggcgggggaaggccgaccagucccagagcucccagaacagcuucgagacggucuccaccggcguggaccugaaggggaccugcgugcucaagcacaagaugaucgaggagagcuaccgcucccgcaagagcaucacgugcuacgaccuguccugcaacagcaccuacugcaagcccacccuguacaugaucguccccauccacgccugcaacaugaugaaguccugccucaucgcccugggccccuaccggguccaggugguguacgagcggaccuacugcaugaccggcgugcugaucgaggggaagugcuucgugccggaccagagcgucguguccaucaucaagcacggcaucuucgacaucgcgagcgugcacaucgucugcuucuacguggccgugaaggggaacacguacaagaucuucgagcaggucaagaaguccuucgagagcaacugcaacgacaccgagaacaaggugcagggcuacuacaucugcaucaucgggggcaacagcucccccguguacguccccacccucgacgacuuccgcagcauggaggccuucuccggcaucauccggagcccccacggggaggaccacgaccuggccggcgaggagguggcguccuacagcaucgucgggccggccaacgccaaggugccccacuccgccagcuccgacacccugggccucaucgccuacagcggcauccccuccuacagcucccugagcauccugacguccagcaccgaggcgaagcacguguucucccccgggcuguucccgcagcugaaccacaccaagugcgacaagaccgccaucccccugacguggaccggcaugaucgaccuccccggguacuacgaggccauccaccccugcaccgucaucugcgugcugagcggcccgggggccagcugcgaggcccuguccgagggcggcaucuucaacaucaccagccccaugugccucguguccaagcagaaccgcuuccggcugacggagcagcaggucaacuucgugugccagcgcguggacgucgacaucaucguguacugcaacgggcagcggaaggugauccugaccaagacccucgucaucggccagugcaucuacaccaucacgagccuguucucccugcuccccgggguggcgcacagcaucgccguggagcugugcguccccggcuuccacgggugggccaccgccgcccugcucgugaccuucugcuucggcugggugcugaucccggcgaucaccuucaucauccugacgauccucaaguucaucgccaacaucuuccacaccuccaaccaggagaaccgccucaagagcguccugcggaagaucaaggaggaguucgagcgcaccaagggcuccauggugugcgacaucugcaaguacgagugcgagaccuacaaggagcucaaggcccacggggugagcugcccccagucccagugccccuacugcuucacgcacugcgagcccaccgaggccgccuuccaggcgcacuaccgggucugccaggugacccaccgcuuccgggacgaccugaagaagaccgugaccccgcagaacuucacgcccggcugcuaccgcacccugaaccucuuccgguacaagagccgcugcuacaucuucaccauguggaucugccugcugguccucgaguccauccugugggccgccagcgccuccgagaucccccugaacccgguguggaacgacaacgcgcacggggugggcagcauccccaugcacaccgaccucgagcuggacuucucccugacgagcagcuccaagcacaccuaccggcgcaagcugaccaacccccucgaggagagccaggccaucgaccugcacgucgagaucgaggagcagaccaucgggguggacgugcacgcccugggccacugguucgacggccgccucaaccugaagacguccuuccacugcuacggggccugcaccaaguacgaguaccccuggcacaccgccaagugccacuacgagcgggacuaccaguacgagaccagcuggggcugcaacccguccgacugccccggggucggcacgggcugcaccgcgugcgggcuguaccucgaccagcugaagcccgugggcagcgccuacaagaucaucaccauccgcuacucccggcgcgugugcguccaguucggggaggagaaccugugcaaggugaucgacaugaacgacugcuucgugagccggcacgucaaggugugcaucaucggcaccguguccaaguucagccagggggacacgcuccuguucuucggcccccuggagggcgggggccucaucuucaagcacuggugcaccuccacgugccaguucggggacccgggcgacaucaugagcccccgcgacaagggguuccugugccccgaguuccccggcuccuuccggaagaagugcaacuucgccaccaccccggucugcggcuacgacgggaacauggugagcggcuacaagaaggugauggccaccaucgacuccuuccagagcuucaacaccuccaccaugcacuucacggacgagcgcaucgaguggaaggaccccgacgggaugcugcgggaccacaucaacauccucgucaccaaggacaucgacuucgacaaccugggcgagaaccccugcaagaucgggcugcagaccagcuccaucgagggcgccuggggcagcggggugggcuucacccucacgugccugaucagccugaccgagugccccaccuuccucaccuccaucaaggcgugcgacaaggccaucugcuacggggccgagagcgugacgcugacccgcggccagaacaccgucaagguguccgggaagggcggccacagcggguccaccuucaagugcugccacggcgaggacugcagccaguccgggcugcacgccgccgcgccgcaccucgacaaggugaacggcaucagcgagaucgagaacuccaaggucuacgacgacggcgcgccccagugcgggaucaagugcugguucgucaagagcggcgaguggaucuccgggaucuucagcggcaacuggaucgugcugaucgugcugugcguguuccuccuguucucccugguccuccugagcauccugugccccgugcggaagcacaagaaguccuga

SEQ ID NO: 11746 - RNA, 3408 nt, Artificial Sequence
  derived and/or modified CDS sequence (opt1) from HTNV(CGHu3)__EU363818.1__GP
auggagaucuggaaguggcuggugauggccagccucgucuggcccgcccuggcgcugcgcaacgugcacgacaugaagaucgagugcccgcacaccguguccuucggcaagaacagcgucaucggguacguggagcucccccccaugccccuggccgacaccauccagauggugccggaguccagcugcuccauggacaaccaccagagccuguccacggccaccaaguacacccaggucagcuggcggggcaaggccgaccaggcccaguccagccagaccuccuucgagacggugagcguggaggucgaccucaaggggaccugcgugcugaagcacaagcugguggaggaguccuaccgcagccggaagucccucaccugcuacgaccugagcugcaacuccaccuacugcaagcccacgcuguacaugaucguccccauccacgcgugcaacaugaugaagagcugcaucaucgcccucggcccccaccgcgugcagguggucuacgagcggaccuacugcaugaccggggugcugcuggagggcaagugcuucgugccggaccaguccgucgugagcaucgugcgccacggcaucuucgacaucgccagcguccacaucgccugcuucuucguggcgaucaccgggaacacguacaagcucuucgagcaggugaagaaguccuucggcaccaccugcaacgacaccgagaacaagguccagggguacuacaucugcauccugggcgggaacagcccccccaucuacgugcccacgcuggacgacuuccgguccauggaggccuucagcggcaucuucaaguccccgcacggcgaggaccacgaccucgccggggaggagaucgccagcuacuccaucgucggccccgccaacgcgaaggugccccacagcgccuccagcgacacccugucccugaucgccuucagcgggauccccuccuacagcucccucagcauccugaccuccagcaccgaggccaagcacguguucuccccgggccuguucccccagcucaaccacacgaagugcgacaagaccgccaucccccugaccuggaccggcaucaucgaccugcccggguacuacgaggcgguccacccgugcacgguguucugcgugcucagcggccccggggccagcugcgaggccuucuccgagggcgggaucuucaacaucaccagccccaugugccuggucuccaagcagaaccgcuuccggcugaccgagcagcaggugaacuucgugugccagcgcgucgacauggacaucgugguguacugcaacggccagcggaaggucauccucaccaagacgcuggugaucggccagugcaucuacacccugaccagccucuucucccugcugcccgggguggcccacagcaucgccgucgagcucugcgugccgggcuuccacgggugggcgaccgccgcccugcugaucacguucugcuucggcugggugcucauccccgcccugaccuucaucguccugaccgugcucaaguucaucgccaacaucuuccacaccuccaaccaggagaaccgccugaagauggugcugaagaagaucaaggaggaguucgagcggacgaaggggagcauggucugcgacaucugcaaguacgagugcgagaccuacaaggagcucaaggcgcacggcguguccugcccccagagccagugccccuacugcuucacccacugcgagccgaccgaguccgccuuccaggcccacuaccgcgugugccaggucacccaccgguuccgcgacgaccugaagaagacggugaccccccagaacuucacccccggcugcuaccggacccugaaccucuuccgcuacaagagccggugcuacaucuucacgauguggaucugccugcuggugcuggaguccauccucugggccgcgagcgccuccgagaucccgcugagccccaccuggaacgacaacgcccacggggucggcuccauccccaugcacaccgaccuggagcucgacuucagccugaccagcuccagcaaguacacguaccgccggaagcugaccaacccccucgaggagucccaggccgugaacuuccacguggagaucgaggagcaggccaucggggucgacgugcacgcgcugggccacugguucgacgggcgccugaaccucaagaccagcuuccacugcuacggcgccugcaccaaguacgaguacccguggcacacggccaagugccacuacgagcgcgacuaccaguacgagaccuccuggggcugcaaccccagcgacugccccggggugggcaccgggugcaccgccugcggccuguaccuggaccagcucaagcccgucggcuccgccuacaagaucaucacgauccgguacagccgccgggugugcgugcaguucggggaggagaaccugugcaaggucaucgacaugaacgacugcuucgugucccgccacgugaaggucugcaucaucggcaccgugagcaaguucucccagggggacacccugcucuucuucggcccgcuggaggggggcggccugaucuucaagcacuggugcaccagcacgugccaguucggggaccccggcgacaucauguccccccgggacaagggguuccucugccccgaguucccgggcagcuuccgcaagaagugcaacuucgcgaccacccccgugugcgaguacgacgggaacauggucuccggcuacaagaaggugauggccaccaucgacagcuuccaguccuucaacacgagcaccaugcacuucaccgacgagcggaucgaguggaaggaccccgacggcaugcugcgcgaccacaucaacauccuggugaccaaggacaucgacuucgacaaccucggggagaaccccugcaaggucggccugcggacguccagcaucgagggggccuggggcagcggggugggcuucacccugaccugccucaucucccugaccgagugcccgacguuccugaccagcaucaaggccugcgacaaggccaucugcuacggcgcggaguccgugacccucacccgcgggcagaacacggucaaggugagcggcaaggggggccacuccgggagcaccuucaagugcugccacggcgaggacugcucccagagcggccugcacgccgccgccccccaccuggacaaggugaacgggaucuccgagaucgagaacagcaaggucuacgacgacggcgcgccccagugcgggaucaagugcugguucgugaaguccggcgaguggaucagcggcaucuucuccgggaacuggaucguccucaucgugcugugcguguuccugcucuucagccugguccugcucuccauccugugccccgugcggaagcacaagaagagcuga

SEQ ID NO: 11747 - RNA, 3408 nt, Artificial Sequence
  derived and/or modified CDS sequence (opt1) from HTNV(CGHu3612)__EF990923.1__GP
augggcaucuggaaguggcuggugauggccagccucgucuggcccgccuucgcccugcgcaaccuguacgacaugaagaucgagugcccgcacaccguguccuucggggagaacagcgugaccggcuacgucgagcucccgcccaugccccuggccgacacgacccagauggugcccgaguccagcugcuccauggacaaccaccagagccugaacaccaucaccaaguacacgcagaucaucuggcgggggaaggccgaccagucccagagcucccagaacagcuucgagaccguguccaccgaggucgaccucaaggggaccugcgugcugaagcacaagaugaucgaggagagcuaccgcucccgcaagagcaucacgugcuacgaccuguccugcaacagcaccuacugcaagcccacccucuacaugaucgugcccauccacgccugcaacaugaugaaguccugccugaucgcccuggggcccuaccgcguccaggugguguacgagcggaccuacugcaugacgggcguccucaucgagggcaagugcuucgugccggaccagagcguggucuccaucaucaagcacgggaucuucgacaucgccagcgugcacaucgugugcuucaucgucgccgugaagggcaacaccuacaagaucuucgagcaggucaagaagaccuucgagagcaacugcaacgacaccgagaacaagguccagggguacuacaucugcaucaucggcgggaacuccagccccguguacgugcccacgcuggacgacuuccgcuccauggaggccuucagcggcaucauccggagcccccacggcgaggaccacgaccuggccggggaggaggucgcguccuacuccaucgugggcccggccaacgccaaggucccccacagcgccuccagcgacacccucgggcugaucgccuacuccagcauccccuccuacagcucccugagcauccucaccuccagcaccgaggcgaagcacguguucucccccggccuguuccgccagcugaaccacacgaagugcgacaagaccgccaucccgcucaccuggaccggcaugaucgaccugcccggguacuacgaggccauccaccccugcacgguguucugcgugcugagcggccccggcgccagcugcgaggccuucuccgagggcgggaucuucaacaucgcgagcccgaugugccucguguccaagcagaaccgguuccggcugaccgagcagcaggucaacuucgugugccagcggguggacguggacaucaucgucuacugcaacggccagcgcaaggugauccugaccaagacccucgugaucggccagugcaucuacacgaucaccagccuguucucccugcuccccggggucgcccacagcaucgccguggagcugugcgugcccggcuuccacgggugggccaccgccgcgcugcucgucaccuucugcuucggcugggugcugauccccgccaucacguucaucauccugaccauccucaaguucaucgccaacaucuuccacaccuccaaccaggagaaccggcucaagagcgugcugcgcaagaucaaggaggaguucgagcggaccaagggguccauggucugcgacaucugcaaguacgagugcgagacguacaaggagcucaaggcccacggcgugagcugcccgcagucccagugccccuacugcuucacccacugcgagcccaccgaggccgcguuccaggcccacuacaaggugugccaggucacccaccgcuuccgggacgaccugaagaagaccgugacgccccagaacuucaccccgggcugcuaccgcacccugaaccucuuccgguacaagagccgcugcuacaucuucaccauguggguguuccugcugguccucgaguccauccugugggccgccagcgcguccgagaucccccugaaccccguguggaacgacaacgcccacggggugggcagcaucccgaugcacacggaccucgagcuggacuucucccugaccagcagcuccaaguacaccuaccggcgcaagcugaccaacccccucgaggagagccaggccaucgaccugcacgucgagaucgaggagcagacgaucgggguggacgugcacgcccugggccacugguucgacgggcgccucaaccugaagaccuccuuccacugcuacggcgccugcaccaaguacgaguaccccuggcacaccgcgaagugccacuacgagcgggacuaccaguacgagacgagcuggggcugcaaccccuccgacugcccgggggucggcaccgggugcaccgccugcggccuguaccucgaccagcugaagcccgugggcagcgccuacaagaucaucaccauccgcuacucccggcgcgugugcguccaguucggggaggagaaccugugcaagaucaucgacaugaacgacugcuucgugagccggcacgugaaggucugcaucaucggcacgguguccaaguucagccagggggacacccuccuguucuucggcccccuggagggcgggggccucaucuucaagcacuggugcaccagcacgugccaguucggggaccccggcgacaucaugagcccgcgcgacaagggguuccugugccccgaguuccccggcuccuuccggaagaagugcaacuucgccaccacccccgugugcgaguacgacgggaacauggucagcggcuacaagaaggugauggccaccaucgacuccauccagagcuucaacaccuccacgaugcacuucaccgacgagcgcaucgaguggaaggacccggacggcaugcugcgggaccacaucaacauccucgugaccaaggacaucgacuucgacaaccugggggagaaccccugcaagaucggccugcagaccagcuccaucgagggggcguggggcagcggggucggcuucacgcugaccugccugaucagccugaccgagugcuccaccuuccucacgagcaucaaggccugcgacaaggccaucugcuacggcgccgaguccgugacccugacccgcgggcagaacaccgugaaggucagcggcaagggcgggcacuccgggagcuccuucaagugcugccacggcgaggagugcagccagaucggccugcacgccgcggcgccccaccucgacaaggugaacgggaucuccgagauggagaacagcaagguguucgacgacggcgcgccccagugcgggaucaagugcugguucgucaaguccggcgaguggaucagcggcaucuucuccgggaacuggaucgugcugaucgugcugugcgucuuccuccuguucagccuggugcuccuguccauccugugcccgguccggaagcacaagaaguccuga

SEQ ID NO: 11748 - RNA, 3408 nt, Artificial Sequence
  derived and/or modified CDS sequence (opt1) from HTNV(CGHu3614)__EF990922.1__GP
augggcaucuggaaguggcuggugauggccagccucgucuggcccgccuucgcccugcgcaaccuguacgacaugaagaucgagugcccgcacaccguguccuucggggagaacagcgugaccggcuacgucgagcucccgcccaugccccuggccgacacgacccagauggugcccgaguccagcugcuccauggacaaccaccagagccugaacaccaucaccaaguacacgcagaucaucuggcgggggaaggccgaccagucccagagcucccagaacagcuucgagaccguguccaccgaggucgaccucaaggggaccugcgugcugaagcacaagaugaucgaggagagcuaccgcucccgcaagagcaucacgugcuacgaccuguccugcaacagcaccuacugcaagcccacccucuacaugaucgugcccauccacgccugcaacaugaugaaguccugccugaucgcccuggggcccuaccgcguccaggugguguacgagcggaccuacugcaugacgggcguccucaucgagggcaagugcuucgugccggaccagagcguggucuccaucaucaagcacgggaucuucgacaucgcgagcgugcacaucgugugcuucuucgucgccgugaagggcaacaccuacaagaucuucgagcaggucaagaagaccuucgagagcaacugcaacgacaccgagaacaagguccagggguacuacaucugcaucaucggcgggaacuccagccccguguacgugcccacgcuggacgacuuccgcuccauggaggccuucagcggcaucuuccggagcccccacggcgaggaccacgaccuggccggggaggaggucgcguccuacuccaucgugggcccggccaacgccaaggucccccacagcgccuccagcgacacccucgggcugaucgccuacuccagcauccccuccuacagcucccugagcauccucaccuccagcaccgaggcgaagcacguguucucccccggccuguucccgcagcugaaccacacgaagugcgacaagaccgccaucccccucaccuggaccggcaugaucgaccugcccggguacuacgaggccauccaccccugcacgguguucugcgugcugagcggcccgggcgccagcugcgaggccuucuccgagggcgggaucuucaacaucgcgagccccaugugccucguguccaagcagaaccgguuccggcugaccgagcagcaggucaacuucgugugccagcgcguggacguggacaucaucgucuacugcaacggccagcggaaggugauccugaccaagacccucgugaucggccagugcaucuacacgaucaccagccuguucucccugcuccccggggucgcccacagcaucgccguggagcugugcgugcccggcuuccacgggugggccaccgccgcgcugcucgucaccuucugcuucggcugggugcugaucccggccaucacguucaucauccugaccauccucaaguucaucgccaacaucuuccacaccuccaaccaggagaaccgccucaagagcgugcugcggaagaucaaggaggaguucgagcgcaccaagggguccauggucugcgacaucugcaaguacgagugcgagacguacaaggagcucaaggcccacggcgugagcugcccccagucccagugccccuacugcuucacccacugcgagcccaccgaggccgcguuccaggcccacuacaaggugugccaggucacccaccgguuccgcgacgaccugaagaagaccgugacgccgcagaacuucacccccggcugcuaccggacccugaaccucuuccgcuacaagagccggugcuacaucuucaccauguggguguuccugcugguccucgaguccauccugugggccgccagcgcguccgagaucccccugaacccgguguggaacgacaacgcccacggggugggcagcauccccaugcacacggaccucgagcuggacuucucccugaccagcagcuccaaguacaccuaccgccggaagcugaccaacccccucgaggagagccaggccaucgaccugcacgucgagaucgaggagcagacgaucgggguggacgugcacgcccugggccacugguucgacgggcgccucaaccugaagaccuccuuccacugcuacggcgccugcaccaaguacgaguaccccuggcacaccgcgaagugccacuacgagcgcgacuaccaguacgagacgagcuggggcugcaacccguccgacugccccggggucggcaccgggugcaccgccugcggccuguaccucgaccagcugaagcccgugggcagcgccuacaagaucaucaccauccgguacucccgccgggugugcguccaguucggggaggagaaccugugcaagaucaucgacaugaacgacugcuucgugagccgccacgugaaggucugcaucaucggcacgguguccaaguucagccagggggacacccuccuguucuucggcccccuggagggcgggggccucaucuucaagcacuggugcaccagcacgugccaguucggggacccgggcgacaucaugagcccccgggacaagggguuccugugccccgaguuccccggcuccuuccgcaagaagugcaacuucgccaccaccccggugugcgaguacgacgggaacauggucagcggcuacaagaaggugauggccaccaucgacuccuuccagagcuucaacaccuccacgaugcacuucaccgacgagcggaucgaguggaaggaccccgacggcaugcugcgcgaccacaucaacauccucgugaccaaggacaucgacuucgacaaccugggggagaaccccugcaagaucggccugcagaccagcuccaucgagggggcguggggcagcggggucggcuucacgcugaccugccugaucagccugaccgagugcuccaccuuccucacgagcaucaaggccugcgacaaggccaucugcuacggcgccgaguccgugacccugacccgggggcagaacaccgugaaggucagcggcaagggcgggcacuccgggagcuccuucaagugcugccacggcgaggagugcagccagaucggccugcacgccgcggcgccccaccucgacaaggugaacgggaucuccgagauggagaacagcaagguguucgacgacggcgccccgcagugcgggaucaagugcugguucgucaaguccggcgaguggaucagcggcaucuucuccgggaacuggaucgugcugaucgugcugugcgucuuccuccuguucagccuggugcuccuguccauccugugccccguccgcaagcacaagaaguccuga

SEQ ID NO: 11749 - RNA, 3408 nt, Artificial Sequence
  derived and/or modified CDS sequence (opt1) from HTNV(CGRn15)__EU363814.1__GP
auggagaucuggaaguggcuggugauggccagccucgucuggcccgcccuggcgcugcgcaacgugcacgacaugaagaucgagugcccgcacaccguguccuucggcaagaacagcgucaucggguacguggagcucccccccaugccccuggccgacaccauccagauggugccggaguccagcugcuccauggacaaccaccagagccuguccacggucaccaaguacacccaggugagcuggcggggcaaggccgaccaggcccaguccagccagaccuccagcgagacgguguccgucgagguggaccucaaggggaccugcgugcugaagcacaagcuggucgaggagagcuaccgcucccggaagagccucaccugcuacgaccuguccugcaacagcaccuacugcaagcccacgcuguacaugaucgugcccauccacgccugcaacaugaugaaguccugcaucaucgcgcucggcccccaccgcgugcaggucguguacgagcggaccuacugcaugaccggggugcugcuggagggcaagugcuucgucccggaccagagcguggugagcaucguccgccacggcaucuucgacaucgccuccgugcacaucgccugcuucuucguggccaucaccgggaacacguacaagcucuucgagcaggucaagaagagcuucggcaccaccugcaacgacaccgagaacaaggugcagggguacuacaucugcauccugggcgggaacuccccccccaucuacguccccacgcuggacgacuuccggagcauggaggcguucuccggcaucuucaagagcccgcacggcgaggaccacgaccucgccggggaggagaucgccuccuacagcaucgugggccccgccaacgccaaggugccccacuccgcgagcuccgacacccugagccugaucgccuucuccgggauccccagcuacuccagccucuccauccugaccagcuccaccgaggccaagcacgucuucagcccgggccuguucccccagcucaaccacacgaagugcgacaagaccgccaucccccugaccuggaccggcaucaucgaccugcccggguacuacgaggccgugcacccgugcacgguguucugcguccucagcggccccggggcguccugcgaggccuucagcgagggcgggaucuucaacaucaccucccccaugugccuggugagcaagcagaaccgcuuccggcugaccgagcagcaggugaacuucgucugccagcgcguggacauggacaucguggucuacugcaacggccagcggaaggugauccucaccaagacgcuggugaucggccagugcaucuacaccaucaccucccuguucagccuccugcccggggucgcccacuccaucgccguggagcugugcgugccgggcuuccacgggugggccaccgcggcccuccugaucacguucugcuucggcuggguccugauccccgcccucaccuucaucgugcugaccgugcugaaguucaucgccaacaucuuccacaccagcaaccaggagaaccgccucaagaugguccugaagaagaucaaggaggaguucgagcggacgaagggguccauggugugcgacaucugcaaguacgagugcgagaccuacaaggagcugaaggcccacggcgugagcugcccccagucccagugccccuacugcuucacccacugcgagccgaccgagagcgcguuccaggcccacuaccgcgucugccaggugacccaccgguuccgcgacgaccucaagaagacggugaccccccagaacuucacccccggcugcuaccggacccugaaccuguuccgcuacaagucccggugcuacaucuucacgauguggaucugccuccugguccuggagagcauccugugggccgccuccgcgagcgagaucccgcucucccccaccuggaacgacaacgcccacggggugggcagcauccccaugcacaccgaccuggagcuggacuucagccucaccuccagcuccaaguacacguaccgccggaagcugaccaacccccuggaggagagccaggccgugaacuuccacgucgagaucgaggagcaggccaucgggguggacgugcacgcccucggccacugguucgacgggcgccugaaccugaagaccuccuuccacugcuacggcgcgugcaccaaguacgaguacccguggcacacggccaagugccacuacgagcgcgacuaccaguacgagaccagcuggggcuccaaccccagcgacugccccggggucggcaccgggugcaccgccugcggccucuaccuggaccagcugaagcccgugggcuccgccuacaagaucaucacgauccgguacagccgccgggugugcguccaguucggggaggagaaccucugcaaggugaucgacaugaacgacugcuucgugucccgccacgucaaggugugcaucaucggcaccgugagcaaguucucccagggggacacccugcuguucuucggcccgcucgaggggggcggccugaucuucaagcacuggugcaccagcacgugccaguucggggaccccggcgacaucauguccccccgggacaagggguuccugugccccgaguucccgggcagcuuccgcaagaagugcaacuucgccaccacccccgucugcgaguacgacgggaacaugguguccggcuacaagaaggugauggcgaccaucgacagcuuccaguccagcaacacgagcaccaugcacuucaccgacgagcggaucgaguggaaggaccccgacggcaugcuccgcgaccacaucaacauccuggucaccaaggacaucgacuucgacaaccugggggagaaccccugcaagaucggccuccagacguccagcaucgagggggccuggggcuccggggugggcuucacccugaccugccugaucagccucaccgagugcccgacguuccugaccuccaucaaggccugcgacaaggccaucugcuacggcgccgagagcgugacccugacccgggggcagaacacggucaagguguccggcaaggggggccacagcggguccaccuucaagugcugccacggcgaggacugcagccaguccggccuccacgcggccgccccccaccuggacaaggugaacgggaucagcgagaucgagaacuccaaggucuacgacgacggcgccccccagugcggggugaagugcugguucgucaagagcggcgaguggaucuccggcaucuucagcgggaacuggaucgugcugaucgugcucugcgucuuccugcuguucucccucgugcugcugagcauccucugccccgugcgcaagcacaagaaguccuga

SEQ ID NO: 11750 - RNA, 3408 nt, Artificial Sequence
  derived and/or modified CDS sequence (opt1) from HTNV(CGRn2616)__EU363816.1__GP
auggagaucuggaaguggcuggugauggccagccucgucuggcccgcccuggcgcugcgcaacgugcacgacaugaagaucgagugcccgcacaccguguccuucggcaagaacagcgucaucggguacguggagcucccccccaugccccuggccgacaccauccagauggugccggaguccagcugcuccauggacaaccaccagagccuguccacggucaccaagcacacccaggugagcuggcggggcaaggccgaccaggcccaguccagccagaccuccuucgagacggugagcgucgagguggaccucaaggggaccugcgugcugaagcacaagcuggucgaggaguccuaccgcagccggaagucccucaccugcuacgaccugagcugcaacuccaccuacugcaagcccacgcuguacaugaucgugcccauccacgccugcaacaugaugaagagcugcaucaucgcgcucggcccccaccgcgugcaggucguguacgagcggaccuacugcaugaccggggugcugcuggagggcaagugcuucgucccggaccaguccguggugagcaucguccgccacggcaucuucgacaucgccagcgugcacaucgccugcuucuucguggccaucaccgggaacacguacaagcucuucgagcaggucaagaaguccuucggcaccaccugcaacgacaccgagaacaaggugcagggguacuacaucugcauccugggcgggaacagcccccccaucuacguccccacgcuggacgacuuccgguccauggaggcguucagcggcaucuucaaguccccgcacggcgaggaccacgaccucgccggggaggagaucgccagcuacuccaucgugggccccgccaacgccaaggugccccacagcgcguccagcgacacccugucccugaucgccuucagcgggauccccuccuacagcucccucagcauccugaccuccagcaccgaggccaagcacgucuucuccccgggccuguucccccagcucaaccacacgaagugcgacaagaccgccaucccccugaccuggaccggcaucaucgaccugcccggguacuacgaggccgugcacccgugcacgguguucugcguccucagcggccccggggcgagcugcgaggccuucuccgagggcgggaucuucaacaucaccagccccaugugccugguguccaagcagaaccgcuuccggcugaccgagcagcaggugaacuucgucugccagcgcguggacauggacaucguggucuacugcaacggccagcggaaggugauccucaccaagacgcuggugaucggccagugcaucuacaccaucaccagccuguucucccuccugcccggggucgcccacagcaucgccguggagcugugcgugccgggcuuccacgggugggccaccgcggcccuccugaucacguucugcuucggcuggguccugauccccgcccucaccuucaucgugcugaccgugcugaaguucaucgccaacaucuuccacaccuccaaccaggagaaccgccucaagaugguccugaagaagaucaaggaggaguucgagcggacgaaggggagcauggugugcgacaucugcaaguacgagugcgagaccaacaaggagcugaaggcccacggcguguccugcccccagagccagugccccuacugcuucacccacugcgagccgaccgaguccgcguuccaggcccacuaccgcgucugccaggugacccaccgguuccgcgacgaccucaagaagacggugaccccccagaacuucacccccggcugcuaccggacccugaaccuguuccgcuacaagagccggugcuacaucuucacgauguggaucugccuccugguccuggaguccauccugugggccgccagcgcguccgagaucccgcucagccccaccuggaacgacaacgcccacggggugggcuccauccccaugcacaccgaccuggagcuggacuucagccucaccagcuccagcaaguacacguaccgccggaagcugaccaacccccuggaggagucccaggccgugaacuuccacgucgagaucgaggagcaggccaucgggguggacgugcacgcccucggccacugguucgacgggcgccugaaccugaagaccagcuuccacugcuacggcgcgugcaccaaguacgaguacccguggcacacggccaagugccacuacgagcgcgacuaccaguacgagaccuccuggggcugcaaccccagcgacugccccggggucggcaccgggugcaccgccugcggccucuaccuggaccagcugaagcccgugggcuccgccuacaagaucaucacgauccgguacagccgccgggugugcguccaguucggggaggagaaccucugcaucgugaucgacaugaacgacugcuucgugucccgccacgucaaggugugcaucaucggcaccgugagcaaguucucccagggggacacccugcuguucuucggcccgcucgaggggggcggccugaucuucaagcacuggugcaccagcacgugccaguucggggaccccggcgacaucauguccccccgggacaagggguuccugugccccgaguucccgggcagcuuccgcaagaagugcaacuucgccaccacccccgucugcgaguacgggggcaacaugguguccggcuacaagaaggugauggcgaccaucgacagcuuccaguccuucaacacgagcaccaugcacuucaccgacgagcggaucgaguggaaggaccccgacgggaugcuccgcgaccacaucaacauccuggucaccaaggacaucgacuucgacaaccugggcgagaaccccugcaagaucgggcuccagacguccagcaucgagggcgccugggggagcggcgugggcuucacccugaccugccugaucucccucaccgagugcccgacguuccugaccagcaucaaggccugcgacaaggccaucugcuacggggccgaguccgugacccugacccggggccagaacacggucaaggugagcgggaagggcgggcacuccggcagcaccuucaagugcugccacggcgaggacugcucccagagcgggcuccacgcggccgccccccaccuggacaaggugaacggcaucuccgagaucgagaacagcaaggucuacgacgacggggccccccagugcggcaucaagugcugguucgugaaguccggcgaguggaucagcgggaucuucuccggcaacuggaucguccugaucgugcucugcguguuccugcuguucagccucguccugcuguccauccucugccccgugcgcaagcacaagaagagcuga

SEQ ID NO: 11751 - RNA, 3408 nt, Artificial Sequence
  derived and/or modified CDS sequence (opt1) from HTNV(CGRn2618)__EU363817.1__GP
auggagaucuggaaguggcuggugauggccagccucgucuggcccgcccuggcgcugcgcaacgugcacgacaugaagaucgagugcccgcacaccguguccuucggcaagaacagcgucaucggguacguggagcucccccccaugccccuggccgacaccauccagauggugccggaguccagcugcuccauggacaaccaccagagccuguccacggucaccaaguacacccaggugagcuggcggggcaaggccgaccaggcccaguccagccagacccccuucgagacgguguccgucgagguggaccucaagcgcaccugcgugcugaagcacaagcuggucgaggagagcuaccggucccgcaagagccucaccugcuacgaccuguccugcaacagcaccuacugcaagcccacgcuguacaugaucgugcccauccacgccugcaacaugaugaaguccugcaucaucgcgcucgggccgcaccgggugcaggucguguacgagcgcaccuacugcaugaccggcgugcugcuggaggggaagugcuucguccccgaccagagcgugguguccaucguccggcacggcaucuucgacaucgccagcgugcacaucgccugcuucuucguggccaucaccggcaacacguacaagcucuucgagcaggucaagaagagcuucgggaccaccugcaacgacaccgagaacaaggugcagggcuacuacaucugcauccuggggggcaacuccccccccaucuacgucccgacgcuggacgacuuccgcagcauggaggcguucuccgggaucuucaagagcccccacggcgaggaccacgaccucgccggcgaggagaucgccuccuacagcaucguggggcccgccaacgccaaggugccccacuccgcgagcuccgacacccugagccugaucgccuucuccggcaucccgagcuacuccagccucuccauccugaccagcuccaccgaggccaagcacgucuucagccccgggcuguucccccagcucaaccacacgaagugcgacaagaccgccaucccccugaccuggaccggcaucaucgaccugccgggcuacuacgaggccgugcaccccugcacgguguucugcguccucuccgggcccggcgcgagcugcgaggccuucagcgaggggggcaucuucaacaucaccucccccaugugccuggugagcaagcagaaccgguuccgccugaccgagcagcaggugaacuucgucugccagcggguggacauggacaucguggucuacugcaacgggcagcgcaaggugauccucaccaagacgcuggugaucggccagugcaucuacaccaucaccucccuguucagccuccugccgggcgucgcccacuccaucgccguggagcugugcgugcccggguuccacggcugggccaccgcggcccuccugaucacguucugcuucggguggguccugauccccgcccucaccuucaucgugcugaccgugcugaaguucaucgccaacaucuuccacaccagcaaccaggagaaccggcucaagaugguccugaagaagaucaaggaggaguucgagcgcacgaagggcuccauggugugcgacaucugcaaguacgagugcgagaccuacaaggagcugaaggcccacggggugagcugcccccagucccagugcccguacugcuucacccacugcgagcccaccgagagcgcguuccaggcccacuaccgggucugccaggugacccaccgcuuccgggacgaccucaagaagacggugaccccccagaacuucaccccgggcugcuaccgcacccugaaccuguuccgguacaagucccgcugcuacauccucacgauguggaaccugcugcugauccccggcuaccggcucugggccgccagcgcguccgagaucccccugagccccaccuggaacgacaacgcccacggggucggcuccaucccgaugcacaccgaccuggagcucgacuucagccugaccuccagcagcaaguacacguaccgccgcaagcugaccaacccccucgaggagucccaggccgugaacuuccacguggagaucgaggagcaggccaucggggucgacgugcacgcccugggccacugguucgacgggcggcugaaccucaagaccagcuuccacugcuacggcgcgugcaccaaguacgaguaccccuggcacacggccaagugccacuacgagcgcgacuaccaguacgagaccuccuggggcugcaaccccagcgacugcccgggggugggcaccgggugcaccgccugcggccuguaccuggaccagcucaagcccgucggcuccgccuacaagaucaucacgauccgguacagccgccgggugugcgugcaguucggggaggagaaccugugcaucgucaucgacaugaacgacugcuucgugucccgccacgugaaggucugcaucaucggcaccgugagcaaguucucccagggggacacccugcucuucuucggcccccuggaggggggcggccugaucuucaagcacuggugcaccagcacgugccaguucggggaccccggcgacaucauguccccgcgggacaagggguuccucugccccgaguuccccggcagcuuccgcaagaagugcaacuucgccaccacccccgugugcgaguacgggggcaacauggucuccggcuacaagaaggugauggcgaccaucgacagcuuccaguccuucaacacgagcaccaugcacuucaccgacgagcggaucgaguggaaggacccggacgggaugcugcgcgaccacaucaacauccuggugaccaaggacaucgacuucgacaaccucggcgagaaccccugcaagaucgggcugcagacguccagcaucgagggcgccuggggguccggcgucggcuucacccugaccugccucaucagccugaccgagugccccacguuccugaccagcaucaaggccugcgacaaggccaucugcuacggggccgaguccgugacccucacccggggccagaacacggugaaggucagcgggaagggcgggcacuccggcagcaccuucaagugcugccacggcgaggacugcucccagagcgggcugcacgcggccgccccccaccuggacaaggugaacggcaucuccgagaucgagaacagcaagguguacgacgacggggccccgcagugcggcaucaagugcugguucgucaaguccggcgaguggaucagcgggaucuucuccggcaacuggaucgugcucaucguccugugcguguuccugcucuucagccuggugcugcucuccauccugugccccguccgcaagcacaagaagagcuga

SEQ ID NO: 11752 - RNA, 3408 nt, Artificial Sequence
  derived and/or modified CDS sequence (opt1) from HTNV(CGRn45)__EU092225.1__GP
auggagaucuggaaguggcuggugauggccagccucgucuggcccgcccuggcgcugcgcaacgugcacgacaugaagaucgagugcccccacaccgugagcuucggcaagaacagcgucaucggguacguggagcucccgcccaugccccuggccgacaccauccagauggugcccgaguccagcugcuccauggacaaccaccagagccuguccacggucaccaaguacacccaggugagcuggcggggcaaggccgaccaggcccaguccagccagaccuccuucgaggccgugagcgucgagguggaccucaaggggacgugcgugcugaagcacaagcuggucgaggaguccuaccgcagccggaagucccugaccugcuacgaccucagcugcaacuccaccuacugcaagcccacccuguacaugaucgugcccauccacgcgugcaacaugaugaaguccugcaucaucgcccucggcccccaccgcgugcaggucguguacgagcggacguacugcaugaccggggugcugcuggagggcaagugcuucgucccggaccaguccguggugagcaucguccgccacggcaucuucgacaucgccagcgugcacaucgccugcuucuucguggcgaucaccgggaacaccuacaagcuguucgagcaggucaagaaguccuucggcacgaccugcaacgacaccgagaacaaggugcagggguacuacaucugcauccucggcgggaacagcccgcccaucuacguccccacccuggacgacuuccgguccauggaggccuucagcggcaucuucaagagcccccacggcgaggaccacgaccucgccggggaggagaucgccuccuacuccaucgugggccccgccaacgcgaaggugccccacagcgccuccagcgacacgcugucccugaucgccuucagcgggauccccuccuacagcucccucagcauccugaccuccagcaccgaggccaagcacgucuucuccccgggccuguucccccagcucaaccacaccaagugcgacaagacggccaucccccugaccuggaccggcaucaucgaccugcccggguacuacgaggcggugcacccgugcaccguguucugcguccucagcggccccggggccagcugcgaggccuucuccgagggcgggaucuucaacaucacgagccccaugugccugguguccaagcagaaccgcuuccggcugaccgagcagcaggucaacuucgugugccagcgcguggacauggacaucguggucuacugcaacggccagcggaaggugauccucaccaagacccuggugaucggccagugcaucuacacgaucaccagccuguucucccuccugcccggggucgcccacagcaucgccguggagcugugcgugccgggcuuccacgggugggcgaccgccgcccuccugaucaccuucugcuucggcuggguccugauccccgcccucacguucaucgugcugaccgugcugaaguucaucgccaacaucuuccacaccuccaaccaggagaaccgccucaagaugguccugaagaagaucaaggaggaguucgagcggaccaaggggagcauggugugcgacaucugcaaguacgagugcgagacguacaaggagcugaaggcgcacggcguguccugcccccagagccagugccccuacugcuucacccacugcgagccgaccgaguccgccuuccaggcccacuaccgcgucugccaggugacccaccgguuccgcgacgaccucaagaagaccgugacgccccagaacuucacccccggcugcuaccggacccugaaccuguuccgcuacaagagccggugcuacaucuucaccauguggaucugccuccugguccuggaguccauccugugggccgcgagcgccuccgagaucccgcucagccccacguggaacgacaacgcccacggggugggcuccauccccaugcacaccgaccuggagcuggacuucagccucaccagcuccagcaaguacaccuaccgccggaagcugacgaacccccuggaggagucccaggccgugaacuuccacgucgagaucgaggagcaggccaucgggguggacgugcacgcgcucggccacugguucgacgggcgccugaaccugaagaccagcuuccacugcuacggcgccugcaccaaguacgaguacccguggcacaccgccaagugccacuacgagcgcgaccaccaguacgagacguccuggggcugcaaccccagcgacugccccggggucggcaccgggugcaccgccugcggccucuaccuggaccagcugaagcccgugggcuccgccuacaagaucaucaccauccgguacagccgccgggugugcguccaguucggggaggagaaccucugcaaggugaucgaccgcaacgacugcuucgugucccggcacgucaaggugugcaucaucggcacggugagcaaguucucccagggggacacccugcuguucuucggcccgcucgagggcgggggccugaucuucaagcacuggugcaccagcacgugccaguucggggaccccggcgacaucaugagcccccgcgacaagggguuccugugccccgaguucccgggcagcuuccggaagaagugcaacuucgcgaccacccccgucugcgaguacgacgggaacaugguguccggcuacaagaaggugauggccaccaucgacagcuuccaguccuucaacaccagcacgaugcacuucaccgacgagcgcaucgaguggaaggaccccgacggcaugcuccgggaccacaucaacauccuggucaccaaggacaucgacuucgacaaccugggggagaaccccugcaagaucggccuccagaccuccagcaucgagggggccuggggcagcggggugggcuucacgcugaccugccugaucucccucaccgagugcccgaccuuccugacgagcaucaaggccugcgacaaggccaucugcuacggcgcggaguccgugacccugacccgcgggcagaacaccgucaaggugagcggcaagggcgggcacuccgggagcacguucaagugcugccacggcgaggacugcucccagagcggccuccacgccgccgccccgcaccuggacaaggugaacgggaucuccgagaucgagaacagcaaggucuacgacgacggcgcgccccagugcgggaucaagugcugguucgugaaguccggcgaguggaucagcggcaucuucuccgggaacuggaucguccugaucgugcucugcguguuccugcuguucagccucguccugcuguccauccucugccccgugcggaagcacaagaaguccuga

SEQ ID NO: 11753 - RNA, 3408 nt, Artificial Sequence
  derived and/or modified CDS sequence (opt1) from HTNV(CGRn53)__EF990921.1__GP
augggcaucuggaaguggcuggugauggccagccucgucuggcccgccuacacccugcgcaacguguacgacaugaagaucgagugcccgcacaccguguccuucggggagaacagcgucaucggcuacguggagcugccccccaucccccucgcggacacgacccagauggugccggaguccagcugcuccauggacaaccaccagagccugaacaccaucaccaaguacacgcaggucuccuggcgggggaaggccggccaggcccaggccagccagaacuccuucgaggccgugagcgcggagguggaccugaaggggaccugcguccucaagcacaagaugcuggaggaguccuaccgcagccggaaguccaucgccugcuacgaccugagcugcaacuccaccuacugcaagcccacccucuacaugaucgugcccauccacgccugcaacaugaugaagagcugccugaucgcccugggcccccaccgcgugcaggucguguacgagcggacguacugcaugaccggcgugcucaucgaggggaagugcuucgucccggaccaguccguggugagcaucaucaagcacggcaucuucgacaucgcguccguccacaucgugugcuucuucguggccgucaaggggaacaccuacaagaucuucgagcagaucaagaagagcuucgagagcaccugcaacgacacgaagaacaaggugcagggcuacuacaucugcaucguggggggcaacuccgcccccaucuacguccccacccuggacgacuuccgcagcauggaggccuucuccggcaucuuccggagcccccacggggaggaccacgaccuggccggcgaggagaucgcguccuacagcaucguggggccggccaacgccaaggucccccacuccgccagcuccgacacccucagccugaccgccuacuccggcauccccagcuacuccagccuguccauccucgcgggcagcgccgaggccaagcacguguucucccccggguucuucccgcagcugaaccacacgaagugcgacaagaccgccaucccccugauguggaccggcaugaucgaccuccccggguacuacgaggccauccaccccugcaccguguucugcguccugagcggcccgggggcguccugcgaggccuucagcgagggcggcaucuucaacaucacgagccccaugugccugguguccaagcagaaccgcuuccggcucaccgagcagcaggugaacuucgucugccagcgcguggacauggacaucaucguguacugcaacgggcagcggaaggucauccugaccaagacccuggugaucggccagugcaucuacacgaucaccagccucuucucccugcugcccgggguggcccacagcaucgccgucgagcucugcgugcccggcuuccacgggugggccaccgcggcccugcuggugaccuucugcuucggcuggguccucaucccggccaugacguucaucgugcugaccauccugaaguucaucgccaacaucuuccacaccuccaaccaggagaacaagcucaagagcgugcugcgcaagaucaaggaggaguucgagaagaccaagggcuccauggucugcgacgugugcaaguacgagugcgagacguacaaggagcugaaggcgcacggggugagcugcccccagucccagugccccuacugcuucacccacugcgagcccaccgaggccgccuuccaggcccacuaccgggucugccaggugacccaccgcuuccgggacgaccucaagaagacggugaccccgcagaacuucacccccggcugcuaccgcacccugaaccuguuccgguacaagagccgcugcuacauccucaccauguggaaccugcugcucguccccggguaccgggccugggcggccuccgccagcgagaucccgcugaaccccguguggaacgacaacgcccacggcgugggguccguccccaugcacacggaccuggagcucgacuucagccugaccuccagcuccaaguacaccuaccgccggaagcugaccaacccccuggaggagagccaggccaucaaccuccacaucgagaucgaggagcagacgaucggcguggacgugcacgcgcugggccacugguucgucgggcgccugaaccucaagaccagcuuccacugcuacggcgccugcaccaaguacgaguacccguggcacaccgccaagugccacuacgagcgcgacuaccaguacgagacguccugggggugcaaccccagcgacugccccggcgugggcaccgggugcaccgccugcggccuguaccuggaccagcucaagcccgugggguccgccuacaagaucaucaccauccgguacagccgccgggucugcgugcaguucggcgaggagaaccugugcaagaucaucgacaugaacgacugcuucgugucccgccacgucaaggugugcaucaucgggacggugagcaaguucucccagggcgacacccugcucuucuucggcccgcuggaggggggcgggcugaucuucaagcacuggugcaccagcaccugccaguucggcgaccccggggacaucauguccccccgggacaagggcuuccucugccccgaguucccgggcagcuuccgcaagaagugcaacuucgcgacgaccccccugugcgaguacgacgggaacauggucuccggcuacaagaaggugauggccaccaucgacagcuuccaguccuucaacaccagcacgaugcacuucaccgacgagcggaucgaguggaaggaccccgacgggaugcugcgcgaccacaucaacauccucgugaccaaggacaucgacuucgagaaccugggcgagaaccccugcaagaucgggcugcagaccuccagcaucgagggcgccuggggcuccggggucggcuucacgcucaccugccuggugagccugaccgagugcccgaccuuccucacguccaucaaggccugcgacaaggcgaucugcuacggggccgagagcgugacccugacccggggccagaacaccgucaaggugagcgggaagggcggccacuccgggagcacguucaagugcugccacggcgaggagugcucccagaucgggcugcacgccgccgccccccaccucgacaaggugaacggcaucagcgagaucgagaacaacaaggucuacgacgacggcgcgccccagugcgggaucaagugcugguucgugaaguccggcgaguggaucagcgggaucuucuccggcaacuggaucgugcugaucguccugugcguguuccuccuguucagccugauccuccuguccauccugugccccguccgcaagcacaagaagagcuga

SEQ ID NO: 11754 - RNA, 3408 nt, Artificial Sequence
  derived and/or modified CDS sequence (opt1) from HTNV(CGRn93MP8)__EF990919.1__GP
augggcaucuggaaguggcuggugaaggccagccucgucuggcccgccuacacccugcgcaacguguacgacaugaagaucgagugcccgcacaccguguccuucggggagaacagcgucaucggcuacguggagcugccgcccaucccccucgccgacacgacccacauggugcccgaguccagcugcuccauggacaaccaccagagccugaacaccaucaccaaguacacgcaggucuccuggcgggggaaggccgaccaggcccaggccagccagaacuccuucgaggccgugagcgcggagguggaccugaaggggaccugcguccucaagcacaagaugcuggaggaguccuaccgcagccggaaguccaucgccugcuacgaccugagcugcaacuccaccuacugcaagcccacccucuacaugaucgugcccauccacgccugcaacaugaugaaguccugccugaucgcccuggggccccaccgcgugcaggucguguacgagcggacguacugcaugaccggcuuccucaucgagggcaagugcuucgugccggaccgcagcgucgugagcaucaucaagcacgggaucuucgacaucgcguccgugcacaucgucugcuucuucguggccgugaagggcaacaccuacaagaucuucgagcagaucaagaaguccuucgagagcacgugcaacgacaccaagaacaagguccagggguacuacaucugcaucgugggcgggaacagcgcccccaucuacgugcccacccuggacgacuuccggagcauggaggccuucuccggcaucuuccgcagcccccacggcgaggaccacgaccuggccggggaggagaucgcguccuacagcaucgucggcccggccaacgccaaggugccccacuccgccagcuccgacacccucagccugaccgccuacuccgggauccccagcuacuccagccuguccauccucgcgggcagcgccgaggccaagcacgucuucucccccggcuuccugccgcagcugaaccacacgaagugcgacaagaccgccaucccccucauguggaccgggaugaucgaccugcccggcuacuacgaggccauccaccccugcaccguguucugcgugcugagcgggccgggcgcguccugcgaggccuucagcgagggcggcaucuucaacaucacgagccccaugugccucgucuccaagcagaaccgguuccgccugaccgagcagcaggucaacuucgugugccagcggguggacauggacaucaucguguacugcaacggccagcgcaaggugauccugaccaagacccucgucaucgggcagugcaucuacacgaucaccagccuguucucccugcuccccggcguggcccacagcaucgccguggagcugugcguccccggguuccacggcugggccaccgcggcccugcucgugaccuucugcuucgggugggugcugaucccggccaugacguucaucguccugaccauccucaaguucaucgccaacaucuuccacaccuccaaccaggagaacaagcucaagagcgugcugcggaagaucaaggaggaguucgagaagaccaagggcuccauggugugcgacgucugcaaguacgagugcgagacguacaaggagcugaaggcgcacggcgugagcugcccccagucccagugccccuacugcuucacccacugcgagcccaccgaggccgccuuccaggcccacuaccgcgugugccaggucacccaccgguuccgcgacgaccugaagaagacggugaccccgcagaacuucacccccgggugcuaccggacccugaaccucuuccgcuacaagagccggugcuacaucuucaccauguggguguuccugcugguccucgaguccauccugugggccgcgagcgccuccgagaucccccugaacccgguguggaacgacaacgcccacggcguggggagcguccccaugcacacggaccucgagcuggacuucucccugaccagcuccagcaaguacaccuaccgccggaagcugaccaacccccucgaggagagccaggccaucaaccugcacaucgagaucgaggagcagacgaucggcguggacgugcacgcccuggggcacugguucgacggccgccucaaccugaagaccuccuuccacugcuacggcgcgugcaccaaguacgaguaccccuggcacaccgccaagugccacuacgagcgcgacuaccaguacgagacgagcugggggugcaacccguccgacugccccggcgucgggaccggcugcaccgccugcggccuguaccucgaccagcugaagcccguggggagcgccuacaagaucaucaccauccgguacucccgccgggugugcguccaguucggcgaggagaaccugugcaagaucaucgacaugaacgacugcuucgugagccgccacgugaaggucugcaucaucgggacgguguccaaguucagccagggcgacacccuccuguucuucgggccccuggagggcggcgggcucaucuucaagcacuggugcaccuccacgugccaguucggcgacccgggggacaucaugagcccccgggacaagggcuuccugugccccgaguuccccggguccuuccgcaagaagugcaacuucgccaccaccccgcugugcgaguacgacggcaacauggugagcggcuacaagaaggucauggcgaccaucgacuccuuccagagcuucaacaccuccacgaugcacuucaccgacgagcggaucgaguggaaggaccccgacgggaugcuccgcgaccacaucaacauccuggugaccaaggacaucgacuucgagaaccugggcgagaaccccugcaagaucgggcuccagaccagcuccaucgagggcgccugggggagcggcgugggcuucacgcugaccugccuggucucccucaccgagugccccaccuuccugacgagcaucaaggccugcgacaaggccaucugcuacggggcggagagcgugacccugacccggggccagaacaccgugaaggucuccgggaagggcgggcacagcggcuccacguucaagugcugccacggcgaggagugcagccagaucgggcuccacgccgccgccccgcaccuggacaaggugaacggcaucuccgagaucgagaacaacaagguguacgacgacggggcgccccagugcggcaucaagugcugguucgucaagagcggcgaguggaucuccgggaucuucagcggcaacuggaucgugcugaucgugcucugcgucuuccugcuguucucccucauccugcugagcauccucugccccgugcgcaagcacgagaaguccuga

SEQ ID NO: 11755 - RNA, 3408 nt, Artificial Sequence
  derived and/or modified CDS sequence (opt1) from HTNV(CGRn93P8)__EF990918.1__GP
augggcaucuggaaguggcuggugauggccagccucgucuggcccgccuacacccugcgcaacguguacgacaugaagaucgagugcccgcacaccguguccuucggggagaacagcgucaucggcuacguggagcugccgcccaucccccucgccgacacgacccagauggugcccgaguccagcugcuccauggacaaccaccagagccugaacaccaucaccaaguacacgcaggucuccuggcgggggaaggccgaccaggcccaggccagccagaacuccuucgaggccgugagcgcggagguggaccugaaggggaccugcguccucaagcacaagaugcuggaggaguccuaccgcagccggaaguccaucgccugcuacgaccugagcugcaacuccaccuacugcaagcccacccucuacaugaucgugcccauccacgccugcaacaugaugaaguccugccugaucgcccuggggccccaccgcgugcaggucguguacgagcggacguacugcaugaccggcgugcucaucgagggcaagugcuucgucccggaccgcagcguggugagcaucaucaagcacgggaucuucgacaucgcguccguccacaucgugugcuucuucguggccgucaagggcaacaacuacaagaucuucgagcagaucaagaaguccuucgagagcacgugcaacgacaccaagaacaaggugcagggguacuacaucugcaucgugggcgggaacagcgcccccaucuacguccccacccuggacgacuuccggagcauggaggccuucuccggcaucuuccgcagcccccacggcgaggaccacgaccuggccggggaggagaucgcguccuacagcaucgugggcccggccaacgccaaggucccccacuccgccagcuccgacacccucagccugaccgccuacuccgggauccccagcuacuccagccuguccauccucgcgggcagcgccgaggccaagcacguguucucccccggcuucuucccgcagcugaaccacaccaagugcgacaagacggccaucccccugauguggaccgggaugaucgaccuccccggcuacuacgaggccauccaccccugcaccguguucugcguccugagcgggccgggcgcguccugcgaggccuucagcgagggcggcaucuucaacaucaccagccccaugugccugguguccaagcagaaccgguuccgccucacggagcagcaggucaacuucgugugccagcggguggacauggacaucaucguguacugcaacggccagcgcaaggucauccugaccaagacccuggugaucgggcagugcaucuacaccaucacgagccucuucucccugcugcccggcguggcccacagcaucgccgucgagcucugcgugcccggguuccacggcugggccaccgcggcccugcuggugaccuucugcuucggguggguccucaucccggccaugaccuucaucgugcugacgauccugaaguucaucgccaacaucuuccacaccuccaaccaggagaacaagcucaagagcgugcugcggaagaucaaggaggaguucgagaagaccaagggcuccauggucugcgacgugugcaaguacgagugcgagaccuacaaggagcugaaggcgcacggcgugagcugcccccagucccagugccccuacugcuucacgcacugcgagcccaccgaggccgccuuccaggcccacuaccgcgucugccaggugacccaccgguuccgcgacgaccucaagaagaccgugacgccgcagaacuucacccccgucugcuaccggacccugaaccuguuccgcuacaagagccggugcuacaucuucaccauguggguguuccuccuggugcuggaguccauccucugggccgcgagcgccuccgagaucccccugaacccggucuggaacgacaacgcccacggggugggcagcgugcccaugcacaccgaccuggagcucgacuucucccugacgagcuccagcaaguacaccuaccgccggaagcugaccaacccccuggaggagagccaggccaucaaccuccacaucgagaucgaggagcagaccaucggggucgacgugcacgcccugggccacugguucgacgggcgccugaaccucaagacguccuuccacugcuacggcgcgugcaccaaguacgaguaccccuggcacaccgccaagugccacuacgagcgcgacuaccaguacgagaccagcuggggcugcaacccguccgacugccccggggugggcacggggugcaccaucugcggccuguaccuggaccagcucaagcccgucggcagcgccuacaagaucaucaccauccgguacucccgccgggugugcgugcaguucggggaggagaaccugugcaaggucaucgacaugaacgacugcuucgugagccgccacgugaaggucugcaucaucggcaccguguccaaguucagccagggggacacgcugcuguucuucggcccccuggagggcgggggccugaucuucaagcacuggugcaccuccacgugccaguucggggacccgggcgacaucaugagcccccgggacaagggguuccucugccccgaguuccccggcuccuuccgcaagaagugcaacuucgccaccaccccggugugcgaguacgacgggaacauggucagcggcuacaagaaggugauggccaccaucgacuccuuccagagcuucaacaccuccaccaugcacuucacggacgagcggaucgaguggaaggaccccgacggcaugcugcgcgaccacaucaacauccuggugaccaaggacaucgacuucgacaaccucggggagaaccccugcaagaucggccugcagaccagcuccaucgagggggcguggggcagcggggucggcuucacccugacgugccucaucucccugaccgagugccccaccuuccugaccagcaucaaggccugcgacaaggccaucugcuacggcgccgagagcgugacgcucacccgggggcagaacaccgugaaggucuccggcaagggcgggcacagcggguccaccuucaagugcugccacggcgaggacugcagccaguccggccugcacgcggccgccccgcaccuggacaaggugaacgggaucagcgagaucgagaacuccaagguguacgacgacggcgcgccccagugcgggaucaagugcugguucgucaagagcggcgaguggaucuccggcaucuucagcgggaacuggaucgugcucaucguccugugcguguuccuccucuucucccuggugcugcucagcauccugugccccguccgcaagcacaagaaguccuga

SEQ ID NO: 11756 - RNA, 3408 nt, Artificial Sequence
  derived and/or modified CDS sequence (opt1) from HTNV(CGRni1)__EU363815.1__GP
augggcaucuggaaguggcuggugauggccagccucgucuggcccgccuucgcccugcgcaaccuguacgacaugaagaucgagugcccgcacaccguguccuucggggagaacagcgugaccggcuacgucgagcucccgcccaugccccuggccgacacgacccagauggugcccgaguccagcugcuccauggacaaccaccagagccugaacaccaucaccaaguacacgcagaucaucuggcgggggaaggccgaccagucccagagcucccagaacagcuucgagaccguguccaccgaggucgaccucaaggggaccugcgugcugaagcacaagaugaucgaggagagcuaccgcucccgcaagagcaucacgugcuacgaccuguccugcaacagcaccuacugcaagcccacccucuacaugaucgugcccauccacgccugcaacaugaugaaguccugccugaucgcccuggggcccuaccgcguccaggugguguacgagcggaccuacugcaugacgggcguccucaucgagggcaagugcuucgugccggaccagagcguggucuccaucaucaagcacgggaucuucgacaucgccagcgugcacaucgugugcuucuacgucgccgugaagggcaacaccuacaagaucuucgagcaggucaagaagaccuucgagagcaacugcaacgacaccgagaacaagguccagggguacuacaucugcaucaucggcgggaacuccagccccguguacgugcccacgcuggacgacuuccgcuccauggaggccuucagcggcaucauccggagcccccacggcgaggaccacgaccuggccggggaggaggucgcguccuacuccaucgugggcccggccaacgccaaggucccccacagcgccuccagcgacacccucgggcugaucgccuacuccagcauccccuccuacagcucccugagcauccucaccuccagcaccgaggcgaagcacguguucucccccggccuguucccgcagcugaaccacacgaagugcgacaagaccgccaucccccucaccuggaccggcaugaucgaccugcccggguacuacgaggccauccaccccugcacgguguucugcgugcugagcggcccgggcgccagcugcgaggccuucuccgagggcgggaucuucaacaucgcgagccccaugugccucguguccaagcagaaccgguuccggcugaccgagcagcaggucaacuucgugugccagcgcguggacguggacaucaucgucuacugcaacggccagcggaaggugauccugaccaagacccucgugaucggccagugcaucuacacgaucaccagccuguucucccugcuccccggggucgcccacagcaucgccguggagcugugcgugcccggcuuccacgggugggccaccgccgcgcugcucgucaccuucugcuucggcugggugcugaucccggccaucacguucaucauccugaccauccucaaguucaucgccaacaucuuccacaccuccaaccaggagaaccgccucaagagcgugcugcggaagaucaaggaggaguucgagcgcaccaugggguccauggucugcgacaucugcaaguacgagugcgagacguacaaggagcugaaggcccacggcgugagcugcccccagucccagugccccuacugcuucacccacugcgagcccaccgaggccgcguuccaggcccacuacaaggugugccaggucacccaccgguuccgcgacgaccugaagaagaccgugacgcggcagaacuucaccccgggcugcuaccgcacccugaaccucuuccgguacaagagccgcugcuacaucuucaccauguggguguuccugaucguccuggaguccauccucugggccgccagcgcguccgagaucccccugaaccccguguggaacgacaacgcccacggggugggcagcaucccgaugcacacggaccuggagcucgacuucucccugaccagcagcuccaaguacaccuaccggcgcaagcugaccaacccccuggaggagagccaggccaucgaccuccacgucgagaucgaggagcagacgaucgggguggacgugcacgcccugggccacugguucgacgggcgccugaaccucaagaccuccuuccacugcuacggcgccugcaccaaguacgaguaccccuggcacaccgcgaagugccacuacgagcgggacuaccaguacgagacgagcuggggcugcaaccccuccgacugcccgggggucggcaccgggugcaccgccugcggccuguaccuggaccagcucaagcccgugggcagcgccuacaagaucaucaccauccgcuacucccggcgcgugugcguccaguucggggaggagaaccugugcaagaucaucgacaugaacgacugcuucgugagccggcacgugaaggucugcaucaucggcacgguguccaaguucagccagggggacacccuccuguucuucggcccccuggagggcgggggccugaucuucaagcacuggugcaccagcacgugccaguucggggaccccggcgacaucaugagcccgcgcgacaagggguuccucugccccgaguuccccggcuccuuccggaagaagugcaacuucgccaccacccccgugugcgaguacgacgggaacauggucagcggcuacaagaaggugauggccaccaucgacuccuuccagagcuucaacaccuccacgaugcacuucaccgacgagcgcaucgaguggaaggacccggacggcaugcugcgggaccacaucaacauccuggugaccaaggacaucgacuucgacaaccucggggagaaccccugcaagaucggccugcagaccagcuccaucgagggggcguggggcagcggggucggcuucacgcugaccugccucaucagccugaccgagugcuccaccuuccugacgagcaucaaggccugcgacaaggccaucugcuacggcgccgaguccgugacccucacccgcgggcagaacaccgugaaggucagcggcaagggcgggcacuccgggagcuccuucaagugcugccacggcgaggagugcagccagaucggccugcacgccgcggcgccccaccuggacaaggugaacgggaucuccgagauggagaacagcaagguguucgacgacggcgcgccccagugcgggaucaagugcugguucgucaaguccggcgaguggaucagcggcaucuucuccgggaacuggaucgugcucaucgugcugugcgucuuccuccuguucagccuggugcugcucuccauccugugcccgguccggaagcacaagaaguccuga

SEQ ID NO: 11757 - RNA, 3408 nt, Artificial Sequence
  derived and/or modified CDS sequence (opt1) from HTNV(Aa10-434)__KU207160.1__GP
augggcaucuggaaguggcuggugauggccagccucgucuggcccgugcugacccugcgcaacguguacgacaugaagaucgagugcccgcacaccgucuccuucgggggcaacagcgugaucggguacguggagcucccccccaugccccuggccgacacggcgcagcuggucccggaguccagcugcuccauggacaaccaccagagccucaacaccaucaccaaguacacccagguguccuggcggggcaaggccgaccagagccaguccagccagaucuccuucgagacggugagcaccgaggucgaccugaaggggaccugcgugcugaagcacaagaugguggaggaguccuaccgcagccggaaguccaucaccugcuacgaccucagcugcaacuccacguacugcaagcccacccuguacaugaucguccccauccacgccugcaacaugaugaagagcugccugaucgcccucggccccuaccgcgugcagguggucuacgagcggaccuacugcaugaccggcgugcugaucgaggggaagugcuucgugccggaccaguccgucgugagcaucaucaagcacggcaucuucgacaucgccagcgugcacaucgucugcuucuucguggcggugaaggggaacacguacaagaucuucgagcaggucaagaaguccuucgagagcaccugcaacgacaccgagaacaaggugcagggcuacuacaucugcaucgucgggggcaacuccgcccccaucuacgugcccacccuggacgacuuccgcagcauggaggccuucacgggcaucuuccgguccccccacggggaggaccacgaccucgccggcgaggagaccgcgaccuacagcaucguggggccggccaacgccaaggucccccacuccgccagcuccgacacccugagccugaucgccuucuccggcauccccagcuacuccagccucuccauccugacgagcuccaccgaggcgaagcacguguucagccccggccuguucccgaagcucaaccacaccaacugcgacaagggggccaucccccugauguggaccggcaugaucgaccugcccggguacuacgaggccauccaccccugcacgguguucugcguccucuccggcccgggggccagcugcgaggccuucagcgagggcggcaucuucaacaucaccucccccaugugccuggugagcaagcagaaccgcuuccggcugaccgagcagcaggugaacuucgucugccagcgcguggacguggacaucgucguguacugcaacgggcagcggaaggugauccucaccaagacgcuggucaucggccagugcaucuacaccaucaccucccuguucagccuccugcccgggguggcgcacuccaucgccguggagcugugcguccccggcuuccacgggugggccaccgccgcccuccuggugacguucugcuucggcugggugcugaucccggcgaucaccuucaucauccucaccauccugaaguucaucgccaacaucuuccacaccagcaaccaggagaaccgccugaaguccguccuccggaagaucaaggaggaguucgagaagacgaagggcagcauggugugcgacaucugcaaguacgagugcgagaccuacaaggagcugaaggcccacgggguguccugcccccagagccagugccccuacugcuucacccacugcgagcccaccgaggccgccuuccaggcgcacuacaaggucugccaggugacccaccgcuuccgggacgaccugaagaagacggugaccccgcagaacuucacccccggcugcuaccgcacccucaaccuguuccgguacaagucccgcugcuacaucuucacgauguggaucuuccugcucguccuggagagcauccugugggccgccuccgccagcgagaccccccucaccccgguguggaacgacaacgcgcacggggugggcuccguccccaugcacaccgaccuggagcuggacuucagccugacguccagcagcaaguacaccuaccggcgcaagcucaccaacccccuggaggaggcccaguccaucgaccugcacaucgagaucgaggagcagaccaucgggguggacgugcacgcccucggccacugguucgacggccggcugaaccugaagacgagcuuccacugcuacggggccugcaccaaguacgaguaccccuggcacaccgccaagugccacuacgagcgcgacuaccaguacgagaccuccuggggcugcaacccgagcgacugccccggggucggcacgggcugcaccgcgugcgggcucuaccuggaccgccugaagcccgugggcuccgccuacaagaucaucaccauccgguacagccgccgggugugcguccaguucggggaggagaaccucugcaagaucaucgacaugaacgacugcuucgugucccgccacgugaaggucugcaucaucggcaccaucagcaaguucucccagggggacacgcugcuguucuucggcccccucgagggcgggggccugaucuucaagcacuggugcaccagcaccugccaguucggggacccgggcgacaucauguccccccgggacaagggguuccugugccccgaguuccccggcagcuuccgcaagaagugcaacuucgccaccacgccgaucugcgaguacgacggcaacaugguguccggguacaagaaggugauggccaccaucgacagcuuccaguccuucaacaccagcaccaugcacuucacggacgagcggaucgaguggaaggaccccgacggcaugcuccgcgaccacaucaacauccuggucaccaaggacaucgacuucgacaaccugggggagaaccccugcaagaucggccuccaggccuccagcaucgagggggcguggggcuccggcgugggguucacccugaccugccuggugagccucacggagugccccaccuuccugaccagcaucaaggccugcgacaaggccaucugcuacggcgccgaguccgucacccugacgcgggggcagaacaccgugaaggugagcggcaaggggggccacuccggcagcaccuucaagugcugccacggggaggacugcucccagaucggccuccacgccgcggccccgcaccuggacaaggucaacgggaucagcgagauggagaacuccaagguguacgacgacggcgccccccagugcggcaucaagugcugguucgugaagagcggggaguggaucuccggcaucuucagcgggaacuggaucguccugaucgugcucugcgucuuccugcuguucucccucgugcugcugagcauccucugccccgugcgcaagcacaagaaguccuga

SEQ ID NO: 11758 - RNA, 3408 nt, Artificial Sequence
  derived and/or modified CDS sequence (opt1) from HTNV(Aa10-518)__KU207161.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagaacuccuucgagacggugagcaccgaggucgaccugaagggcaccugcgugcugaagcacaagaugguggaggaguccuaccgcagccggaaguccaucaccugcuacgaccucagcugcaacuccacguacugcaagcccacccuguacaugaucguccccauccacgccugcaacaugaugaagagcugccugaucgcccucgggcccuaccgcgugcagguggucuacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcaccugcaacgacaccaagaacaaggugcagggguacuacaucugcaucgucggcgggaacuccgcccccaucuacgugcccacccuggacgacuuccgcagcauggaggccuucacgggcaucuuccgguccccccacggcgaggaccacgaccucgccggggaggagaccgcgaccuacagcaucgugggcccggccaacgccaaggucccccacuccgccagcuccgacacccugagccugaucgccuucuccgggauccccagcuacuccagccucuccauccugacgagcuccaccgaggcgaagcacguguucagccccggccuguucccgaagcucaaccacaccaacugcgacaagggcgccaucccccugauguggaccgggaugaucgaccugcccggcuacuacgaggccauccaccccugcacgguguucugcguccucuccgggccgggcgccagcugcgaggccuucagcgaggggggcaucuucaacaucaccucccccaugugccuggugagcaagcagaaccgcuuccggcugaccgagcagcaggugaacuucgucugccagcgcguggacguggacaucgucguguacugcaacggccagcggaaggugauccucaccaagacgcuggucaucgggcagugcaucuacaccaucaccucccuguucagccuccugcccggcguggcgcacuccaucgccguggagcugugcguccccggguuccacggcugggccaccgccgcccuccuggugacguucugcuucgggugggugcugaucccggcgaucaccuucaucauccucaccauccugaaguucaucgccaacaucuuccacaccagcaaccaggagaaccgccugaaguccguccuccggaagaucaaggaggaguucgagaagacgaagggcagcauggugugcgacaucugcaaguacgagugcgagaccuacaaggagcugaaggcccacggcguguccugcccccagagccagugccccuacugcuucacccacugcgagcccaccgaggccgccuuccaggcgcacuacaaggucugccaggugacccaccgcuuccgggacgaccugaagaagacggugaccccgcagaacuucacccccgggugcuaccgcacccucaaccuguuccgguacaagucccgcugcuacaucuucacgauguggaucuuccugcucguccuggagagcauccugugggccgccuccgccagcgagaccccccucaccccgguguggaacgacaacgcgcacggcgugggguccguccccaugcacaccgaccuggagcuggacuucagccugacguccagcagcaaguacaccuaccggcgcaagcucaccaacccccuggaggaggcccaguccaucgaccugcacaucgagaucgaggagcagaccaucggcguggacgugcacgcccucgggcacugguucgacggccggcugaaccugaagacgagcuuccacugcuacggcgccugcaccaaguacgaguaccccuggcacaccgccaagugccacuacgagcgcgacuaccaguacgagaccuccugggggugcaacccgagcgacugccccggcgucgggacgggcugcaccgcgugcggccucuaccuggaccgccugaagcccgugggguccgccuacaagaucaucaccauccgguacagccgccgggugugcguccaguucggcgaggagaaccucugcaagaucguggacaugaacgacugcuucgugucccgccacgucaaggugugcaucaucgggaccgugagcaaguucucccagggcgacacgcugcuguucuucgggccccucgagggcggcgggcugaucuucaagcacuggugcaccagcaccugccaguucggcgacccgggggacaucauguccccccgggacaagggcuuccugugccccgaguuccccgggagcuuccgcaagaagugcaacuucgccaccacgccgaucugcgaguacgacggcaacauggucuccggcuacaagaaggugauggccaccaucgacagcuuccaguccuucaacaccagcaccaugcacuucacggacgagcggaucgaguggaaggaccccgacgggaugcuccgcgaccacaucaacauccuggugaccaaggacaucgacuucgacaaccugggcgagaaccccugcaagaucgggcuccagaccuccagcaucgagggcgccuggggguccggcgucggcuucacccugacgugccuggugagccucaccgagugccccaccuuccugaccagcaucaaggcgugcgacaaggccaucugcuacggggccgaguccgugacgcugacccggggccagaacaccgucaaggugagcgggaagggcgggcacuccggcagcaccuucaagugcugccacggcgaggacugcucccagaucgggcuccacgccgccgcgccgcaccuggacaaggugaacggcaucagcgagauggagaacuccaaggucuacgacgacggggccccccagugcggcaucaagugcugguucgugaagagcggcgaguggaucuccgggaucuucagcggcaacuggaucguccugaucgugcucugcguguuccugcuguucucccucguccugcugagcauccucugccccgugcgcaagcacaagaaguccuga

SEQ ID NO: 11759 - RNA, 3408 nt, Artificial Sequence
  derived and/or modified CDS sequence (opt1) from HTNV(Aa13_3)__KX687227.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccgcccaugccccuggucgacacggugcagcuggugcccgaguccagcugcuccauggacaaccaccagagccucaacaccaucaccaaguacacccaggucuccuggcgggggaaggccgaccagagccaguccagccagaacuccuucgagacggugagcaccgagguggaccugaaggggaccugcguccugaagcacaagaugguggaggaguccuaccgcagccggaaguccaucacgugcuacgaccucagcugcaacuccaccuacugcaagcccacccuguacaugaucgugcccauccacgccugcaacaugaugaaguccugccugaucgcccucgggcccuaccgcguccaggugguguacgagcggaccuacugcaugaccggcguccugaucgagggcaagugcuucgugccggaccaguccguggucagcaucaucaagcacgggaucuucgacaucgccagcgugcacaucgugugcuucuucgucgccgugaagggcaacacguacaagaucuucgagcaggucaagaaguccuucgagagcacgugcaacgacaccgagaacaaggugcagggguacuacaucugcaucgugggcgggaacuccgcccccaucuacguccccacccuggacgacuuccgcagcauggaggcguucaccggcaucuuccggagcccccacggcgaggaccacgaccucgccggggaggagaccgccaccuacagcaucgugggcccggccaacgcgaaggugccccacuccgccagcuccgacacccugagccugaucgccuucuccgggauccccagcuacuccagccucuccauccugacgagcuccaccgaggccaagcacgucuucagccccggccuguucccgaagcucaaccacaccaacugcgacaagggcgccaucccccugauguggaccgggaugaucgaccugcccggcuacuacgaggcgauccaccccugcacgguguucugcgugcucuccgggccgggcgccagcugcgaggccuucagcgagggcggcaucuucaacaucaccucccccaugugccuggucagcaagcagaaccgcuuccggcugaccgagcagcaggucaacuucgugugccagcgcguggacguggacaucguggucuacugcaacggccagcggaaggugauccucaccaagacgcuggugaucgggcagugcaucuacaccaucaccucccuguucagccuccugcccggcgucgcccacuccaucgccguggagcugugcgugcccggguuccacggcugggcgaccgccgcccuccuggucacguucugcuucgggugggugcugaucccggccaucaccuucaucauccucaccauccugaaguucaucgccaacaucuuccacaccagcaaccaggagaaccgccugaaguccgugcuccggaagaucaaggaggaguucgagaagacgaagggcagcauggucugcgacaucugcaaguacgagugcgagaccuacaaggagcugaaggcgcacggcguguccugcccccagagccagugccccuacugcuucacccacugcgagcccaccgaggccgccuuccaggcccacuacaaggugugccaggucacccaccgcuuccgggacgaccugaagaagacggugaccccgcagaacuucacccccgggugcuaccgcacccucaaccuguuccgguacaagucccgcugcuacaucuucacgauguggaucuuccugcucgugcuggagagcauccugugggccgcguccgccagcgagacgccccucaccccggucuggaacgacaacgcccacggcgugggguccgugcccaugcacaccgaccuggagcuggacuucagccugaccuccagcagcaaguacaccuaccggcgcaagcucaccaacccccuggaggaggcccaguccaucgaccugcacaucgagaucgaggagcagaccaucggcgucgacgugcacgcgcucgggcacugguucgacggccggcugaaccugaagacgagcuuccacugcuacggcgccugcaccaaguacgaguaccccuggcacaccgccaagugccacuacgagcgcgacuaccaguacgagaccuccugggggugcaacccgagcgacugccccggcguggggacgggcugcaccgccugcggccucuaccuggaccgccugaagcccgucggguccgccuacaagaucaucaccauccgguacagccgccgggugugcgugcaguucggcgaggagaaccucugcaagaucaucgacaugaacgacugcuucgucucccgccacgugaaggugugcaucaucgggaccgucagcaaguucucccagggcgacacgcugcuguucuucgggccccucgagggcggcgggcugaucuucaagcacuggugcaccagcacgugccaguucggcgacccgggggacaucaugagcccccgggacaagggcuuccugugccccgaguuccccggguccuuccgcaagaagugcaacuucgcgaccaccccgaucugcgaguacgacggcaacaugguguccggcuacaagaaggugauggccaccaucgacagcuuccaguccuucaacaccagcaccaugcacuucacggacgagcggaucgaguggaaggaccccgacgggaugcuccgcgaccacaucaacauccuggucaccaaggacaucgacuucgacaaccugggcgagaaccccugcaagaucgggcuccagaccuccagcaucgagggcgccuggggguccggcgugggcuucacccugacgugccuggugagccucaccgagugccccaccuuccugaccagcaucaaggccugcgacaaggccaucugcuacggggcggaguccgucacgcugacccggggccagaacaccgugaaggugagcgggaagggcgggcacuccggcagcaccuucaagugcugccacggcgaggacugcucccagaucgggcuccacgccgccgccccgcaccuggacaaggucaacggcaucagcgagauggagaacuccaagguguacgacgacggggcgccccagugcggcaucaagugcugguucgucaagagcggcgaguggaucuccgggaucuucagcggcaacuggaucgugcugaucgugcucugcgucuuccugcuguucucccucgugcugcugagcauccucugccccgugcgcaagcacaagaaguccuga

SEQ ID NO: 11760 - RNA, 3408 nt, Artificial Sequence
  derived and/or modified CDS sequence (opt1) from HTNV(Aa14_186)__KX687228.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagaacuccuucgagacggugagcaccgaggucgaccugaagggcaccugcgugcugaagcacaagaugaucgaggaguccuaccgcagccggaaguccaucaccugcuacgaccucagcugcaacaacacguacugcaagcccacccuguacaugaucgugcccauccacgccugcaacaugaugaaguccugccugaucgcccucgggcccuaccgcguccaggugguguacgagcggaccuacugcaugaccggcguccugaucgagggcaagugcuucgugccggaccagagcguggucuccaucaucaagcacgggaucuucgacaucgccagcgugcacaucgugugcuucuucgucgcggugaagggcaacacguacaagaucuucgagcaggugaagaagagcuucgaguccaccugcaacgacaccgagaacaagguccagggguacuacaucugcaucgugggcgggaacagcgcccccaucuacguccccacccuggacgacuuccgcuccauggaggccuucacgggcaucuuccggagcccccacggcgaggaccacgaccucgccggggaggagaccgcgaccuacuccaucgugggcccggccaacgccaaggugccccacagcgccuccagcgacacccugucccugaucgccuucagcgggauccccuccuacagcucccucagcauccugacguccagcaccgaggcgaagcacgucuucucccccggccuguucccgaagcucaaccacaccaacugcgacaagggcgccaucccccugauguggaccgggaugaucgaccugcccggcuacuacgaggccauccaccccugcacgguguucugcgugcucagcgggccgggcgccuccugcgaggccuucagcgaggggggcaucuucaacaucaccagccccaugugccuggucuccaagcagaaccgcuuccggcugaccgagcagcaggugaacuucgugugccagcgcgucgacguggacaucguggucuacugcaacggccagcggaaggugauccucaccaagacgcuggugaucgggcagugcaucuacaccaucaccagccuguucucccuccugcccggcgucgcgcacagcaucgccguggagcugugcgugcccggguuccacggcugggccaccgccgcccuccuggucacguucugcuucgggugggugcugaucccggcgaucaccuucaucauccucaccauccugaaguucaucgccaacaucuuccacaccuccaaccaggagaaccgccugaagagcgugcuccggaagaucaaggaggaguucgagaagacgaagggcuccauggucugcgacaucugcaaguacgagugcgagaccuacaaggagcugaaggcccacggcgugagcugcccccagucccagugccccuacugcuucacccacugcgagcccaccgaggccgccuuccaggcgcacuacaaggugugccaggucacccaccgcuuccgggacgaccugaagaagacggugaccccgcagaacuucacccccgggugcuaccgcacccucaaccuguuccgguacaagagccgcugcuacaucuucacgauguggaucuuccugcucgugcuggaguccauccugugggccgccagcgccuccgagaccccccucaccccggucuggaacgacaacgcgcacggcguggggagcgugcccaugcacaccgaccuggagcuggacuucucccugacgagcuccagcaaguacaccuaccggcgcaagcucaccaacccccuggaggaggcccagagcaucgaccugcacaucgagaucgaggagcagaccaucggcgucgacgugcacgcccucgggcacugguucgacggccggcugaaccugaagacguccuuccacugcuacggcgccugcaccaaguacgaguaccccuggcacaccgccaagugccacuacgagcgcgacuaccaguacgagaccagcugggggugcaacccguccgacugccccggcguggggacgggcugcaccgcgugcggccucuaccuggaccgccugaagcccgucgggagcgccuacaagaucaucaccauccgguacucccgccgggugugcgugcaguucggcgaggagaaccucugcaagaucaucgacaugaacgacugcuucgucagccgccacgugaaggugugcaucaucgggaccgucuccaaguucagccagggcgacacgcugcuguucuucgggccccucgagggcggcgggcugaucuucaagcacuggugcaccuccaccugccaguucggcgacccgggggacaucaugagcccccgggacaagggcuuccugugccccgaguuccccggguccuuccgcaagaagugcaacuucgccaccacgccgaucugcgaguacgacggcaacauggugagcggcuacaagaaggugauggccaccaucgacuccuuccagagcuucaacaccuccaccaugcacuucacggacgagcggaucgaguggaaggaccccgacgggaugcuccgcgaccacaucaacauccuggucaccaaggacaucgacuucgacaaccugggcgagaaccccugcaagaucgggcuccagaccagcuccaucgagggcgccugggggagcggcgugggcuucacccugacgugccuggugucccucaccgagugccccaccuuccugaccagcaucaaggcgugcgacaaggccaucugcuacggggccgagagcgucacgcugacccggggccagaacaccgugaagguguccgggaagggcgggcacagcggcuccaccuucaagugcugccacggcgaggacugcagccagaucgggcuccacgccgccgcgccgcaccuggacaaggucaacggcaucuccgagguggagaacagcaagguguacgacgacggggccccccagugcggcaucaagugcugguucgucaaguccggcgaguggaucagcgggaucuucuccggcaacuggaucgugcugaucguccucugcguguuccugcuguucagccucgugcugcuguccauccucugccccguccgcaagcacaagaagagcuga

SEQ ID NO: 11761 - RNA, 3408 nt, Artificial Sequence
  derived and/or modified CDS sequence (opt1) from HTNV(Aa14_234)__KX687230.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagacguccuucgagaccgugagcaccgaggucgaccugaagggcaccugcgugcugaagcacaagaugguggaggaguccuaccgcagccggaaguccaucacgugcuacgaccucagcugcaacuccaccuacugcaagcccacccuguacaugaucguccccauccacgccugcaacaugaugaagagcugccugaucgcccucgggcccuaccgcgugcagguggucuacgagcggaccuacugcaugacgggcgugcugaucgagggcaagugcuucgugccggaccaguccgucgugagcaucaucaagcacgggaucuucgacaucgccagcgugcacaucgucugcuucuucguggcggugaagggcaacaccuacaagaucuucgagcaggucaagaaguccuucgagagcaccugcaacgacaccgagaacaaggugcagggguacuacaucugcaucgucggcgggaacuccgcccccaucuacgugcccacgcuggacgacuuccgcagcauggaggccuucaccggcaucuuccgguccccccacggcgaggaccacgaccucgccggggaggagaccgcgaccuacagcaucgugggcccggccaacgccaaggucccccacuccgccagcuccgacacgcugagccugaucgccuucuccgggauccccagcuacuccagccucuccauccugaccagcuccaccgaggcgaagcacguguucagccccggccuguucccgaagcucaaccacaccuccugcgacaagggcgccaucccccugauguggacggggaugaucgaccugcccggcuacuacgaggccauccaccccugcaccguguucugcguccucagcgggccgggcgccagcugcgaggccuucuccgaggggggcaucuucaacaucaccagccccaugugccugguguccaagcagaaccgcuuccggcugaccgagcagcaggugaacuucgucugccagcgcguggacguggacaucgucguguacugcaacggccagcggaaggugauccucacgaagacccuggucaucgggcagugcaucuacaccaucaccagccuguucucccuccugcccggcguggcgcacagcaucgccguggagcugugcguccccggguuccacggcugggccacggccgcccuccuggugaccuucugcuucgggugggugcugaucccggcgaucaccuucaucauccucaccguccugaaguucaucgccaacaucuuccacacguccaaccaggagaaccgccugaagagcgugcuccggaagaucaaggaggaguucgagaagaccaagggcuccauggugugcgacaucugcaaguacgagugcgagaccuacaaggagcugaaggcccacggcgucagcugcccccagucccagugccccuacugcuucacccacugcgagcccaccgaggccgccuuccaggcgcacuacaaggugugccaggugacgcaccgcuuccgggacgaccugaagaagaccgucaccccgcagaacuucacccccgggugcuaccgcacgcucaaccuguuccgguacaagagccgcugcuacaucuucaccauguggaucuuccugcucgugcuggaguccauccugugggccgccagcgccuccgagaccccccucaccccgguguggaacgacaacgcgcacggcgucgggagcgugcccaugcacacggaccuggagcuggacuucucccugaccagcagcuccaaguacaccuaccggcgcaagcucaccaacccccuggaggaggcccagagcaucgaccugcacaucgagaucgacgagcagacgaucggcguggacguccacgcccucgggcacugguucgacggccggcugaaccugaagaccuccuuccacugcuacggcgccugcaccaaguacgaguaccccuggcacaccgccaagugccacuacgagcgcgacuaccaguacgagacgagcugggggugcaacccguccgacugccccggcguggggaccggcugcaccgcgugcggccucuaccuggaccgccugaagcccguggggagcgccuacaagaucaucaccauccgguacucccgccgggucugcgugcaguucggcgaggagaaccucugcaagaucaucgacaugaacgacugcuucgugagccgccacgucaaggugugcaucaucgggacgguguccaaguucagccagggcgacacccugcuguucuucgggccccucgagggcggcgggcugaucuucaagcacuggugcaccuccaccugccaguucggcgacccgggggacaucaugagcccccgggacaagggcuuccugugccccgaguuccccggguccuuccgcaagaagugcaacuucgccacgaccccgaucugcgaguacgacggcaacauggucagcggcuacaagaaggugauggccaccaucgacuccuuccagagcuucaacaccuccacgaugcacuucaccgacgagcggaucgaguggaaggaccccgacgggaugcuccgcgaccacaucaacauccuggugaccaaggacaucgacuucgacaaccugggcgagaaccccugcaagaucgggcuccagaccagcuccaucgagggcgccugggggagcggcgucggcuucacgcugaccugccuggugagccucaccgagugccccaccuuccugacguccaucaaggcgugcgacaaggccaucugcuacggggccgagagcgugacccugacccggggccagaacaccgucaagguguccgggaagggcgggcacagcggcuccaccuucaagugcugccacggcgaggacugcagccagaucgggcuccacgccgccgcgccgcaccuggacaaggugaacggcaucuccgagauggagaacagcaaggucuacgacgacggggccccccagugcggcaucaagugcugguucgugaaguccggcgaguggaucagcgggaucuucuccggcaacuggaucguccugaucgugcucugcguguuccugcuguucagccucguccugcuguccauccucugccccgugcgcaagcacaagaagagcuga

SEQ ID NO: 11762 - RNA, 3408 nt, Artificial Sequence
  derived and/or modified CDS sequence (opt1) from HTNV(Aa14_239)__KX687231.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagaacuccuucgagacggugagcaccgaggucgaccugaagggcaccugcgugcugaagcacaagaugguggaggaguccuaccgcagccggaaguccaucaccugcuacgaccucagcugcaacuccacguacugcaagcccacccuguacaugaucguccccauccacgccugcaacaugaugaagagcugccugaucgcccucgggcccuaccgcgugcagguggucuacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcaccugcaacgacaccgagaacaaggugcagggguacuacaucugcaucgucggcgggaacuccgcccccaucuacgugcccacccuggacgacuuccgcagcauggaggccuucacgggcaucuuccgguccccccacggcgaggaccacgaccucgccggggaggagaccgcgaccuacagcaucgugggcccggccaacgccaaggucccccacuccgccagcuccgacacccugagccugaucgccuucuccgggauccccagcuacuccagccucuccauccugacgagcuccaccgaggcgaagcacguguucagccccggccuguucccgaagcucaaccacaccaacugcgacaagggcgccaucccccugauguggaccgggaugaucgaccugcccggcuacuacgaggccauccaccccugcacgguguucugcguccucuccgggccgggcgccagcugcgaggccuucagcgaggggggcaucuucaacaucaccucccccaugugccuggugagcaagcagaaccgcuuccggcugaccgagcagcaggugaacuucgucugccagcgcguggacguggacaucgucguguacugcaacggccagcggaaggugauccucaccaagacgcuggucaucgggcagugcaucuacaccaucaccucccuguucagccuccugcccggcguggcgcacuccaucgccguggagcugugcguccccggguuccacggcugggccaccgccgcccuccuggugacguucugcuucgggugggugcugaucccggcgaucaccuucaucauccucaccguccugaaguucaucgccaacaucuuccacaccagcaaccaggagaaccgccugaaguccgugcuccggaagaucaaggaggaguucgagaagacgaagggcagcauggugugcgacaucugcaaguacgagugcgagaccuacaaggagcugaaggcccacggcgucuccugcccccagagccagugccccuacugcuucacccacugcgagcccaccgaggccgccuuccaggcgcacuacaaggugugccaggugacccaccgcuuccgggacgaccugaagaagacggucaccccgcagaacuucacccccgggugcuaccgcacccucaaccuguuccgguacaagucccgcugcuacaucuucacgauguggaucuuccugcucgugcuggagagcauccugugggccgccuccgccagcgagaccccccucaccccgguguggaacgacaacgcgcacggcgucggguccgugcccaugcacaccgaccuggagcuggacuucagccugacguccagcagcaaguacaccuaccggcgcaagcucaccaacccccuggaggaggcccaguccaucgaccugcacaucgagaucgacgagcagaccaucggcguggacguccacgcccucgggcacugguucgacggccggcugaaccugaagacgagcuuccacugcuacggcgccugcaccaaguacgaguaccccuggcacaccgccaagugccacuacgagcgcgacuaccaguacgagaccuccugggggugcaacccgagcgacugccccggcguggggacgggcugcaccgcgugcggccucuaccuggaccgccugaagcccgugggguccgccuacaagaucaucaccauccgguacagccgccgggucugcgugcaguucggcgaggagaaccucugcaagaucaucgacaugaacgacugcuucgugucccgccacgucaaggugugcaucaucgggaccgugagcaaguucucccagggcgacacgcugcuguucuucgggccccucgagggcggcgggcugaucuucaagcacuggugcaccagcaccugccaguucggcgacccgggggacaucauguccccccgggacaagggcuuccugugccccgaguuccccgggagcuuccgcaagaagugcaacuucgccaccacgccgaucugcgaguacgacggcaacauggucuccggcuacaagaaggugauggccaccaucgacagcuuccaguccuucaacaccagcaccaugcacuucacggacgagcggaucgaguggaaggaccccgacgggaugcuccgcgaccacaucaacauccuggugaccaaggacaucgacuucgacaaccugggcgagaaccccugcaagaucgggcuccagaccuccagcaucgagggcgccuggggguccggcgucggcuucacccugacgugccuggugagccucaccgagugccccaccuuccugaccagcaucaaggcgugcgacaaggccaucugcuacggggccgaguccgugacgcugacccggggccagaacaccgucaaggugagcgggaagggcgggcacuccggcagcaccuucaagugcugccacggcgaggacugcucccagaucgggcuccacgccgccgcgccgcaccuggacaaggugaacggcaucagcgagauggagaacuccaaggucuacgacgacggggccccccagugcggcaucaagugcugguucgugaagagcggcgaguggaucuccgggaucuucagcggcaacuggaucguccugaucgugcucugcguguuccugcuguucucccucguccugcugagcauccucugccccgugcgcaagcacaagaaguccuga

SEQ ID NO: 11763 - RNA, 3408 nt, Artificial Sequence
  derived and/or modified CDS sequence (opt1) from HTNV(Aa14-172)__KU207162.1__GP
augggcaucuggaaguggcuggugauggccagccucgucuggcccgugcugacccugcgcaacguguacgacaugaagaucgagugcccgcacaccgucagcuucggggagaacagcgugaucggcuacguggagcucccgcccaugccccugacggacaccgcccagcugguccccgaguccagcugcuccauggacaaccaccagagccucaacaccaucaccaaguacacccagguguccuggcgggggaaggcggaccagagccaguccagccagaacuccuucgagaccgugagcaccgaggucgaccugaaggggaccugcgugcugaagcacaagaugaucgaggaguccuaccgcagccggaaguccaucacgugcuacgaccucagcugcaacaacaccuacugcaagcccacccuguacaugaucgugcccauccacgccugcaacaugaugaaguccugccugaucgcccucgggcccuaccgcguccaggugguguacgagcggaccuacugcaugacgggcguccugaucgagggcaagugcuucgugccggaccagagcguggucuccaucaucaagcacgggaucuucgacaucgccagcgugcacaucgugugcuucuucgucgccgugaagggcaacaccuacaagaucuucgagcaggucaagaaguccuucgagagcacgugcaacgacaccgagaacaaggugcagggguacuacaucugcaucgugggcgggaacagcgcgcccaucuacguccccacgcuggacgacuuccgcuccauggaggccuucaccggcaucuuccggagcccccacggcgaggaccacgaccucgccggggaggagaccgccaccuacuccaucgugggcccggcgaacgccaaggugccccacagcgccuccagcgacacgcugucccugaucgccuucagcgggauccccuccuacagcucccucagcauccugaccuccagcaccgaggccaagcacgucuucucccccggccuguucccgaagcucaaccacaccaacugcgacaagggcgcgaucccccugauguggacggggaugaucgaccugcccggcuacuacgaggccauccaccccugcaccguguucugcgugcucagcgggccgggcgccuccugcgaggccuucagcgagggcggcaucuucaacaucaccagccccaugugccuggucuccaagcagaaccgcuuccggcugaccgagcagcaggucaacuucgugugccagcgcguggacguggacaucguggucuacugcaacggccagcggaaggugauccucacgaagacccuggugaucgggcagugcaucuacaccaucaccagccuguucucccuccugcccggcgucgcccacagcaucgcgguggagcugugcgugcccggguuccacggcugggccacggccgcccuccuggucaccuucugcuucgggugggugcugaucccggccaucaccuucaucauccucaccauccugaaguucaucgcgaacaucuuccacacguccaaccaggagaaccgccucaagagcgugcugcggaagaucaaggaggaguucgagaagaccaagggcuccauggucugcgacaucugcaaguacgagugcgagaccuacaaggagcugaaggcccacggcgugagcugcccccagucccagugccccuacugcuucacccacugcgagcccaccgaggccgccuuccaggcccacuacaaggugugccaggucacgcaccgcuuccgggacgaccugaagaagaccgugaccccgcagaacuucacccccgggugcuaccgcacgcucaaccuguuccgguacaagagccgcugcuacaucuucaccauguggaucuuccugcucgugcuggaguccauccugugggcggccagcgccuccgagacgccccucaccccggucuggaacgacaacgcccacggcguggggagcgugcccaugcacaccgaccuggagcuggacuucucccugaccagcuccagcaaguacaccuaccggcgcaagcucaccaacccccuggaggaggcgcagagcaucgaccugcacaucgagaucgaggagcagacgaucggcgucgacgugcacgcccucgggcacugguucgacggccggcugaaccugaagaccuccuuccacugcuacggcgccugcaccaaguacgaguaccccuggcacaccgccaagugccacuacgagcgcgacuaccaguacgagacgagcugggggugcaacccguccgacugccccggcguggggaccggcugcaccgccugcggccucuaccuggaccgccugaagcccgucgggagcgcguacaagaucaucaccauccgguacucccgccgggugugcgugcaguucggcgaggagaaccucugcaagaucaucgacaugaacgacugcuucgucagccgccacgugaaggugugcaucaucgggacggucuccaaguucagccagggcgacacccugcuguucuucgggccccucgagggcggcgggcugaucuucaagcacuggugcaccuccacgugccaguucggcgacccgggggacaucaugagcccccgggacaagggcuuccugugccccgaguuccccggguccuuccgcaagaagugcaacuucgccaccaccccgaucugcgaguacgacggcaacauggugagcggcuacaagaaggugauggccaccaucgacuccuuccagagcuucaacaccuccacgaugcacuucaccgacgagcggaucgaguggaaggaccccgacgggaugcuccgcgaccacaucaacauccuggucaccaaggacaucgacuucgacaaccugggcgagaaccccugcaagaucgggcuccagaccagcuccaucgagggcgccugggggagcggcgugggcuucacgcugaccugccuggugucccucaccgagugccccaccuuccugacgagcaucaaggccugcgacaaggcgaucugcuacggggccgagagcgucacccugacccggggccagaacaccgugaagguguccgggaagggcgggcacagcggcuccaccuucaagugcugccacggcgaggacugcagccagaucgggcuccacgccgccgccccgcaccuggacaaggucaacggcaucuccgagguggagaacagcaagguguacgacgacggggcgccccagugcggcaucaagugcugguucgucaaguccggcgaguggaucagcgggaucuucuccggcaacuggaucgugcugaucguccucugcguguuccugcuguucagccucgugcugcuguccauccucugccccguccgcaagcacaagaaguccuga

SEQ ID NO: 11764 - RNA, 3408 nt, Artificial Sequence
  derived and/or modified CDS sequence (opt1) from HTNV(Aa14-175)__KU207163.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagaacuccuucgagacggugagcaccgaggucgaccugaagggcaccugcgugcugaagcacaagaugguggaggaguccuaccgcagccggaaguccaucaccugcuacgaccucagcugcaacuccacguacugcaagcccacccuguacaugaucguccccauccacgccugcaacaugaugaagagcugccugaucgcccucgggcccuaccgcgugcagguggucuacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcaccugcaacgacaccgagaacaaggugcagggguacuacaucugcaucgucggcgggaacuccgcccccaucuacgugcccacccuggacgacuuccgcagcauggaggccuucacgggcaucuuccgguccccccacggcgaggaccacgaccucgccggggaggagaccgcgaccuacagcaucgugggcccggccaacgccaaggucccccacuccgccagcuccgacacccugagccugaucgccuucuccgggauccccagcuacuccagccucuccauccugacgagcuccaccgaggcgaagcacguguucagccccggccuguucccgaagcucaaccacaccaacugcgacaagggcgccaucccccugauguggaccgggaugaucgaccugcccggcuacuacgaggccauccaccccugcacgguguucugcguccucuccgggccgggcgccagcugcgaggccuucagcgaggggggcaucuucaacaucaccucccccaugugccuggugagcaagcagaaccgcuuccggcugaccgagcagcaggugaacuucgucugccagcgcguggacguggacaucgucguguacugcaacggccagcggaaggugauccucaccaagacgcuggucaucgggcagugcaucuacaccaucaccucccuguucagccuccugcccggcguggcgcacuccaucgccguggagcugugcguccccggguuccacggcugggccaccgccgcccuccuggugacguucugcuucgggugggugcugaucccggcgaucaccuucaucauccucaccauccugaaguucaucgccaacaucuuccacaccagcaaccaggagaaccgccugaaguccguccuccggaagaucaaggaggaguucgagaagacgaagggcagcauggugugcgacgugugcaaguacgagugcgagaccuacaaggagcugaaggcccacggcgucuccugcccccagagccagugccccuacugcuucacccacugcgagcccaccgaggccgccuuccaggcgcacuacaaggugugccaggugacccaccgcuuccgggacgaccugaagaagacggucaccccgcagaacuucacccccgggugcuaccgcacccucaaccuguuccgguacaagucccgcugcuacaucuucacgauguggaucuuccugcucgugcuggagagcauccugugggccgccuccgccagcgagaccccccucaccccgguguggaacgacaacgcgcacggcgucggguccgugcccaugcacaccgaccuggagcuggacuucagccugacguccagcagcaaguacaccuaccggcgcaagcucaccaacccccuggaggaggcccaguccaucgaccugcacaucgagaucgaggagcagaccaucggcguggacguccacgcccucgggcacugguucgacggccggcugaaccugaagacgagcuuccacugcuacggcgccugcaccaaguacgaguaccccuggcacaccgccaagugccacuacgagcgcgacuaccaguacgagaccuccugggggugcaacccgagcgacugccccggcguggggacgggcugcaccgcgugcggccucuaccuggaccgccugaagcccgugggguccgccuacaagaucaucaccauccgguacagccgccgggucugcgugcaguucggcgaggagaaccucugcaagaucaucgacaugaacgacugcuucgugucccgccacgucaaggugugcaucaucgggaccgugagcaaguucucccagggcgacacgcugcuguucuucgggccccucgagggcggcgggcugaucuucaagcacuggugcaccagcaccugccaguucggcgacccgggggacaucauguccccccgggacaagggcuuccugugccccgaguuccccgggagcuuccgcaagaagugcaacuucgccaccacgccgaucugcgaguacgacggcaacauggucuccggcuacaagaaggugauggccaccaucgacagcuuccaguccuucaacaccagcaccaugcacuucacggacgagcggaucgaguggaaggaccccgacgggaugcuccgcgaccacaucaacauccuggugaccaaggacaucgacuucgacaaccugggcgagaaccccugcaagaucgggcuccagaccuccagcaucgagggcgccuggggguccggcgucggcuucacccugacgugccuggugagccucaccgagugccccaccuuccugaccagcaucaaggcgugcgacaaggccaucugcuacggggccgaguccgugacgcugacccggggccagaacaccgucaaggugagcgggaagggcgggcacuccggcagcaccuucaagugcugccacggcgaggacugcucccagaucgggcuccacgccgccgcgccgcaccuggacaaggugaacggcaucagcgaggucgagaacuccaagguguacgacgacggggccccccagugcggcaucaagugcugguucgucaagagcggcgaguggaucuccgggaucuucagcggcaacuggaucgugcugaucgugcucugcgucuuccugcuguucucccucgugcugcugagcauccucugccccgugcgcaagcacaagaaguccuga

SEQ ID NO: 11765 - RNA, 3408 nt, Artificial Sequence
  derived and/or modified CDS sequence (opt1) from HTNV(Aa14-184)__KU207164.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagaacuccuucgagacggugagcaccgaggucgaccugaagggcaccugcgugcugaagcacaagaugaucgaggaguccuaccgcagccggaaguccaucaccugcuacgaccucagcugcaacaacacguacugcaagcccacccuguacaugaucgugcccauccacgccugcaacaugaugaaguccugccugaucgcccucgggcccuaccgcguccaggugguguacgagcggaccuacugcaugaccggcguccugaucgagggcaagugcuucgugccggaccagagcguggucuccaucaucaagcacgggaucuucgacaucgccagcgugcacaucgugugcuucuucgucgcggugaagggcaacacguacaagaucuucgagcaggugaagaagagcuucgaguccaccugcaacgacaccgagaacaagguccagggguacuacaucugcaucgugggcgggaacagcgcccccaucuacguccccacccuggacgacuuccgcuccauggaggccuucacgggcaucuuccggagcccccacggcgaggaccacgaccucgccggggaggagaccgcgaccuacuccaucgugggcccggccaacgccaaggugccccacagcgccuccagcgacacccugucccugaucgccuucagcgggauccccuccuacagcucccucagcauccugacguccagcaccgaggcgaagcacgucuucucccccggccuguucccgaagcucaaccacaccaacugcgacaagggcgccaucccccugauguggaccgggaugaucgaccugcccggcuacuacgaggccauccaccccugcacgguguucugcgugcucagcgggccgggcgccuccugcgaggccuucagcgaggggggcaucuucaacaucaccagccccaugugccuggucuccaagcagaaccgcuuccggcugaccgagcagcaggugaacuucgugugccagcgcgucgacguggacaucguggucuacugcaacggccagcggaaggugauccucaccaagacgcuggugaucgggcagugcaucuacaccaucaccagccuguucucccuccugcccggcgucgcgcacagcaucgccguggagcugugcgugcccggguuccacggcugggccaccgccgcccuccuggucacguucugcuucgggugggugcugaucccggcgaucaccuucaucauccucaccauccugaaguucaucgccaacaucuuccacaccuccaaccaggagaaccgccugaagagcgugcuccggaagaucaaggaggaguucgagaagacgaagggcuccauggucugcgacgugugcaaguacgagugcgagaccuacaaggagcugaaggcccacggcgugagcugcccccagucccagugccccuacugcuucacccacugcgagcccaccgaggccgccuuccaggcgcacuacaaggucugccaggugacccaccgcuuccgggacgaccugaagaagacggugaccccgcagaacuucacccccgggugcuaccgcacccucaaccuguuccgguacaagagccgcugcuacaucuucacgauguggaucuuccugcucguccuggaguccauccugugggccgccagcgccuccgagaccccccucaccccgguguggaacgacaacgcgcacggcguggggagcguccccaugcacaccgaccuggagcuggacuucucccugacgagcuccagcaaguacaccuaccggcgcaagcucaccaacccccuggaggaggcccagagcaucgaccugcacaucgagaucgaggagcagaccaucggcguggacgugcacgcccucgggcacugguucgacggccggcugaaccugaagacguccuuccacugcuacggcgccugcaccaaguacgaguaccccuggcacaccgccaagugccacuacgagcgcgacuaccaguacgagaccagcugggggugcaacccguccgacugccccggcgucgggacgggcugcaccgcgugcggccucuaccuggaccgccugaagcccguggggagcgccuacaagaucaucaccauccgguacucccgccgggugugcguccaguucggcgaggagaaccucugcaagaucaucgacaugaacgacugcuucgugagccgccacgugaaggucugcaucaucgggaccguguccaaguucagccagggcgacacgcugcuguucuucgggccccucgagggcggcgggcugaucuucaagcacuggugcaccuccaccugccaguucggcgacccgggggacaucaugagcccccgggacaagggcuuccugugccccgaguuccccggguccuuccgcaagaagugcaacuucgccaccacgccgaucugcgaguacgacggcaacauggugagcggcuacaagaaggucauggccaccaucgacuccuuccagagcuucaacaccuccaccaugcacuucacggacgagcggaucgaguggaaggaccccgacgggaugcuccgcgaccacaucaacauccuggugaccaaggacaucgacuucgacaaccugggcgagaaccccugcaagaucgggcuccagaccagcuccaucgagggcgccugggggagcggcgugggcuucacccugacgugccuggucucccucaccgagugccccaccuuccugaccagcaucaaggcgugcgacaaggccaucugcuacggggccgagagcgugacgcugacccggggccagaacaccgugaaggucuccgggaagggcgggcacagcggcuccaccuucaagugcugccacggcgaggacugcagccagaucgggcuccacgccgccgcgccgcaccuggacaaggugaacggcaucuccgagguggagaacagcaaggucuacgacgacggggccccccagugcggcaucaagugcugguucgugaaguccggcgaguggaucagcgggaucuucuccggcaacuggaucguccugaucgugcucugcguguuccugcuguucagccucguccugcuguccauccucugccccgugcgcaagcacaagaagagcuga

SEQ ID NO: 11766 - RNA, 3408 nt, Artificial Sequence
  derived and/or modified CDS sequence (opt1) from HTNV(LR1)__AF288293.1__GP
augggcaucuggaaguggcuggugauggccagccucgucuggcccgugcugacccugcgcaacguguacgacaugaagaucgagugcccgcacaccgucuccuucgggggcaacagcgugaucggguacguggagcucccgcccgucccccuggccgacacggcgcagauggugcccgaguccagcugcuccauggacaaccaccagagccugaacaccaucaccaaguacacccagguguccuggcggggcaaggccgaccagagccaguccagccagaacuccuucgagacggucagcaccgagguggaccucaaggggaccugcgugcugaagcacaagauggucgaggaguccuaccgcagccggaaguccgugaccugcuacgaccugagcugcaacuccacguacugcaagcccacccucuacaugaucgugcccauccacgccugcaacaugaugaaguccugccugaucgcccugggccccuaccgcguccaggugguguacgagcggaccuacugcaugaccggcguccucaucgaggggaagugcuucgugccggaccaguccguggucagcaucaucaagcacggcaucuucgacaucgccagcgugcacaucgugugcuucuucgucgcggugaaggggaacacguacaagaucuucgagcaggucaagaaguccuucgagagcacgugcaacgacaccgagaacaaggugcagggcuacuacaucugcaucgucgggggcaacuccgcccccaucuacgugcccacccuggacgacuuccgcagcauggaggccuucaccggcaucuuccggagcccccacggggaggaccgcgaccuggccggcgaggagaucgcgagcuacuccaucguggggccggccaacgccaaggugccccacagcgccuccagcgacacccuccggcugaucgccuacuccggcauccccagcuacuccagccuguccauccucaccagcuccaccgaggcgaagcacgucuucagccccggccuguucccgaagcugaaccacacgaacugcgacaaguccgccaucccccucaucuggaccgggaugaucgaccugcccggcuacuacgaggccgugcaccccugcaccguguucugcguccugagcgggccgggcgccagcugcgaggccuucuccgagggcgggaucuucaacaucaccagcuccaugugccucgugagcaagcagaaccgcuuccggcugacggagcagcaggucaacuucgugugccagcgcguggacauggacaucguggucuacugcaacggccagcggaaggugauccugaccaagacccucgugaucgggcagugcaucuacaccaucacgucccuguucagccugcuccccggcgucgcgcacuccaucgccguggagcugugcgugcccggguuccacggcugggccaccgccgcccugcucgucaccuuccgcuucgggugggugcugauccccgcgaucaccuucaucauccugacggugcucaaguucaucgccaacaucuuccacaccagcaaccaggagaaccggcugaaguccguccugcgcaagaucaaggaggaguucgagaagaccaagggcagcauggugugcgacgugugcaaguacgagugcgagaccuacaaggagcucaaggcccacggcgucuccugcccgcagagccagugccccuacugcuucacgcacugcgagcccaccgaggccgccuuccaggcgcacuacaaggugugccaggugacccaccgguuccgcgacgggcugaagaagaccgucacgccccagaacuucaccccgggcugcuaccggacccugaaccucuuccgcuacaagucccggugcuacaucuucaccauguggaucuuccugcuggugcucgagagcauccugugggccgccuccgccagcgagacgccccugacccccguguggaacgacaacgcgcacggggucggcuccgugccgaugcacaccgaccucgagcuggacuucagccugaccagcuccagcaaguacaccuaccgccgcaagcugacgaacccccucgaggaggcccaguccaucgaccugcacaucgagaucgaggagcagaccaucgggguggacguccacgcccugggccacugguucgacggccggcucaaccugaagaccagcuuccacugcuacggggccugcaccaaguacgaguaccccuggcacacggccaagugccacuacgagcgcgacuaccaguacgagaccuccuggggcugcaaccccagcgacugcccgggggugggcaccggcugcaccgcgugcgggcuguaccucgaccagcugaagcccgugggcuccgccuacaagaucaucacgauccgguacagccgccgggucugcgugcaguucggggaggagaaccugugcaagaucaucgacaugaacgacugcuucgugucccgccacgucaaggugugcaucaucggcaccgugagcaaguucucccagggggacacccuccuguucuucggcccccuggagggcgggggccucaucuucaagcacuggugcaccagcacgugccaguucggggaccccggcgacaucauguccccgcgggacaagggguuccugugccccgaguuccccggcagcuuccgcaagaagugcaacuucgccaccacccccaucugcgaguacgacggcaacauggucuccggguacaagaaggugauggccaccaucgacagcuuccaguccuucaacacgagcaccaugcacuucaccgacgagcggaucgaguggaaggacccggacggcaugcugcgcgaccacaucaacauccucgugaccaaggacaucgacuucgacaaccugggggagaaccccugcaagaucggccugcagacguccagcaucgagggggccuggggcagcggcgucggguucacccugaccugccucgugucccugaccgagugccccacguuccucaccagcaucaaggcgugcgacaaggccaucugcuacggcgccgaguccgggacccugacccggggccagaacacggugaaggucagcgggaagggcggccacuccgggagcaccuucaagugcugccacggcgaggacugcucccagaucgggcugcacgccgccgcgccccaccucgacaaggugaacggcaucagcgagaucgagaacuccaaggucuacgacgacggcgccccgcagugcgggaucaagugcugguucgucaagagcggcgaguggaucuccgggaucuucagcggcaacuggaucgugcugaucgugcugugcguguuccuccuguucucccuggugcuccugagcauccccugccccguccgcaagcacaagaaguccuga

SEQ ID NO: 11767 - RNA, 3408 nt, Artificial Sequence
  derived and/or modified CDS sequence (opt1) from HTNV(SN7)__AF288656.1__GP
augggcguguggaaguggcuggucauggccagccucguguggcccgccugcacccugcgcaacguguacgacaugaagaucgagugcccgcacaccgucuccuucggggagaacagcgugaucggcuacguggagcugccgcccaugccccucgccgacacgacccagcugguccccgaguccagcugcuccauggacaaccaccagagccugaacaccaucaccaaguacacccagguguccuggcggaagaaggccgaccaggcccagagcucccagaacagcuucgagaccguguccgucgagguggaccucaaggggaccugcgugcugaagcacaagaugaucgaggagagcuaccgcucccgcaagagcaucacgugcuacgaccuguccugcaacagcacguacugcaagcccacccucuacaugaucguccccauccacgccugcaacaugaugaaguccugccugaucgcccugggccccuaccggguccaggugguguacgagcggaccuacugcaugaccggggugcucaucgagggcaagugcuucgugccggaccagagcgucguguccaucaucaagcacggcaucuucgacaucgcgagcgugaagaucgucugcuucuucguggccgugaagcgcaacacguacaagcuguucgagcaggucaagaaguccuucgacuccacgugcaacgacaccgagaacaaggugcagggguacuacaucugcaucgucggcgggaacagcgcccccaucuacgugcccacccuggacgacuuccgguccauggaggccuucagcggcaucuuccgcagcccccacggggaggaccacgaccucgcgggcgaggagguggccagcuacuccaucgucggcccggccaacgccaaggugccccacagcgccuccagcgacacccugucccugaucgcguacagcgggauccccuccuacagcucccucagcauccugaccuccagcaccgaggccaagcacguguucucccccggcuucuucccgcagcugaaccacaccaagugcgacaagacggccaucccccucaccuggaccgggaugaucgaccugcccggcuacuacgaggccauccaccccugcaccgucuucugcgugcugagcggcccgggggccagcugcgaggcguucuccgagggcgggaucuucaacaucacgagccccaugugccucguguccaagcagaaccgguuccgccugaccgagcagcaggucaacuucgugugccagcggguggacauggacaucgucguguacugcaacggccagcgcaaggugauccugaccaagaccauggucaucgggcagugcaucuacacgaucaccagccucuucucccugcugcccggcguggcccacagcaucgccguggagcucugcguccccggcuuccacgggugggccaccgccgcgcugcuggugaccuucugcuucggcugggugcucaucccggccgucacguucaucauccugaccgugcugaaguucguggccaacaucuuccacaccuccaaccaggagaaccggcucaagagcguccugcgcaagaucaaggaggaguucgagaagaccaagggguccauggugugcgacgugugcaaguacgagugcgagacguacaaggagcugaaggcccacggcgucagcugcccccagucccagugccccuacugcuucacccacugcgagcccaccgaggccgcguuccaggcccacuaccgggugugccaggugacccaccgcuuccgggacgaccucaagaagaccgucacgccgcagaacuucacccccgggugcuaccgcacccugaaccuguuccgguacaagagccgcugcuacaucuucaccauguggguguuccuccuggugcuggaguccauccucugggccgccagcgcguccgaggucccccugaacccgaucuggaacgacaacgcccacggcgugggcagcgugcccaugcacacggaccuggagcucgacuucucccugaccagcagcuccaaguacaccuaccggcgcaagcugaccaacccccuggaggagacgcaggccaucgaccuccacaucgagaucgaggagcagaccaucggggucgacgugcacgcccugggccacugguucgacgggcgccugaaccucaagaccagcuuccacugcuacggcgccugcaccaaguacgaguaccccuggcacacggcgaagugccacuacgagcgggacuaccaguacgagaccuccugggggugcaacccgagcgacugccccggcgugggcaccgggugcaccgccugcggccuguaccuggaccagcucaagcccgucggguccgccuacaagaucaucacgauccgcuacagccggcgcgugugcgugcaguucggcgaggagaaccugugcaaggucaucgacaugaacgacugcuucgugucccggcacgugaaggucugcaucaucggcaccgugagcaaguucucccagggggacacccuccucuucuucggcccccuggagggcggcgggcugaucuucaagcacuggugcaccagcacgugccaguucggggacccgggcgacaucaugagcccccgcgacaagggguuccucugccccgaguuccccggcagcuuccggaagaagugcaacuucgccaccaccccgcugugcgaguacgacgggaacaugaucuccggcuacaagaaggugauggccaccaucgacagcuuccaguccuucaacacgagcaccaugcacuucaccgacgagcgcaucgaguggaaggaccccgacgggaugcugcgggaccacaucaacauccucgucaccaaggacaucgacuucgacaaccugggcgagaaccccugcaagaucggccugcagacguccagcaucgagggggcguggggcuccggggugggcuucacccugaccugccuggugagccugaccgagugccccacguuccucaccagcaucaaggccugcgacaaggccaucugcuacggggccgaguccgucacccugacccgcggccagaacacggugaaggucagcggcaagggcgggcacuccgggagcaccuucaagugcugccacggcgaggacugcucccagaccgggcugcacgccgcggccccgcaccucgacaaggugaacggcaucagcgaguccgagaacagcaagguguacgacgacggcgcgccccagugcgggaucaagugcugguucgucaaguccggcgaguggaucagcgggaucuucuccggcaacuggaucgugcugaucgugcugugcgucuuccuccuguucagccuggugcuccuguccgugcugugccccguccggaagcacaagaaguccuga

SEQ ID NO: 11768 - RNA, 3408 nt, Artificial Sequence
  derived and/or modified CDS sequence (opt1) from HTNV(84FLi)__AF366569.1__GP
augggcguguggaaguggcuggucauggccagccucguguggcccgccugcacccugcgcaacguguacgacaugaagaucgagugcccgcacaccgucagcuucggggagaacagcgugaucggcuacguggagcugccgcccaugccccucgccgacacgacccagcugguccccgaguccagcugcuccauggacaaccaccagagccugaacaccaucaccaaguacacccagguguccuggcggaagaaggccgaccaggcccagagcucccagaacagcuucgagaccguguccgucgagguggaccucaaggggaccugcgugcugaagcacaagaugaucgaggagagcuaccgcucccgcaagagcaucacgugcuacgaccuguccugcaacagcacguacugcaagcccacccucuacaugaucguccccauccacgccugcaacaugaugaaguccugccugaucgcccugggccccuaccggguccaggugguguacgagcggaccuacugcaugaccggggugcucaucgagggcaagugcuucgugccggaccagagcgucguguccaucaucaagcacggcaucuucgacaucgcgagcgugaagaucgucugcuucuucguggccgugaaggggaacacguacaagcuguucgagcaggucaagaaguccuucgacuccacgugcaacgacaccgagaacaaggugcagggcuacuacaucugcaucgucgggggcaacagcgcccccaucuacgugcccacccuggacgacuuccgcuccauggaggccuucagcgggaucuuccggagcccccacggcgaggaccacgaccucgcgggcgaggagguggccagcuacuccaucgucgggccggccaacgccaaggugccccacaacgccagcuccgacacccugagccugaucgcguacuccggcauccccagcuacuccagccucuccauccugaccagcuccaccgaggccaagcacguguucagccccggguucuucccgcagcugaaccacaccaagugcgacaagacggccaucccccucaccuggaccggcaugaucgaccugcccggcuacuacgaggccauccaccccugcaccgucuucugcgugcuguccgggccgggcgccagcugcgaggcguucagcgagggcgggaucuucaacaucacgucccccaugugccucgugagcaagcagaaccgcuuccggcugaccaagcagcaggucaacuucgugugccagcgcguggacauggacaucgucguguacugcaacgggcagcggaaggugauccugaccaagaccauggucaucggccagugcaucuacacgaucaccucccucuucagccugcugcccggcguggcccacuccaucgccguggagcucugcguccccggguuccacggcugggccaccgccgcgcugcuggugaccuucugcuucgggugggugcucaucccggccgucacguucaucauccugaccgugcugaaguucguggccaacaucuuccacaccagcaaccaggagaaccgccucaaguccguccugcggaagaucaaggaggaguucgagaagaccaagggcagcauggugugcgacgugugcaaguacgagugcgagacguacaaggagcugaaggcccacggggucuccugcccccagagccagugccccuacugcuucacccacugcgagcccaccgaggccgcguuccaggcccacuaccgcgugugccaggugacccaccgguuccgcgacgaccucaagaagaccgucacgccgcagaacuucacccccggcugcuaccggacccugaaccuguuccgcuacaagucccggugcuacaucuucaccauguggguguuccuccuggugcuggagagcauccucugggccgccuccgcgagcgaggucccccugaacccgaucuggaacgacaacgcccacggcgugggguccgugcccaugcacacggaccuggagcucgacuucagccugaccuccagcagcaaguacaccuaccgccggaagcugaccaacccccuggaggagacgcaggccaucgaccuccacaucgagaucgaggagcagaccaucggcgucgacgugcacgcccuggggcacugguucgacggccgccugaaccucaagaccuccuuccacugcuacggggccugcaccaaguacgaguaccccuggcacacggcgaagugccacuacgagcgcgacuaccaguacgagaccagcuggggcugcaacccguccgacugccccggcguggggaccggcugcaccgccugcgggcuguaccuggaccagcucaagcccgucggcagcgccuacaagaucaucacgauccgguacucccgccgggugugcgugcaguucggcgaggagaaccugugcaaggucaucgacaugaacgacugcuucgugagccgccacgugaaggucugcaucaucgggaccguguccaaguucagccagggcgacacccuccucuucuucgggccccuggagggcgggggccugaucuucaagcacuggugcaccuccacgugccaguucggcgacccgggggacaucaugagcccccgggacaagggcuuccucugccccgaguuccccggguccuuccgcaagaagugcaacuucgccaccaccccgcugugcgaguacgacggcaacaugaucagcggguacaagaaggugauggccaccaucgacuccuuccagagcuucaacacguccaccaugcacuucaccgacgagcggaucgaguggaaggaccccgacggcaugcugcgcgaccacaucaacauccucgucaccaaggacaucgacuucgacaaccugggcgagaaccccugcaagaucgggcugcagacgagcuccaucgagggcgcgugggggagcggcgugggguucacccugaccugccuggugucccugaccgagugccccacguuccucaccagcaucaaggccugcgacaaggccaucugcuacggcgccgagagcgucacccugacccggggccagaacacggugaaggucuccgggaagggcgggcacagcggcuccaccuucaagugcugccacggggaggacugcagccagaccggccugcacgccgcggccccgcaccucgacaaggugaacggcaucuccgagaucgagaacagcaagguguacgacgacggggcgccccagugcggcaucaagugcugguucgucaaguccggggaguggaucagcggcaucuucuccggcaacuggaucgugcugaucgugcugugcgucuuccuccuguucagccuggugcuccuguccgugcugugccccguccgcaagcacaagaaguccuga

SEQ ID NO: 11769 - RNA, 3408 nt, Artificial Sequence
  derived and/or modified CDS sequence (opt1) from HTNV(Aa08-1111)__KY594715.1__GP
augggcaucuggaaguggcuggugauggccagccucgucuggcccguguucacccugcgcaacguguacgacaugaagaucgagugcccgcacaccgucuccuucggggagaacagcgugaucggcuacguggagcugccccccaugccccucgccgacacggcgcagauggucccggaguccagcugcuccauggacaaccaccagagccugaacaccaucaccaaguacacccagguguccuggcgggggaaggccgaccagagccaguccagccagaacuccuucgagacggugagcaccgaggucgaccugaagggcaccugcgugcucaagcacaagaugguggaggaguccuaccgcagccggaaguccaucaccugcuacgaccugagcugcaacuccacguacugcaagcccacccuguacaugaucguccccauccacgccugcaacaugaugaagagcugccucaucgcccuggggcccuaccgcgugcagguggucuacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcaccugcaacgacaccgagaacaaggugcagggguacuacaucugcaucgucggcgggaacuccgcccccaucuacgcccccacccucgacgacuuccgcagcauggaggccuucacgggcaucuuccgguccccccacggcgaggaccacgaccuggcgggggaggagaucgccagcuacuccaucgugggcccggccaacgccaaggugccccacagcgccuccagcgacacccugucccucaucgcguacagcgggauccccuccuacagcucccugagcaucaucaccuccagcaccgaggccaagcacgucuucucccccggccuguucccgaagcucaaccacacgaacugcaacaagggcgccaucccccugaucuggaccgggaugaucgaccugcccggcuacuacgaggccgugcaccccugcaccguguucugcguccucagcgggccgggcgccagcugcgaggcguucuccgaggggggcaucuucaacaucaccagccccaugugccugguguccaagcagaaccgcuuccggcugacggagcagcaggugaacuucgucugccagcgcguggacauggacaucguggucuacugcaacggccagcggaaggugauccucaccaagacccuggugaucgggcagugcaucuacaccaucacgagccuguucucccuccugcccggcgucgcccacagcaucgccguggagcugugcgugcccggguuccacggcugggccaccgccgcgcuccuggucaccuucugcuucgggugggugcugaucccggccaucaccuucaucauccucacggugcugaaguucaucgccaacaucuuccacaccuccaaccaggagaaccgccugaagagcguccuccggaagaucaaggaggaguucgagaagaccaagggcuccauggugugcgacaucugcaaguacgagugcgagaccuacaaggagcugaaggcccacggcgugagcugcccccagucccagugccccuacugcuucacgcacugcgagcccaccgaggccgcguuccaggcccacuacaaggucugccaggugacccaccgcuuccgggacgaccugaagaagaccgugaccccgcagaacuucacgcccgggugcuaccgcacccucaaccuguuccgguacaagagccgcugcuacaucuucaccauguggaucuuccugcucguccuggaguccauccugugggccgccagcgcguccgagaccccccucacgccgguguggaacgacaacgcccacggcguggggagcguccccaugcacaccgaccuggagcuggacuucucccucaccagcagcuccaaguacaccuaccggcgcaagcugacgaacccccuggaggaggcccagagcaucggccugcacaucgagaucgaggagcagaccaucgggguggacgugcacgcccucggccacugguucgacggccggcugaaccugaagaccuccuuccacugcuacggggccugcaccaaguacgaguaccccuggcacacggcgaagugccacuacgagcgcgacuaccaguacgagaccagcuggggcugcaacccguccgacugccccggggucggcaccggcugcaccgccugcgggcucuaccuggaccagcugaagcccgugggcagcgccuacaagaucaucacgauccgcuacucccggcgcgugugcguccaguucggggaggagcaccucugcaagaucaucgacaugaacgacugcuucgugagccggcacgugaaggucugcaucaucggcaccguguccaaguucagccagggggacacccugcuguucuucggcccccucgagggcgggggccugaucuucaagcacuggugcaccuccacgugccaguucggggacccgggcgacaucaugagcccccgcgacaagggguuccugugccccgaguuccccggcuccuuccggaagaagugcaacuucgccaccaccccgaucugcgaguacgacggcaacauggugagcggguacaagaaggucauggccaccaucgacuccuuccagagcuucaacacguccaccaugcacuucaccgacgagcgcaucgaguggaaggaccccgacggcaugcuccgggaccacaucaacauccuggugaccaaggacaucgacuucgacaaccugggggagaaccccugcaagaucggccuccagacgagcuccaucgagggggcguggggcagcggcgugggguucacccugaccugccuggucagccucaccgagugccccacguuccugaccuccaucaaggccugcgacaaggccaucugcuacggcgccgagagcgugacccugacccgcgggcagaacacggugaaggucuccggcaaggggggccacagcggcuccaccuucaagugcugccacggggaggagugcagccagaucggccuccacgccgcggccccgcaccuggacaaggugaacgggaucuccgagaucgagaacagcaagguguacgacgacggcgccccccagugcggcaucaagugcugguucgucaaguccggggaguggaucagcggcaucuucuccgggaacuggaucgugcugaucguccucugcguguuccugcuguucagccucgugcugcuguccauccucugccccguccggaagcacaagaagagcuga

SEQ ID NO: 11770 - RNA, 3408 nt, Artificial Sequence
  derived and/or modified CDS sequence (opt1) from HTNV(Aa09-189)__KY594716.1__GP
augggcaucuggaaguggcuggugauggccagccucgucuggcccguguucacccugcgcaacguguacgacaugaagaucgagugcccgcacaccgucuccuucggggagaacagcgugaucggcuacguggagcugccccccaugccccucgccgacacggcgcagauggucccggaguccagcugcuccauggacaaccaccagagccugaacaccaucaccaaguacacccagguguccuggcgggggaaggccgaccagagccaguccagccagaacuccuucgagacggugagcaccgaggucgaccugaagggcaccugcgugcucaagcacaagaugguggaggaguccuaccgcagccggaaguccaucaccugcuacgaccugagcugcaacuccacguacugcaagcccacccuguacaugaucguccccauccacgccugcaacaugaugaagagcugccucaucgcccuggggcccuaccgcgugcagguggucuacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcaccugcaacgacaccgagaacaaggugcagggguacuacaucugcaucgucggcgggaacuccgcccccaucuacgcccccacccucgacgacuuccgcagcauggaggccuucacgggcaucuuccgguccccccacggcgaggaccacgaccuggcgggggaggagaucgccagcuacuccaucgugggcccggccaacgccaaggugccccacagcgccuccagcgacacccugucccucaucgcguacagcgggauccccuccuacagcucccugagcaucaucaccuccagcaccgaggccaagcacgucuucucccccggccuguucccgaagcucaaccacacgaacugcgacaagggcgccaucccccugaucuggaccgggaugaucgaccugcccggcuacuacgaggccgugcaccccugcaccguguucugcguccucagcgggccgggcgccagcugcgaggcguucuccgaggggggcaucuucaacaucaccagccccaugugccugguguccaagcagaaccgcuuccggcugacggagcagcaggugaacuucgucugccagcgcguggacauggacaucguggucuacugcaacggccagcggaaggugauccucaccaagacccuggugaucgggcagugcaucuacaccaucacgagccuguucucccuccugcccggcgucgcccacagcaucgccguggagcugugcgugcccggguuccacggcugggccaccgccgcgcuccuggucaccuucugcuucgggugggugcugaucccggccaucaccuucaucauccucacggugcugaaguucaucgccaacaucuuccacaccuccaaccaggagaaccgccugaagagcguccuccggaagaucaaggaggaguucgagaagaccaagggcuccauggugugcgacaucugcaaguacgagugcgagaccuacaaggagcugaaggcccacggcgugagcugcccccagucccagugccccuacugcuucacgcacugcgagcccaccgaggccgcguuccaggcccacuacaaggucugccaggugacccaccgcuuccgggacgaccugaagaagaccgugaccccgcagaacuucacgcccgggugcuaccgcacccucaaccuguuccgguacaagagccgcugcuacaucuucaccauguggaucuuccugcucguccuggaguccauccugugggccgccagcgcguccgagaccccccucacgccgguguggaacgacaacgcccacggcguggggagcguccccaugcacaccgaccuggagcuggacuucucccucaccagcagcuccaaguacaccuaccggcgcaagcugacgaacccccuggaggaggcccagagcaucggccugcacaucgagaucgaggagcagaccaucgggguggacgugcacgcccucggccacugguucgacggccggcugaaccugaagaccuccuuccacugcuacggggccugcaccaaguacgaguaccccuggcacacggcgaagugccacuacgagcgcgacuaccaguacgagaccagcuggggcugcaacccguccgacugccccggggucggcaccggcugcaccgccugcgggcucuaccuggaccagcugaagcccgugggcagcgccuacaagaucaucacgauccgcuacucccggcgcgugugcguccaguucggggaggagcaccucugcaagaucaucgacaugaacgacugcuucgugagccggcacgugaaggucugcaucaucggcaccguguccaaguucagccagggggacacccugcuguucuucggcccccucgagggcgggggccugaucuucaagcacuggugcaccuccacgugccaguucggggacccgggcgacaucaugagcccccgcgacaagggguuccugugccccgaguuccccggcuccuuccggaagaagugcaacuucgccaccaccccgaucugcgaguacgacggcaacauggugagcggguacaagaaggucauggccaccaucgacuccuuccagagcuucaacacguccaccaugcacuucaccgacgagcgcaucgaguggaaggaccccgacggcaugcuccgggaccacaucaacauccuggugaccaaggacaucgacuucgacaaccugggggagaaccccugcaagaucggccuccagacgagcuccaucgagggggcguggggcagcggcgugggguucacccugaccugccuggucagccucaccgagugccccacguuccugaccuccaucaaggccugcgacaaggccaucugcuacggcgccgagagcgugacccugacccgcgggcagaacacggugaaggucuccggcaaggggggccacagcggcuccaccuucaagugcugccacggggaggagugcagccagaucggccuccacgccgcggccccgcaccuggacaaggugaacgggaucuccgagaucgagaacagcaagguguacgacgacggcgccccccagugcggcaucaagugcugguucgucaaguccggggaguggaucagcggcaucuucuccgggaacuggaucgugcugaucguccucugcguguuccugcuguucagccucgugcugcuguccauccucugccccguccggaagcacaagaagagcuga

SEQ ID NO: 11771 - RNA, 3408 nt, Artificial Sequence
  derived and/or modified CDS sequence (opt1) from HTNV(CJilin93)__AY748307.1__GP
augggcauguggaaguggcuggugaucgccagccucgucuggcccgcccuggcgcugcgcaacguguacgacaugaagaucgagugcccccacaccguguccuucggggagaacagcgucaucggcuacguggagcucccgcccaugccccuggccgacaccgcccagauggugcccgaguccagcugcuccauggacaaccaccagagcaucaacacgaucaccaaguacacccaggucaccuggcgggggaaggccgaccccggccaguccagccagaacuccuucgagacgcugagcgccgagguggaccucaaggggaccugcgugcugaagcacaagauggucgaggaguccuaccgcagccggaaguccaucacgugcuacgaccugagcugcaacuccaccuacugcaagcccacccucuacaugaucgugcccauccacgcgugcaacaugaugaaguccugccugaucgcccugggcccguaccgcgugcaggucguguacgagcggaccuacugcaugaccggcgugcucaucgaggggaagugcuucguccccgaccaguccguggugagcaucaucaagcacggcaucuucgacaucgccuccguccacaucgugugcuucuucguggccgucaaggggaacaccuacaagcuguucgagcaggucaagaaguccuucgagagcacgugcaacgacaccgagaacaaggugcagggcuacuacaucugcaucgucgggggcaacagcgcgcccaucuacgugcccacccuggacgacuuccgcagcauggaggccuucaccggcaucuucaaguccccgcacggggaggaccacgaccucgccggcgaggagaucgccagcuacuccaucguggggcccgccaacgcgaaggugccccacagcgccuccagcgacacgcugucccugaucgccuacagcggcauccccuccuacagcucccucagcauccugaccuccagcaccgacgccaagcacguguucuccccgggccuguuccccaagcucaaccacaccaacugcgacaagagcgccaucccccugacguggaccgggaugaucgaccugcccggcuacuacgaggcgauccacccgugcaccgucuucugcgugcucuccgggcccggcgccagcugcgaggccuucagcgagggcgggaucuucaacaucaccucccccaugugccuggugagcaagcagaaccgguuccgccugacggagcagcaggucaacuucgugugccagcggguggacauggacaucgucguguacugcaacggccagcgcaaggugauccucaccaagacccuggucaucgggcagugcaucuacaccaucacgucccuguucagccuccugcccggcguggcccacuccaucgccguggagcugugcgucccgggguuccacggcugggcgaccgccgcccuccuggugaccuacugcuucgggugggugcugauccccgccaucaccuucaucauccucacgguccugaaguucaucgccaacaucuuccacaccagcaaccaggagaaccggcugaaguccgugcuccgcaagaucaaggaggaguucgagaagaccaagggcagcauggugugcgacgucugcaaguacgagugcgagaccuacaaggagcugaaggcgcacggcguguccugcccccagagccagugccccuacugcuucacgcacugcgagccgaccgaggccgccuuccaggcccacuacaaggugugccaggucacccaccgguuccgcgacgaccugaagaagaccgugacgccccagaacuucacccccgggugcuaccggacccucaaccuguuccgcuacaagucccggugcuacaucuucaccauguggguguuccugcucauccuggagagcguccugugggcggccuccgccagcgagaccccgcucacgcccguguggaacgacaacgcccacggcgugggguccguccccaugcacaccgaccuggagcuggacuucagccugaccuccagcagcaaguacaccuaccgccggaagcucacgaacccccuggaggaggcccaguccaucgaccugcacaucgagaucgaggagcagaccaucggcguggacgugcacgcgcucgggcacugguucgacggccgccugaacaucaagaccagcuuccacugcuacggcgccugcaccaaguacgaguacccguggcacacggccaagugccacuacgagcgggacuaccaguacgagaccuccugggggugcaaccccagcgacugccccggcgucgggaccggcugcaccgccugcggccuguaccucgaccagcugaagcccgugggguccgccuacaagaucaucacgauccgcuacagccgccgggugugcguccaguucggcgaggagaaccugugcaagaucaucgacaugaacgacugcuucgugucccgccacgugaaggucugcaucaucgggaccgugagcaaguucucccagggcgacacccuccuguucuucgggccgcuggagggcggcgggcucaucuucaagcacuggugcaccagcacgugccaguucggcgaccccggggacaucaugagcccccgggacaagggcuuccugugccccgaguucccggggagcuuccgcaagaagugcaacuucgcgaccacccccaucugcgaguacgacggcaacaugguguccggcuacaagaaggucauggccaccaucgacagcuuccaguccuucaacacgagcaccaugcacuucaccgacgagcggaucgaguggaaggaccccgacgggaugcugcgcgaccacaucaacauccucgugaccaaggacaucgacuucgacaaccugggcgagaaccccugcaagaucgggcugcagacguccagcaucgagggcgccuggggguccggcgugggcuucacccugaccugccucgucagccugaccgagugcccgacguuccucaccagcaucaaggccugcgacaaggccaucugcuacggggcggaguccgugacccugacccggggccagaacacggugaaggucagcgggaagggcgggcacuccggcagcaccuucaagugcugccacggcgaggacugcuccaagaucgggcugcacgccgccgccccgcaccucgacaaggugaacggcaucagcgagaucgagaacuccaagguguacgacgacggggcgccccagugcggcaucaagugcugguucgucaagagcggcgaguggaucuccgggaucuucagcggcaacuggaucgugcugaucguccugugcguguuccuccuguucucccuggugcuccugagcauccugugccccguccgcaagcacaagaaguccuga

SEQ ID NO: 11772 - RNA, 3408 nt, Artificial Sequence
  derived and/or modified CDS sequence (opt1) from HTNV(KHF,clone:4)__LC209208.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagaacuccuucgagacggugagcaccgaggucgaccugaagggcaccugcgugcugaagcacaagaugguggaggaguccuaccgcagccggaaguccaucaccugcuacgaccucagcugcaacuccacguacugcaagcccacccuguacaugaucguccccauccacgccugcaacaugaugaagagcugccugaucgcccucgggcccuaccgcgugcagguggucuacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcaccugcaacgacaccgagaacaaggugcagggguacuacaucugcaucgucggcgggaacuccgcccccaucuacgugcccacccuggacgacuuccgcagcauggaggccuucacgggcaucuuccgguccccccacggcgaggaccacgaccucgccggggaggagaccgcgaccuacagcaucgugggcccggccaacgccaaggucccccacuccgccagcuccgacacccugagccugaucgccuucuccgggauccccagcuacuccagccucuccauccugacgagcuccaccgaggcgaagcacguguucagccccggccuguucccgaagcucaaccacaccaacugcgacaagggcgccaucccccugauguggaccgggaugaucgaccugcccggcuacuacgaggccauccaccccugcacgguguucugcguccucuccgggccgggcgccagcugcgaggccuucagcgaggggggcaucuucaacaucaccucccccaugugccuggugagcaagcagaaccgcuuccggcugaccaagcagcaggugaacuucgucugccagcgcguggacguggacaucgucguguacugcaacggccagcggaaggugauccucaccaagacgcuggucaucgggcagugcaucuacaccaucaccucccuguucagccuccugcccggcguggcgcacuccaucgccguggagcugugcguccccggguuccacggcugggccaccgccgcccuccuggugacguucugcuucgggugggugcugaucccggcggucaccuucaucauccucgccauccugaaguucaucgccaacaucuuccacaccagcaaccaggagaaccgccugaaguccgugcuccggaagaucaaggaggaguucgagaagaccaagggcagcauggugugcgacgucugcaaguacgagugcgagacguacaaggagcugaaggcccacggcguguccugcccccagagccagugccccuacugcuucacccacugcgagcccaccgaggccgcguuccaggcccacuacaaggugugccaggucacccaccgcuuccgggacgaccugaagaagaccgugacgccgcagaacuucacccccgggugcuaccgcacccucaaccuguuccgguacaagucccgcugcuacaucuucaccauguggaucuuccugcucgugcuggagagcauccugugggccgccuccgcgagcgagacgccccucaccccggucuggaacgacaacgcccacggcgugggguccauccccaugcacaccgaccuggagcuggacuucagccugaccuccagcagcaaguacacguaccggcgcaagcucaccaacccccuggaggaggcccaguccaucgaccugcacaucgagaucgaggagcagaccaucggcguggacguccacgcccucgggcacugguucgacggccggcugaaccugaagaccagcuuccacugcuacggcgccugcacgaaguacgaguaccccuggcacaccgcgaagugccacuacgagcgcgacuaccaguacgagaccuccugggggugcaacccgagcgacugccccggcguggggaccggcugcacggccugcggccucuaccuggaccgccugaagcccgugggguccgccuacaagaucaucaccauccgguacagccgccgggucugcgugcaguucggcgaggagaaccucugcaagaucaucgacaugaacgacugcuucgugucccgccacgucaaggugugcaucaucgggaccgugagcaaguucucccagggcgacacccugcuguucuucgggccccucgagggcggcgggcugaucuucaagcacuggugcacgagcaccugccaguucggcgacccgggggacaucauguccccccgggacaagggcuuccugugccccgaguuccccgggagcuuccgcaagaagugcaacuucgccaccaccccgaucugcgaguacgacggcaacauggucuccggcuacaagaaggugauggccacgaucgacagcuuccaguccuucaacaccagcaccaugcacuucaccgacgagcggaucgaguggaaggaccccgacgggaugcuccgcgaccacaucaacauccuggugacgaaggacaucgacuucgacaaccugggcgagaaccccugcaagaucgggcuccagaccuccagcaucgagggcgcguggggguccggcgucggcuucacccugaccugccuggugagccucacggagugccccaccuuccugaccagcaucaaggccugcgacaaggccaucugcuacggggccgaguccgugacccugacgcggggccagaacaccgucaaggugagcgggaagggcgggcacuccggcagcaccuucaagugcugccacggcgaggacugcuccccgaacgggcuccacgccgcggccccccaccuggacaaggugaacggcaucagcgagaucgagaacuccaaggucuacgacgacggggccccccagugcggcaucaagugcugguucgugaagagcggcgaguggaucuccgggaucuucagcggcaacuggaucguccugaucgugcucugcguguuccugcuguucucccucguccugcugagcauccucugccccgugcgcaagcacaagaaguccuga

SEQ ID NO: 11773 - RNA, 3408 nt, Artificial Sequence
  derived and/or modified CDS sequence (opt1) from HTNV(KHF,clone:5)__LC209209.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccccccaugccccuggccgacacggcgcagcuggucccggaguccagcugcuccauggacaaccaccagagccucaacaccaucaccaaguacacccagguguccuggcgggggaaggccgaccagagccaguccagccagaacuccuucgagacggugagcaccgaggucgaccugaagggcaccugcgugcugaagcacaagaugguggaggaguccuaccgcagccggaaguccaucaccugcuacgaccucagcugcaacuccacguacugcaagcccacccuguacaugaucguccccauccacgccugcaacaugaugaagagcugccugaucgcccucgggcccuaccgcgugcagguggucuacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcaccugcaacgacaccgagaacaaggugcagggguacuacaucugcaucgucggcgggaacuccgcccccaucuacgugcccacccuggacgacuuccgcagcauggaggccuucacgggcaucuuccgguccccccacggcgaggaccacgaccucgccggggaggagaccgcgaccuacagcaucgugggcccggccaacgccaaggucccccacuccgccagcuccgacacccugagccugaucgccuucuccgggauccccagcuacuccagccucuccauccugacgagcuccaccgaggcgaagcacguguucagccccggccuguucccgaagcucaaccacaccaacugcgacaagggcgccaucccccugauguggaccgggaugaucgaccugcccggcuacuacgaggccauccaccccugcacgguguucugcguccucuccgggccgggcgccagcugcgaggccuucagcgaggggggcaucuucaacaucaccucccccaugugccuggugagcaagcagaaccgcuuccggcugaccgagcagcaggugaacuucgucugccagcgcguggacguggacaucgucguguacugcaacggccagcggaaggugauccucaccaagacgcuggucaucgggcagugcaucuacaccaucaccucccuguucagccuccugcccggcguggcgcacuccaucgccguggagcugugcguccccggguuccacggcugggccaccgccgcccuccuggugacguucugcuucgggugggugcugaucccggcggucaccuucaucauccucgccauccugaaguucaucgccaacaucuuccacaccagcaaccaggagaaccgccugaaguccgugcuccggaagaucaaggaggaguucgagaagaccaagggcagcauggugugcgacgucugcaaguacgagugcgagacguacaaggagcugaaggcccacggcguguccugcccccagagccagugccccuacugcuucacccacugcgagcccaccgaggccgcguuccaggcccacuacaaggugugccaggucacccaccgcuuccgggacgaccugaagaagaccgugacgccgcagaacuucacccccgggugcuaccgcacccucaaccuguuccgguacaagucccgcugcuacaucuucaccauguggaucuuccugcucgugcuggagagcauccugugggccgccuccgcgagcgagacgccccucaccccggucuggaacgacaacgcccacggcgugggguccauccccaugcacaccgaccuggagcuggacuucagccugaccuccagcagcaaguacacguaccggcgcaagcucaccaacccccuggaggaggcccaguccaucgaccugcacaucgagaucgaggagcagaccaucggcguggacguccacgcccucgggcacugguucgacggccggcugaaccugaagaccagcuuccacugcuacggcgccugcacgaaguacgaguaccccuggcacaccgcgaagugccacuacgagcgcgacuaccaguacgagaccuccugggggugcaacccgagcgacugccccggcguggggaccggcugcacggccugcggccucuaccuggaccgccugaagcccgugggguccgccuacaagaucaucaccauccgguacagccgccgggucugcgugcaguucggcgaggagaaccucugcaagaucaucgacaugaacgacugcuucgugucccgccacgucaaggugugcaucaucgggaccgugagcaaguucucccagggcgacacccugcuguucuucgggccccucgagggcggcgggcugaucuucaagcacuggugcacgagcaccugccaguucggcgacccgggggacaucauguccccccgggacaagggcuuccugugccccgaguuccccgggagcuuccgcaagaagugcaacuucgccaccaccccgaucugcgaguacgacggcaacauggucuccggcuacaagaaggugauggccacgaucgacagcuuccaguccuucaacaccagcaccaugcacuucaccgacgagcggaucgaguggaaggaccccgacgggaugcuccgcgaccacaucaacauccuggugacgaaggacaucgacuucgacaaccugggcgagaaccccugcaagaucgggcuccagaccuccagcaucgagggcgcguggggguccggcgucggcuucacccugaccugccuggugagccucacggagugccccaccuuccugaccagcaucaaggccugcgacaaggccaucugcuacggggccgaguccgugacccugacgcggggccagaacaccgucaaggugagcgggaagggcgggcacuccggcagcaccuucaagugcugccacggcgaggacugcuccccgaacgggcuccacgccgcggccccccaccuggacaaggugaacggcaucagcgagaucgagaacuccaaggucuacgacgacggggccccccagugcggcaucaagugcugguucgugaagagcggcgaguggaucuccgggaucuucagcggcaacuggaucguccugaucgugcucugcguguuccugcuguucucccucguccugcugagcauccucugccccgugcgcaagcacaagaaguccuga

SEQ ID NO: 11774 - RNA, 3405 nt, Artificial Sequence
  derived and/or modified CDS sequence (opt1) from HTNV__D00376.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccgcccaugccccuggccgacacggcccagcugguccccgaguccagcugcuccauggacaaccaccagagccucaacaccaucaccaaguacacccagguguccuggcgggggaaggccgaccagagccaguccagccagaacuccuucgagacggugagcaccgaggucgaccugaaggggaccugcgugcugaagcacaagaugguggaggaguccuaccgcagccggaaguccaucacgugcuacgaccucagcugcaacuccaccuacugcaagcccacccuguacaugaucguccccauccacgccugcaacaugaugaaguccugccugaucgcccucgggcccuaccgcguccaggugguguacgagcggaccuacugcaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaguccuucgagagcacgugcaacgacaccgagaacaaggugcagggguacuacaucugcaucgucggcgggaacuccgcccccaucuacgugcccacccuggacgacuuccgcagcauggaggccuucaccggcaucuuccggagcccccacggcgaggaccacgaccucgccggggaggagaccgcgaccuacagcaucgugggcccggccaacgccaaggucccccacuccgccagcuccgacacccugagccugaucgccuucuccgggauccccagcuacuccagccucuccauccugacgagcuccaccgaggcgaagcacguguucagccccggccuguucccgaagcucaaccacaccaacugcgacaagggcgccaucccccugauguggaccgggaugaucgacgugccccgcuacuacgacggcauccaccccuucacggucuucugcgugcuguccgggccgggcgccagcugcgaggccuucagcgagggcggcaucuucaacaucaccucccccaugugccucgugagcaagcagaaccgguuccgccugaccgagcagcaggucaacuucgugugccagcggguggacgucgacaucgugguguacugcaacggccagcgcaaggucauccugaccaagacgcucgugaucgggcagugcaucuacaccaucaccucccuguucagccugcuccccggcguggcccacuccaucgcggucgagcugugcgugcccggguuccacggcugggccaccgccgcccugcucgugacguucugcuucggguggguccugaucccggccgugaccuucaucauccuggcgauccucaaguucaucgccaacaucuuccacaccagcaaccaggagaaccggcugaaguccgugcugcgcaagaucaaggaggaguucgagaagaccaagggcagcauggucugcgacgugugcaaguacgagugcgagacguacaaggagcucaaggcccacggcguguccugcccccagagccagugccccuacugcuucacccacugcgagcccaccgaggccgccuuccaggcgcacuacaaggucugccaggugacccaccgguuccgcgacgaccugaagaagaccgugacgccgcagaacuucacccccgggugcuaccggacccugaaccucuuccgcuacaagucccggugcuacaucuucaccauguggaucuuccugcugguccucgagagcauccugugggccgccuccgccagcgagacgccccugaccccgguguggaacgacaacgcgcacggcgugggguccauccccaugcacaccgaccucgagcuggacuucagccugaccuccagcagcaaguacacguaccgccggaagcugaccaacccccucgaggcccaguccaucgaccugcacaucgagaucgaggagcagaccaucggcgucgacgugcacgcccuggggcacugguucgacggccgccucaaccugaagaccagcuuccacugcuacggcgccugcacgaaguacgaguaccccuggcacaccgccaagugccacuacgagcgcgacuaccaguacgagaccuccugggggugcaacccgagcgacugccccggcugcgggaccggcugcacggcgugcggccuguaccucgaccggcugaagcccgugggguccgccuacaagaucaucaccauccgcuacagccggcgcgucugcgugcaguucggcgaggagaaccugugcaagaucaucgacaugaacgacugcuucgugucccggcacgucaaggugugcaucaucgggaccgugagcaaguucucccagggcgacacccuccuguucuucgggccccuggagggcggcgggcucaucuucaagcacuggcgcacgagcacgugccaguucggcgacccgggggacaucaugagcccccgggacaagggcuuccugugccccgaguuccccggguccuuccgcaagaagugcaacuucgccaccaccccgaucugcgaguacgacggcaacauggucuccggcuacaagaaggugauggccaccaucgacagcuuccaguccuucaacaccagcaccaugcacuucaccgacgagcggaucgaguggaaggaccccgacgggaugcugcgcgaccacaucaacauccucgugacgaaggacaucgacuucgacaaccugggcgagaaccccugcaagaucgggcugcagaccuccagcaucgagggcgccuggggguccggcgucggcuucacccugaccugccucgugagccugacggagugccccaccuuccucaccagcaucaaggcgugcgacaaggccaucugcuacggggccgaguccgugacccugacgcggggccagaacaccgucaaggugagcgggaagggcgggcacuccggcagcaccuucaagugcugccacggcgaggacugcuccccgaacgggcugcacgccgccgcgccccaccucgacaaggugaacggcaucagcgagaucgagaacuccaaggaguacgacgacggggcgccccagugcggcaucaagugcugguucgucaagagcggcgaguggaucuccgggaucuucagcggcaacuggaucgugcugaucguccugugcguguuccuccuguucucccuggugcuccugagcauccugugccccguccgcaagcacaagaaguccuga

SEQ ID NO: 11775 - RNA, 3417 nt, Artificial Sequence
  derived and/or modified CDS sequence (opt1) from LANV(510B)__AF005728.1__GP
auggagggcuggcuguucaccauccucggggugugcuacaucaugaccacgguccugcccaagaccaucuacgagcugaagauggagugcccgcacaccgugggccucgggcagggcuacaucaucgggagcgccgagcugggccugaucgacaucgccaccgugcccgagaucaagcucgaguccagcugcaacuucgaccugcacacgaccuccagcacccagaaguccuucacccagcuggaguggcgcaagaaggcggagacgaccgacaccacccaggccgccagcacgaccuucgaggcccagaccaagaccgucaacauccggggcacgugcauccucgccuccgaccuguacgacacccugaagcgcgugaagaagaccgugcucugcuacgaccugaccugcaaccagacgcagugccagcccaccgucuaccugaucacccccguggggaccugcaugagcauccgguccugcauggcgaaccuccugagcaaccgcauccagaucacguucgagaagacccacugcgugaccggccagcuggucgaggggcagugcuucaacccgucccacagccucacccugucccagccgccccacacguacgacguggugacccugcccacgaccugcuucuucaccgccaagaaggccgaccaguacaagaucgucaagaccuucgagggcaucaucagcaagaccgggugcaccgagaacuccauccagggcuacuacgugugcuucaucggcagccacuccgagccccucaucauccccacgcuggaggacauccggagcgccgagcuggcgucccgcaugcuccugcacccccgcggggaggaccacgacccccugcagaacgcccaggccgugcuccggaucgucggcccgaucaccgccaaggugcccagcagcuccagcaccgagacccugcaggggaucgccuucgcgggcgugcccauguacuccagcuucuccacccugguccggaacgccgaccccgaguacguguucagcccgggcaucauccccgaguccaaccagagcgugugcgacaagaagacgcucccccugaccuggaccggguaccugcccaucuccggcgagauggagaaggucaccgggugcacgguguucugcacccucgccggcccgggggccaacugcgaggccuacagcgaguccggcaucuucaacaucagcuccccgaccugccuggugaacaagguccagcgcuuccggggcagcgagcagaagaucaacuucaugugccagcgcaucgacaacaacguggucguguacugcaacgggcagaagaaggugauccugaccaagacgcucgucaucggccagugcaucuacaccuucaccucccuguucagccugaugcccgacguggcgcacucccucgccguggagcugugcguccccgggcugcacggcugggccaccaucgcccuccugagcacguucugcuucggguggcugcucauccccggcaucacccugaucgugcugaagauccucaagauccugaccuacuccugcagccacuacagcuccgagagcaaguucaagaugauccuggagaaggugaaggucgaguaccagaagaccaugggcuccauggugugcgacaucugccaccacgagugcgagacggugaaggagcuggagagccacaagcaguccugcgucgaggggcagugccccuacugcaugaccgugaccgaggccacccagagcgcgcuccaggcccacuucuccaucugcaagcugacgggccgguuccacgaggcccugaagaagucccucaagaagcccgaggugcaccgcgggugcuaccggacccugggcgucuuccgcuaccggagccgcugcuacguggggcugguguggggcugccuccugaccaucgagcugguccucugggccgccagcgcggagacgccccugcuggagccgggcugguccgacaccgcccacggggugggcgagcucccccugaagaccgaccuggagcucgacuucagccugcccuccagcuccagcuacuccuaccggcgccggcugaccaacccggccaacaaggaggagagccuccccuuccacuuccagauggagaagcaggucauccacgccgagauccagagccuggggcacuggauggacgcgaccuucaacaucaagacggccuuccacugcuacggcgccugcaagcaguacuccuaccccuggcagaccgccaagugcuucuucgagaaggacuaccaguacgagaccggcugggggugcaaccccggcgacugcccgggggugggcaccgggugcacggccugcggcaucuaccuggacaagcucaagagcgugggcaaggcguacaaggugaucucccugaaguacacccgcaaggucugcauccagcuggggaccgagcaggucugcaagcacaucgacgccaacgacugccucgugacccccagcgugaaggugugcaucaucggcacgguguccaagauccagcccagcgacacccugcuguuccucgggccccuggagcagggcggggucauccugaagcaguggugcaccaccuccugcaccuucggcgacccgggcgacaucaugagcacgaccuccgggaugcgcugccccgagcacaccggcagcuuccggaagaucugcggguucgccaccacgcccgugugcgaguaccagggcaacaccaucuccggguaccagcgccucauggccaccaaggacagcuuccaguccuucaaccugaccgacccccacaucacgagcuccaagcuggaguggaucgacccggacggcaacacccgggaccacgugaaccucauccugaaccgcgacgucagcuuccaggaccuguccgacaaccccugcaagguggaccuccacacccagagcaucgacggcgccuggggguccggcgugggguucacccugacgugcgucgugggccugaccgagugccccagcuucaucaccagcaucaaggcgugcgaccucgccaugugcuacggguccaccguggccacgcuggcccggggcagcaacaccgucaagguggugggcaagggcgggcacuccgggagcuccuucaagugcugccacgacagcgacugcuccagcgagggccugauggccuccgcgccccaccucgagcgcgucaccggcuucaaccagaucgacagcgacaagguguacgacgacggggccccgcccugcuccuucaagugcugguucaccaagagcggcgaguggcugcuggggauccucaacggcaacuggaucgugaucgccguccuggugaucauccugaucaucuccaucauccucuucagcuuccugugcccccggcgcucccacaagaagaacguguga

SEQ ID NO: 11776 - RNA, 3402 nt, Artificial Sequence
  derived and/or modified CDS sequence (opt1) from LQUV(Longquan-Rs-32)__JX465402.1__GP
augaaguccauccugcucauccugcugcucgagcagguccgcagcaaggccaccaacgagaucaagcuggagugcccccacgaccagcggguggagaccggcuucagccacggguucacggaccuguccccgauccucuacaccaagggccuguucaccaagcaccuggagaacaacugccccuucgacaucagcaucaucaaccgccucgugcgggacgugcgcaucuccaccuggcaggccaagagcacgaacaccgacgcgaccgucgccuccgccaccagcuucgagacgaaggacaccgacgacaagcuggccggggugugcggcuucuucgacgacaucaccaagcccaagcaggggcagcggaaggccaucaucugcuacgaccuguccugcaaccagacccacugccuccccacgcugcaccugaucuucccgcagcaguucugccagagccucaagcagugcuccaucaacgcguacgaccacaagauccugaucaccaucagccuguccuucugccccgagggccucaucaucggcgggaacugcaucgugcccguccuggcccagagccagcugcuccacaaccacaugaccuacaacaucaaggugaccugcuucuucgaguacuccauggcccgcgagagccuggacaacaaguuccuggaggagaugaaccggcucgugcugggccgcaacugcgagaagacggaguaccucgggggcuacgucugcuuccucgccggguacggcaccgcgauccacgugcccuacgacaacaccuaccuguccggcgccguggucaacagcaugaaggccaaccugcacggggaggaccacgaccggcucaagcugggcgacaccuccgccgugaucgccgggaaccugaaguucgugaucgacagcacggcgccggagaaguccuaccagggcgagugcuucaccggccacaugggguacaccagccucuacuucuaccccguccgcagcaagggcaaguacgugaccauccugacgaagggggugauccccgucaucaacaagacgaccugcaugcccaagaucgugccgcugguguggaccggcauggucgagaugcgggggaucgaggagaagcucgaggccugcaccaugcacugcaucauggugggcaacggcgcgaccugcgaggccuucuccgccaccgggaucuucgacaucaagagcaccacgugccagaucggcaagacccacaaguaccgccggaccgaggaccagaucaccuucacgugccaggaccugaacaaggacaucuccgugaucugcaacggggagaacaucaccguccccgucaagagccugaucgugggccagugcaucuacaccaucaccuccaucuucagcaucuuccccgccaccgcccacuccaucgccacggagaugugcgugcaggggauccacggcuggcucaccaucaucaucuucuucaccuucugcuucggcuggcugcugauccccauccugaccugccugaucaucaacacgaucgccuacagccugaucacccucgccuacuucaagaacggggcgcgccugggcaaccugaucaagcggaugaaguccgaguuccagcgcaccaucgggaacaccacgugcaacaucugccuccgggagugcgagagcgaguccgaguacaagagccacgaggagcugugcaagaacggcuccugcccguacugcaugaaggacaucggggugagccagguccugcugaacgagcacuacaacgccugcaugcucaucgaccgcuacgagaagcggcugacccacacccugaaccagacgccccucuacucccgcaaggugcggaagauccagagcuuccgcuaccgcaaccggugcuucauccugaccguguggaucauccugcucaccgucgagucccugaucugggccagcagcgccgaggacaucaagcccgcccccaaguggcagaacaccgcgcacggcaucggcaccaucaagcugaacuccgacuacgagcucgacuucagcgugguggccggguccgaguucacgcacaagcgcaugcugcagagcccggaguccggcaagaagaacauccccuucaccgucuaccugagcgagcagcucaucaccuccaccgugcagauccuggggaacuggauggacgccgagaucaacgucaagagcguguuccacugcuacggcacgugcaagaaguacuccuaccccuggcagagcucccccugccacaaggagguggacuucgaguuccagagcuccuggggcugcaacccgaucagcugccccgggaucaacuccggcugcaccgccugcgggaccuacguggacaagcugaagaccaucgcgaaggccuaccggaucaucacggucaaguacagccgcaaggugugcuaccagaucggcaccaagaaggccugcaagacccucgaguccaacgacugccuggugagcaacggggucaagaucugcgccaucggcaccaucagcacgcugcagaccggcaugacccucguguucuucgggccccugaacggcggggcccugcucaucaaggacuggugcaucuccagcugcaaguucggcgaccccggggacaucaugcagaucuccaacaacaucacgugcccgagcuucgacggcaccaugcagcgggugugccgcuucggccuggagcccaugugcuccuacagcgggaacaagaucuccggcgucaagcgggugcuggagaccaaggacagcuaccucuccgugaaccugaccaagcccaagcuggucgggagcacccuccuguggaacucccuggacagcuccaucaaggaccacaucaacaucguggugagcaacgacaucgacuucgaggaccucgcggagacgccgugcaaggucaccaucaagaaccugaagaucgagggcgccuggggguccggcaucggcaucaagcugcacugcgaggugagccucuccgagugcagcgaguaccugaccaccaucaaggugugcgacaacgccaucugcuacgggggcaacgucgcccaccugucccgcgggcucaacaccgugaucaucaagggcgccgggggccacagcggcagcuccuucaagugcugccacgagacgagcugcuccgacaucggguucaaggcggaggcgccccaccuggcccggaucguggacgacggcaucaccaccagcauguccuacagcgacggggcccccgaggccggcaucgucuccuggaucuacaagguggccgaguggaucaagggcauguucaacgggaacugguucgugcugaucaucaugauccucuuccugaucaucagcaucguccugcucaucuuccugugccccgugaagaaguacaaguga

SEQ ID NO: 11777 - RNA, 3402 nt, Artificial Sequence
  derived and/or modified CDS sequence (opt1) from LQUV(Longquan-Ra-25)__JX465397.1__GP
augaaguccauccugcucauccugcugcucggccaggugcgcagcaaggccaccaacgagaucaagcuggagugcccccacgaccagcgggucgagaccggguucagccacggcuucacggaccuguccccgauccucuacaccaaggggcuguucaccaagcaccuggagaacaacugccccuucgacaucagcaucaucaaccgccucgugcgggacgugcgcaucuccaccuggcaggccaagagcacgaacaccgacgcgaccgucgccuccgccaccagcuucgagacgaaggacaccgacgacaagcuggccggcgugugcggguucuucgacgacaucaccaagcccaagcagggccagcggaaggccaucaucugcuacgaccuguccugcaaccagacccacugccuccccacgcugcaccugaucuucccgcagcaguucugccagagccucaagcagugcuccaucaacgcguacgaccacaagauccugaucaccaucagccuguccuucugccccgagggccucaucaucgggggcaacugcaucgugcccguccuggcccagagccagcugcuccacaaccacaugaccuacaacaucaaggugaccugcuucuucgaguacuccauggcccgcgagagccuggacaacaaguuccuggaggagaugaaccggcucgugcuggggcgcaacugcgagaagacggaguaccugggcggguacgucugcuuccucgccggcuacggcaccgcgauccacgugcccuacgacaacaccuaccuguccggggccguggucaacagcaugaaggccaaccugcacggcgaggaccacgaccggcucaagcugggggacaccuccgccgugaucgccggcaaccugaaguucgugaucgacagcacggcgccggagaaguccuaccagggcgagugcuucaccgggcacaugggcuacaccagccucuacuucuaccccguccgcagcaaggggaaguacgugaccauccugacgaagggcgugauccccgucaucaacaagacgaccugcaugcccaagaucgugccgcugguguggaccgggauggucgagaugcggggcaucgaggagaagcucgaggccugcaccaugcacugcaucauggugggcaacggggcgaccugcgaggccuucuccgccaccggcaucuucgacaucaagagcaccacgugccagaucgggaagacccacaaguaccgccggaccgaggaccagaucaccuucacgugccaggaccugaacaaggacaucuccgugaucugcaacggcgagaacaucaccguccccgucaagagccugaucguggggcagugcaucuacaccaucaccuccaucuucagcaucuuccccgccaccgcccacuccaucgccacggagaugugcgugcagggcauccacggcuggcucaccaucaucaucuucuucaccuucugcuucggguggcugcugauccccauccugaccugccucaucaucaacacgaucgccuacagccugaucacccucgccuacuucaagaacggcgcgcgccuggggaaccugaucaagcggaugaaguccgaguuccagcgcaccaucggcaacaccacgugcaacaucugccuccgggagugcgagagcgaguccgaguacaagagccacgaggagcugugcaagaacggguccugcccguacugcaugaaggacaucggcgugagccagguccugcugaacgagcacuacaacgccugcaugcucaucgaccgcuacgagaagcggcugacccacacccugaaccagacgccccucuacucccgcaaggugcggaagauccagagcuuccgcuaccgcaaccggugcuucauccugaccguguggaucauccugcucaccgucgagucccugaucugggccagcagcgccgaggacaucaagcccgcccccaaguggcagaacaccgcgcacggcaucgggaccaucaagcugaacuccgacuacgagcucgacuucagcgugguggccggcuccgaguucacgcacaagcgcaugcugcagagcccggaguccgggaagaagaacauccccuucaccgucuaccugagcgagcagcucaucaccuccaccgugcagauccugggcaacuggauggacgccgagaucaacgucaagagcguguuccacugcuacggcacgugcaagaaguacuccuaccccuggcagagcucccccugccacaaggagguggacuucgaguuccagagcuccugggggugcaacccgaucagcugccccggcaucaacuccgggugcaccgccugcggcaccuacguggacaagcugaagaccaucgcgaaggccuaccggaucaucacggucaaguacagccgcaaggugugcuaccagaucgggaccaagaaggccugcaagacccucgaguccaacgacugccuggugagcaacggcgucaagaucugcgccaucggcaccaucagcacgcugcagaccgggaugacccucguguucuucggcccccugaacgggggcgcccugcucaucaaggacuggugcaucuccagcugcaaguucggggaccccggcgacaucaugcagaucuccaacaacaucacgugcccgagcuucgacggcaccaugcagcgggugugccgcuucgggcuggagcccaugugcuccuacagcggcaacaagaucuccggggucaagcgggugcuggagaccaaggacagcuaccucuccgugaaccugaccaagcccaagcuggucggcagcacccuccuguggaacucccuggacagcuccaucaaggaccacaucaacaucguggugagcaacgacaucgacuucgaggaccucgcggagacgccgugcaaggucaccaucaagaaccugaagaucgagggggccuggggcuccggcaucgggaucaagcugcacugcgaggugagccucuccgagugcagcgaguaccugaccaccaucaaggugugcgacaacgccaucugcuacggcgggaacgucgcccaccugucccgcggccucaacaccgugaucaucaagggggccggcggccacagcgggagcuccuucaagugcugccacgagacgagcugcuccgacaucggcuucaaggcggaggcgccccaccuggcccggaucguggacgacgggaucaccaccagcauguccuacagcgacggcgcccccgaggccggcaucaucuccuggaucuacaaggucgccgaguggaucaaggggauguucaacggcaacugguucgugcugaucaucaugauccucuuccugaucaucagcaucgugcugcucaucuuccugugccccgucaagaaguacaaguga

SEQ ID NO: 11778 - RNA, 3402 nt, Artificial Sequence
  derived and/or modified CDS sequence (opt1) from LQUV(Longquan-Ra-5)__JX465398.1__GP
augaaguccauccugcucauccugcugcucggccaggugcgcagcaaggccaccaacgagaucaagcuggagugcccccacgaccagcgggucgagaccggguucagccacggcuucacggaccuguccccgauccucuacaccaaggggcuguucaccaagcaccuggagaacaacugccccuucgacaucagcaucaucaaccgccucgugcgggacgugcgcaucuccaccuggcaggccaagagcacgaacaccgacgcgaccgucgccuccgccaccagcuucgagacgaaggacaccgacgacaagcuggccggcgugugcggguucuucgacgacaucaccaagcccaagcagggccagcggaaggccaucaucugcuacgaccuguccugcaaccagacccacugccuccccacgcugcaccugaucuucccgcagcaguucugccagagccucaagcagugcuccaucaacgcguacgaccacaagauccugaucaccaucagccuguccuucugccccgagggccucaucaucgggggcaacugcaucgugcccguccuggcccagagccagcugcuccacaaccacaugaccuacaacaucaaggugaccugcuucuucgaguacuccauggcccgcgagagccuggacaacaaguuccuggaggagaugaaccggcucgugcuggggcgcaacugcgagaagacggaguaccugggcggguacgucugcuuccucgccggcuacggcaccgcgauccacgugcccuacgacaacaccuaccuguccggggccguggucaacagcaugaaggccaaccugcacggcgaggaccacgaccggcucaagcugggggacaccuccgccgugaucgccggcaaccugaaguucgugaucgacagcacggcgccggagaaguccuaccagggcgagugcuucaccgggcacaugggcuacaccagccucuacuucuaccccguccgcagcaaggggaaguacgugaccauccugacgaagggcgugauccccgucaucaacaagacgaccugcaugcccaagaucgugccgcugguguggaccgggauggucgagaugcggggcaucgaggagaagcucgaggccugcaccaugcacugcaucauggugggcaacggggcgaccugcgaggccuucuccgccaccggcaucuucgacaucaagagcaccacgugccagaucgggaagacccacaaguaccgccggaccgaggaccagaucaccuucacgugccaggaccugaacaaggacaucggcgugaucugcaacggggagaacaucaccguccccgugaagucccugaucgucggccagugcaucuacaccaucaccagcaucuucuccaucuuccccgccaccgcccacagcaucgccacggagaugugcgugcagggcauccacggguggcucaccaucaucaucuucuucaccuucugcuucggcuggcugcugauccccauccugaccugccucaucaucaacacgaucgccuacucccugaucacccucgccuacuucaagaacggggcgcgccugggcaaccugaucaagcggaugaaguccgaguuccagcgcaccaucgggaacaccacgugcaacaucugccuccgggagugcgagagcgagagcgaguacaagucccacgaggagcugugcaagaacggcagcugcccguacugcaugaaggacaucggcgugucccagguccugcugaacgagcacuacaacgccugcaugcucaucgaccgcuacgagaagcggcugacccacacccugaaccagacgccccucuacagccgcaaggugcggaagauccaguccuuccgcuaccgcaaccggugcuucauccugaccguguggaucacccugcucaccgucgagagccugaucugggccuccagcgccgaggacaucaagcccgcccccaaguggcagaacaccgcgcacgggaucggcacgaucaagcugaacagcgacuacgagcucgacuucuccgugguggccgggagcgaguucacccacaagcgcaugcugcaguccccggagagcggcaagaagaacauccccuucaccgucuaccuguccgagcagcucaucaccagcacggugcagauccugggcaacuggauggacgccgagaucaacgugaaguccgucuuccacugcuacgggaccugcaagaaguacagcuaccccuggcaguccagccccugccacaaggagguggacuucgaguuccaguccagcuggggcugcaacccgaucuccugccccgggaucaacagcggcugcaccgccugcgggaccuacguggacaagcugaagacgaucgcgaaggccuaccggaucaucaccgucaaguacucccgcaaggugugcuaccagaucggcaccaagaaggccugcaagacccucgagagcaacgacugccugguguccaacggcgucaagaucugcgccaucgggacgaucagcacccugcagaccggcaugacccucguguucuucgggccccugaacggcggggcccugcucaucaaggacuggugcaucagcuccugcaaguucggcgaccccggcgacaucaugcagaucagcaacaacaucacgugcccguccuucgacgggaccaugcagcgggugugccgcuucggccuggagcccaugugcagcuacuccgggaacaagaucagcggcgucaagcgggugcuggagaccaaggacuccuaccucagcgugaaccugaccaagcccaagcuggucggguccacgcuccuguggaacagccuggacuccagcaucaaggaccacaucaacaucgugguguccaacgacaucgacuucgaggaccucgcggagaccccgugcaaggucaccaucaagaaccugaagaucgagggcgccuggggcagcgggaucggcaucaagcugcacugcgaggugucccucagcgagugcuccgaguaccugaccaccaucaaggugugcgacaacgccaucugcuacgggggcaacgucgcccaccugagccgcgggcucaacacggugaucaucaagggcgccggcgggcacuccggcagcagcuucaagugcugccacgagaccuccugcagcgacaucggguucaaggcggaggcgccccaccuggcccggaucguggacgacggcaucaccaccuccaugagcuacuccgacggcgcccccgaggccgggaucgucagcuggaucuacaagguggccgaguggaucaagggcauguucaacgggaacugguucgugcugaucaucaugauccucuuccugaucaucuccaucguccugcucaucuuccugugccccgugaagaaguacaaguga

SEQ ID NO: 11779 - RNA, 3402 nt, Artificial Sequence
  derived and/or modified CDS sequence (opt1) from LQUV(Longquan-Ra-56)__JX465399.1__GP
augaaguccauccugcucauccugcugcucggccaggugcgcagcaaggccaccaacgagaucaagcuggagugcccccacgaccagcgggucgagaccggguucagccacggcuucacggaccuguccccgauccucuacaccaaggggcuguucaccaagcaccuggagaacaacugccccuucgacaucagcaucaucaaccgccucgugcgggacgugcgcaucuccaccuggcaggccaagagcacgaacaccgacgcgaccgucgccuccgccaccagcuucgagacgaaggacaccgacgacaagcuggccggcgugugcggguucuucgacgacaucaccaagcccaagcagggccagcggaaggccaucaucugcuacgaccuguccugcaaccagacccacugccuccccacgcugcaccugaucuucccgcagcaguucugccagagccucaagcagugcuccaucaacgcguacgaccacaagauccugaucaccaucagccuguccuucugccccgagggccucaucaucgggggcaacugcaucgugcccguccuggcccagagccagcugcuccacaaccacaugaccuacaacaucaaggugaccugcuucuucgaguacuccauggcccgcgagagccuggacaacaaguuccuggaggagaugaaccggcucgugcuggggcgcaacugcgagaagacggaguaccugggcggguacgucugcuuccucgccggcuacggcaccgcgauccacgugcccuacgacaacaccuaccuguccggggccguggucaacagcaugaaggccaaccugcacggcgaggaccacgaccggcucaagcugggggacaccuccgccgugaucgccggcaaccugaaguucgugaucgacagcacggcgccggagaaguccuaccagggcgagugcuucaccgggcacaugggcuacaccagccucuacuucuaccccguccgcagcaaggggaaguacgugaccauccugacgaagggcgugauccccgucaucaacaagacgaccugcaugcccaagaucgugccgcugguguggaccgggauggucgagaugcggggcaucgaggagaagcucgaggccugcaccaugcacugcaucauggugggcaacggggcgaccugcgaggccuucuccgccaccggcaucuucgacaucaagagcaccacgugccagaucgggaagacccacaaguaccgccggaccgaggaccagaucaccuucacgugccaggaccugaacaaggacaucuccgugaucugcaacggcgagaacaucaccguccccgucaagagccugaucguggggcagugcaucuacaccaucuccagcaucuucuccaucuuccccgccaccgcccacagcaucgccaccgagaugugcgugcaguccauccacggcuggcucacgaucaucaucuucuucaccuucugcuucggcuggcugcugauccccauccugaccugccucaucaucaacaccaucgccuacagccugaucacgcucgccuacuucaagaacggggcgcgccugggcaaccugaucaagcggaugaaguccgaguuccagcgcaccaucgggaacacgaccugcaacaucugccuccgggagugcgagagcgaguccgaguacaagagccacgaggagcugugcaagaacggcuccugcccguacugcaugaaggacaucggggugagccagguccugcugaacgagcacuacaacgccugcaugcucaucgaccgcuacgagaagcggcugacccacacccugaaccagacgccccucuacucccgcaaggugcggaagauccagagcuuccgcuaccgcaaccggugcuucauccugaccguguggaucauccugcucaccgucgagagccugaucugggccuccagcgccgaggacaucaagcccgcccccaaguggcagaacaccgcgcacggcaucggcaccaucaagcugaacuccgacuacgagcucgacuucagcgugguggccggguccgaguucacccacaagcgcaugcugcagagcccggaguccggcaagaagaacauccccuucacggucuaccugagcgagcagcucaucaccuccaccgugcagauccuggggaacuggauggacgccgagaucaacgucaagagcguguuccacugcuacgggaccugcaagaaguacuccuaccccuggcagagcucccccugccacaaggagguggacuucgaguuccagagcuccuggggcugcaacccgaucagcugccccggcaucaacuccggcugcacggccugcgggaccuacguggacaagcugaagaccaucgcgaaggccuaccggaucaucaccgucaaguacagccgcaaggugugcuaccagaucggcacgaagaaggccugcaagacccucgagagcaacgacugccugguguccaacggggucaagaucugcgccaucggcaccaucagcacccugcagacgggcaugacccucguguucuucgggccccugaacggcggggcccugcucaucaaggacuggugcaucuccagcugcaaguucggcgaccccggggacaucaugcagaucuccaacaacaucacgugcccgagcuucgacggcaccaugcagcgggugugccgcuucggccuggagcccaugugcuccuacagcgggaacaagaucuccggcgucaagcgggugcuggagaccaaggacagcuaccucuccgugaaccugaccaagcccaagcuggucgggagcacccuccuguggaacucccuggacagcuccaucaaggaccacaucaacaucguggugagcaacgacaucgacuucgaggaccucgcggagaccccgugcaaggucacgaucaagaaccugaagaucgagggcgccuggggguccggcaucggcaucaagcugcacugcgaggugagccucuccgagugcagcaaguaccugaccaccaucaaggugugcgacaacgccaucugcuacgggggcaacgucgcccaccugagccgcgggcucaacaccgugaucaucaagggcgccgggggccacuccggcagcuccuucaagugcugccacgagaccagcugcuccgacaucggguucaaggcggaggcgccccaccuggcccggaucguggacgacggcaucacgaccagcauguccuacagcgacggggcccccgaggccggcaucgucuccuggaucuacaagguggccgaguggaucaagggcauguucaacgggaacugguucgugcugaucaucaugauccucuuccugaucaucagcaucguccugcucaucuuccugugccccgugaagaaguacaaguga

SEQ ID NO: 11780 - RNA, 3402 nt, Artificial Sequence
  derived and/or modified CDS sequence (opt1) from LQUV(Longquan-Ra-90)__JX465400.1__GP
augaaguccauccugcucauccugcugcucggccaggugcgcagcaaggccaccaacgagaucaagcuggagugcccccacgaccagcgggucgagaccggguucagccacggcuucacggaccuguccccgauccucuacaccaaggggcuguucaccaagcaccuggagaacaacugccccuucgacaucagcaucaucaaccgccucgugcgggacgugcgcaucuccaccuggcaggccaagagcacgaacaccgacgcgaccgucgccuccgccaccagcuucgagacgaaggacaccgacgacaagcuggccggcgugugcggguucuucgacgacaucaccaagcccaagcagggccagcggaaggccaucaucugcuacgaccuguccugcaaccagacccacugccuccccacgcugcaccugaucuucccgcagcaguucugccagagccucaagcagugcuccaucaacgcguacgaccacaagauccugaucaccaucagccuguccuucugccccgagggccucaucaucgggggcaacugcaucgugcccguccuggcccagagccagcugcuccacaaccacaugaccuacaacaucaaggugaccugcuucuucgaguacuccauggcccgcgagagccuggacaacaaguuccuggaggagaugaaccggcucgugcuggggcgcaacugcgagaagacggaguaccugggcggguacgucugcuuccucgccggcuacggcaccgcgauccacgugcccuacgacaacaccuaccuguccggggccguggucaacagcaugaaggccaaccugcacggcgaggaccacgaccggcucaagcugggggacaccuccgccgugaucgccggcaaccugaaguucgugaucgacagcacggcgccggagaaguccuaccagggcgagugcuucaccgggcacaugggcuacaccagccucuacuucuaccccguccgcagcaaggggaaguacgugaccauccugacgaagggcgugauccccgucaucaacaagacgaccugcaugcccaagaucgugccgcugguguggaccgggauggucgagaugcggggcaucgaggagaagcucgaggccugcaccaugcacugcaucauggugggcaacggggcgaccugcgaggccuucuccgccaccggcaucuucgacaucaagagcaccacgugccagaucgggaagacccacaaguaccgccggaccgaggaccagaucaccuucacgugccaggaccugaacaaggacaucuccgugaucugcaacggcgagaacaucaccguccccgucaagagccugaucguggggcagugcaucuacaccaucaccuccaucuucagcaucuuccccgccaccgcccacuccaucgccacggagaugugcgugcagggcauccacggcuggcucaccaucaucaucuucuucaccuucugcuucggguggcugcugauccccauccugaccugccucaucaucaacacgaucgccuacagccugaucacccucgccuacuucaagaacggcgcgcgccuggggaaccugaucaagcggaugaaguccgaguuccagcgcaccaucggcaacaccacgugcaacaucugccuccgggagugcgagagcgaguccgaguacaagagccacgaggagcugugcaagaacggguccugcccguacugcaugaaggacaucggcgugagccagguccugcugaacgagcacuacaacgccugcaugcucaucgaccgcuacgagaagcggcugacccacacccugaaccagacgccccucuacucccgcaaggugcggaagauccagagcuuccgcuaccgcaaccggugcuucauccugaccguguggaucauccugcucaccgucgagucccugaucugggccagcagcgccgaggacaucaagcccgcccccaaguggcagaacaccgcgcacggcaucgggaccaucaagcugaacuccgacuacgagcucgacuucagcgugguggccggcuccgaguucacgcacaagcgcaugcugcagagcccggaguccgggaagaagaacauccccuucaccgucuaccugagcgagcagcucaucaccuccaccgugcagauccugggcaacuggauggacgccgagaucaacgucaagagcguguuccacugcuacggcacgugcaagaaguacuccuaccccuggcagagcucccccugccacaaggagguggacuucgaguuccagagcuccugggggugcaacccgaucagcugccccggcaucaacuccgggugcaccgccugcggcaccuacguggacaagcugaagaccaucgcgaaggccuaccggaucaucacggucaaguacagccgcaaggugugcuaccagaucgggaccaagaaggccugcaagacccucgaguccaacgacugccuggugagcaacggcgucaagaucugcgccaucggcaccaucagcacgcugcagaccgggaugacccucguguucuucggcccccugaacgggggcgcccugcucaucaaggacuggugcaucuccagcugcaaguucggggaccccggcgacaucaugcagaucuccaacaacaucacgugcccgagcuucgacggcaccaugcagcgggugugccgcuucgggcuggagcccaugugcuccuacagcggcaacaagaucuccggggucaagcgggugcuggagaccaaggacagcuaccucuccgugaaccugaccaagcccaagcuggucggcagcacccuccuguggaacucccuggacagcuccaucaaggaccacaucaacaucguggugagcaacgacaucgacuucgaggaccucgcggagacgccgugcaaggucaccaucaagaaccugaagaucgagggggccuggggcuccggcaucgggaucaagcugcacugcgaggugagccucuccgagugcagcgaguaccugaccaccaucaaggugugcgacaacgccaucugcuacggcgggaacgucgcccaccugucccgcggccucaacaccgugaucaucaagggggccggcggccacagcgggagcuccuucaagugcugccacgagacgagcugcuccgacaucggcuucaaggcggaggcgccccaccuggcccggaucguggacgacgggaucaccaccagcauguccuacagcgacggcgcccccgaggccggcaucgucuccuggaucuacaagguggccgaguggaucaaggggauguucaacggcaacugguucgugcugaucaucaugauccucuuccugaucaucagcaucguccugcucaucuuccugugccccgugaagaaguacaaguga

SEQ ID NO: 11781 - RNA, 3423 nt, Artificial Sequence
  derived and/or modified CDS sequence (opt1) from NYV(Rhode Island-1 (RI-1))__U36801.1__GP
auggugggcugggucugcaucuuccugguggugcucgccaccaccacggccgggcugacccgcaaccuguacgagcucaagaucgagugcccccacaccgucggccuggggcagggcuacgugaccgggagcguggagacgaccccgauccugcucacccaggucaccgaccugaagaucgaguccagcugcaacuucgaccugcacgugcccuccacgagcauccagaaguacaaccagguggagugggcgaagaaguccagcaccaccgaguccaccagcgccggcgccacgaccuucgaggccaagaccaaggaggucucccucaaggggaccugcaacauccccgugacgaccuucgaggccgcguacaagagccggaagaccgugaucugcuacgaccuggccugcaaccagaccuacugccugcccacgguccaccucaucgccccggugcagaccugcauguccgugcgcagcugcaugaucgggcugcuguccagccggauccaggucaucuacgagaagaccuacugcgugaccggccagcucguggaggggcugugcuucauccccacgcacaccaucgcccugacccagcccggccacaccuacgacacgaugacccuccccaucacgugcuuccuggucgcgaagaagcuggggacccagcucaagaucgccguggagcuggagaagcugaucacggccuccggcugcaccgagaacagcuuccagggcuacuacaucugcuuccucgggaagcacuccgagccgcugagcgugcccaugauggacgacuaccgcuccgccgagcuguucacccggaugguccucaacccccgcggcgaggaccacgaccccgaccagaacgggcagggccugaugcggaucgccggcccgaucaccgcgaaggugcccagcacggagaccaccgagaccaugcaggggaucgccuucgccggcgcccccaccuacagcuccuucagcacgcuggugcgcaaggccgaccccgacuacgucuucuccccggggaucaucgcggagagcaaccacuccgugugcgacaagaaggccaucccccucaccuggaccggcuuccuggccgucagcggggagaucgagaagaucaccggcugcacgguguucugcacccuggugggccccggggccuccugcaaggccuacagcgagaccggcaucuucaacaucuccagcccgaccugccucgucaacaaggugcagaaguuccggggguccgagcagcgcaucaacuucaugugccagcggguggaccaggacgucaucguguacugcaacggccagaagaaggugauccugacgaagacccugaucaucgggcagugcaucuacaccuucaccagccucuucucccugauccccggcgucgcgcacagccuggccguggagcucugcgugcccggccugcacgggugggccacggccgcccugcucaucaccuucugcuucggcuggcugcugauccccaccaucaccaugaucauccucaagauccugcgccugcucacguucuccugcagccacuacuccaccgagagcaaguucaaggcgauccuggagcgggucaagguggaguaccagaagaccaugggguccauggugugcgacgccugccaccacgagugcgagaccgccaaggagcuggagacgcacaagaaguccugccccgagggccagugcccguacugcaugaccaugaccgagagcaccgagagcgcccugcucgcgcacuucagcaucugcaagcugacgaaccgcuuccaggagaaccugaagaagucccucaagcggcccgaggucaagcaggggcgcuaccggacccugggcguguuccgcuacaagagccggugcuacgugggccuggucuggggcgugcuccugaccaccgagcugaucgugugggccgccuccgccgacacgccccucauggagagcggcugguccgacaccgcccacggggucggcaucgugcccaugaagaccgaccuggagcuggacuucgcgcucgccagcuccagcuccuacagcuaccgccggaagcuggugaacccggccaacaaggaggagacccugcccuuccacuuccagcucgacaagcaggucgugcacgccgagauccagaaccugggccacuggauggacgggacguucaacaucaagaccgccuuccacugcuacggcgagugcaagaaguacgcguaccccuggcagaccgccaagugcuucuucgagaaggacuaccaguacgagaccuccugggggugcaacccgcccgacugccccggcguggggacgggcugcaccgccugcggcgucuaccuggacaagcuccgcagcgggggcaaggccuacaagaucgugucccugaaguucacccgcaaggugugcauccagcuggggaccgagcagaccugcaagcacaucgacgucaacgacugccucgugacgcccagcgugaaggucugccugaucggcaccaucuccaagcugcagccgggggacacccuccuguuccugggcccccucgagcagggcgggaucauccugaagcaguggugcaccacgagcugcguguucggcgaccccggggacaucaugagcaccaccaccggcaugaagugccccgagcacacgggguccuuccggaagaucugcggcuucgccaccaccccgaccugcgaguaccagggcaacacgaucagcggguuccagcgcaugauggcgacccgggacuccuuccagagcuucaacgugaccgagccccacaucaccuccaaccgccuggaguggaucgaccccgacagcuccaucaaggaccacaucaacaugguccucaaccgggacgugagcuuccaggaccuguccgacaaccccugcaagguggaccugcacacgcagagcaucgacggcgccuggggguccggcgucggguucacccucgugugcaccgugggccugaccgagugcgccaacuucaucacgagcaucaaggccugcgacuccgcgaugugcuacggcgccaccgucaccaaccugcuccgcgggagcaacaccgugaagguggucggcaagggcgggcacuccagcucccuguucaagugcugccacgacacggacugcaccgaggagggccuggccgccagcccgccccaccucgaccgggugaccggguacaaccagaucgacuccgacaagguguacgacgacggcgccccgcccugcaccaucaagugcugguucaccaagagcggggaguggcugcugggcauccucaacgggaacugggucgugguggcgguccugaucgugauccugauccucagcauccugcuguucuccuucuucugccccauccgcggccggaagaacaagagcaacuga

SEQ ID NO: 11782 - RNA, 3423 nt, Artificial Sequence
  derived and/or modified CDS sequence (opt1) from NYV(New York-1 (NY-1))__U36802.1__GP
auggugggcugggucugcaucagccugguggugcucgccaccaccacggccgggcugacccgcaaccuguacgagcucaagaucgagugcccccacaccgucggccuggggcagggcuacgugaccggguccguggagacgaccccgauccugcucacccaggucaccgaccugaagaucgagagcuccugcaacuucgaccugcacgugcccagcacguccauccagaaguacaaccagguggagugggcgaagaaguccagcaccaccgagagcaccuccgccggcgccacgaccuucgaggccaagaccaaggaggucagccucaaggggaccugcaacauccccgugacgaccuucgaggccgcguacaagucccggaagaccgugaucugcuacgaccuggccugcaaccagacccacugccugcccacgguccaccucaucgccccggugcagaccugcaugagcgugcgcuccugcaugaucgggcugcugagcucccggauccaggucaucuacgagaagaccuacugcgugaccggccagcucguggaggggcugugcuucauccccacgcacaccaucgcccugacccagcccggccacaccuacgacacgaugacccuccccaucacgugcuuccuggucgcgaagaagcuggggacccagcucaagaucgccguggagcuggagaagcugaucaccgccagcggcugcaccgagaacuccuuccagggcuacuacaucugcuuccucgggaagcacagcgagccgcuguucgugcccaugauggacgacuaccgcuccgccgagcuguucacccggaugguccucaacccccgcggcgaggaccacgaccccgaccagaacgggcagggccugaugcggaucgccggcccgaucaccgcgaaggugcccagcacggagaccaccgagaccaugcaggggaucgccuucgccggcgcccccauguacagcuccuucagcacccuggugcgcaaggccgaccccgacuacgucuucuccccggggaucaucgcggagagcaaccacuccgugugcgacaagaagacgaucccccucaccuggaccggcuuccuggccgucagcggggagaucgagaagaucaccggcugcacgguguucugcacccuggugggccccggggccuccugcgaggccuacagcgagaccggcaucuucaacaucuccagcccgaccugccucgucaacaaggugcagaaguuccggggguccgagcagcgcaucaacuucaugugccagcggguggaccaggacgucaucguguacugcaacggccagaagaaggugauccugacgaagacccuggucaucgggcagugcaucuacaccuucaccagccucuucucccugauccccggcguggcccacagccuggcgguggagcucugcguccccggccugcacgggugggccacgaccgcccugcucaucaccuucugcuucggcuggcugcugauccccaccaucacgaugaucauccucaagauccugcgccugcucaccuucuccugcagccacuacuccaccgagagcaaguucaaggccauccuggagcgggugaagguggaguaccagaagaccaugggguccauggucugcgacgugugccaccacgagugcgagacggccaaggagcuggagacccacaagaaguccugccccgagggccagugcccguacugcaugaccaugaccgagagcacggagagcgcgcugcaggcccacuucagcaucugcaagcucaccaaccgcuuccaggagaaccugaagaagucccugaagcggcccgaggugaagcaggggugcuaccgcacccucggcgucuuccgguacaagagccgcugcuacgugggccugguguggggcguccugcucaccacggagcugaucgugugggccgccuccgcggacacgccccugauggagagcggcugguccgacaccgcccacggggugggcaucguccccaugaagaccgaccucgagcuggacuucgcccuggccagcuccagcuccuacagcuaccggcgcaagcucgugaacccggccaacaaggaggagacccugcccuuccacuuccagcuggacaagcaggucgugcacgcggagauccagaaccucggccacuggauggacgggaccuucaacaucaagaccgccuuccacugcuacggcgagugcaagaaguacgccuaccccuggcagaccgccaagugcuucuucgagaaggacuaccaguacgagacguccugggggugcaacccgcccgacugccccggcguggggaccggcugcaccgccugcggcguguaccuggacaagcugcggagcgucgggaaggcguacaagaucgugucccucaaguucacccgcaaggugugcauccagcugggcaccgagcagacgugcaagcacaucgacgucaacgacugccuggugacccccagcgugaaggucugccucaucgggaccaucuccaagcugcagccgggcgacacccuccuguuccuggggccccuggagcagggcggcaucauccucaagcaguggugcacgaccagcugcguguucggggaccccggcgacaucaugagcaccaccacggggaugaagugccccgagcacaccggcuccuuccgcaagaucugcggguucgccaccaccccgacgugcgaguaccagggcaacaccaucagcggcuuccagcggaugauggccacccgcgacuccuuccagagcuucaacgugaccgagccccacaucacguccaaccggcuggaguggaucgaccccgacagcuccaucaaggaccacaucaacaugguccugaaccgcgacgugagcuuccaggaccucuccgacaaccccugcaagguggaccugcacacccagagcaucgacggggccuggggcuccggggucggcuucacccuggugugcaccguggggcucacggagugcgccaacuucaucaccagcaucaaggcgugcgacuccgccaugugcuacggcgccaccgucaccaaccugcugcggggcagcaacacggugaagguggucgggaagggcgggcacuccggcagccucuucaagugcugccacgacaccgacugcaccgaggagggccuggccgcguccccgccccaccuggaccgcgugaccggguacaaccagaucgacagcgacaagguguacgacgacggcgccccgcccugcacgaucaagugcugguucaccaaguccggggaguggcuccugggcauccugaacgggaacugggucguggucgccgugcucaucgugauccugauccugagcauccuccuguucagcuucuucugccccauccggggccgcaagaacaaguccaacuga

SEQ ID NO: 11783 - RNA, 3423 nt, Artificial Sequence
  derived and/or modified CDS sequence (opt1) from NYV(New York-2 (NY-2))__U36803.1__GP
auggugggcuucgucugcaucuuccugguggugcucgccaccaccacggccgggcugacccgcaaccuguacgagcucaagaucgagugcccccacaccgucggccuggggcagggcuacgugaccgggagcgugggcacgaccccgauccugcucacccaggucaccgaccugaagaucgaguccagcugcaacuucgaccugcacgugcccuccacgagcauccagaaguacaaccagguggagugggcgaagaaguccagcaccaccgaguccaccagcgccggcgccacgaccuucgaggccaagaccaaggaggucucccucaaggggaccugcaacauccccgugacgaccuucgaggccgcguacaagagccggaagaccgugaucugcuacgaccuggccugcaaccagacccacugccugcccacgguccaccucaucgccccggugcagaccugcauguccgugcgcagcugcaugaucggccugcuguccagccggauccaggucaucuacgagaagaccuacugcgugaccgggcagcucguggagggccugugcuucauccccacgcacaccaucgcccugacccagcccgggcacaccuacgacacgaugacccuccccaucacgugcuuccuggucgcgaagaagcugggcacccagcucaagaucgccguggagcuggagaagcugaucaccgccggcgggugcaccgagaacuccuuccagggcuacuacaucugcuuccucgggaagcacagcgagccgcuguucgugcccaugauggacgacuaccgcuccgccgagcuguucacccggaugguccucaacccccgcggcgaggaccacgaccccgaccagaacggccaggggcugaugcggaucgccggcccgaucaccgcgaaggugcccagcacggagaccaccgaggccaugcaggggaucgccuucgccggcgcccccauguacuccagcuucagcacccuggugcgcaaggcggaccccgacuacgucuucuccccggggaucaucgccgagagcaaccacuccgugugcgacaagaagaccaucccccucacguggaccggcuuccuggccgucagcggcgagaucgagaagaucaccgggugcaccguguucugcacgcuggugggccccggggccuccugcgaggccuacagcgagaccggcaucuucaacaucuccagcccgaccugccucgucaacaaggugcagaaguuccggggguccgagcagcgcaucaacuucaugugccagcggguggaccaggacgucaucguguacugcaacggccagaagaaggugauccugaccaagacgcuggucaucggccagugcaucuacaccuucaccagccucuucucccugauccccgggguggcgcacagccuggccguggagcucugcguccccggccugcacgggugggccaccacggcccugcucaucaccuucugcuucggcuggcugcugauccccaccaucaccaugaucauccucaagauccugcgccugcucacguucuccugcagccacuacuccaccgagagcaaguucaaggccauccuggagcgggugaagguggaguaccagaagaccaugggguccauggucugcgacgugugccaccacgagugcgagaccgcgaaggagcuggagacgcacaagaaguccugccccgagggccagugcccguacugcaugaccaugaccgagagcaccgagagcgcccugcaggcccacuucagcaucugcaagcucacgaaccgcuuccaggagaaccugaagaagucccugaagcggcccgaggugaagcagggcugcuaccgcacccucggggucuuccgguacaagagccgcugcuacgugggccugguguggggcguccugcucaccaccgagcugaucgugugggccgcguccgccgacacgccccugauggagagcgggugguccgacaccgcccacggcguggggaucguccccaugaagaccgaccucgagcuggacuucgcccuggccagcuccagcuccuacagcuaccggcgcaagcucguggacccggcgaacaaggaggagacccugcccuuccacuuccagcuggacaagcaggucgugcacgccgagauccagaaccucggccacuggauggacgggacguucaacaucaagaccgccuuccacugcuacggcgagugcaagaaguacgccuaccccuggcagaccgccaagugcuucuucgagaaggacuaccaguacgagaccuccugggggugcaacccgcccgacugccccggcgugggcacggggugcaccgcgugcggcguguaccuggacaagcugcggagcgucgggaaggccuacaagaucgugucccucaaguucacccgcaaggugugcauccagcugggcaccgagcagaccugcaagcacaucgacgucaacgacugccuggugacgcccagcgugaaggucugccucaucgggaccaucuccaagcugcagccgggcgacacccuccuguuccugggcccccuggagcagggcgggaucauccucaagcaguggugcaccacgagcugcguguucggggaccccggcgacaucauguccaccaccaccgggaugaagugccccgagcacacgggcagcuuccgcaagaucugcggcuucgccaccaccccgaccugcgaguaccaggggaacacgaucagcggcuuccagcggaugauggccacccgcgacuccuuccagagcuucaacgugaccgagccccacaucaccuccaaccggcuggaguggaucgaccccgacagcuccaucaaggaccacaucaacaugguccugaaccgcgacgugagcuuccaggaccucuccgacaaccccugcaagguggaccugcacacgcagagcaucgacggggccuggggcuccggggucggcuucacccuggugugcaccgugggccucaccgagugcgcgaacuucaucacgagcaucaaggccugcgacuccgccaugugcuacggggccaccgucaccaaccugcugcggggcagcaacaccgugaagguggucgggaagggcggccacuccgggagccucuucaagugcugccacgacacggacugcaccgaggagggccuggcggccuccccgccccaccuggaccgcgugaccggguacaaccagaucgacagcgacaagguguacgacgacggcgccccgcccugcaccaucaagugcugguucacgaaguccggggaguggcuccugggcauccugaacggcaacugggucguggucgccgugcucaucgugauccugauccugagcauccuccuguucuccuucuucugccccauccgggggcgcaagaacaagagcaacuga

SEQ ID NO: 11784 - RNA, 3447 nt, Artificial Sequence
  derived and/or modified CDS sequence (opt1) from PUUV(K27)__L08754.1__GP
augggcgagcugagccccgugugccucuaccugcugcuccaggggcugcugcucugcaacaccggcgccgcccgcaaccugaacgagcugaagauggagugcccgcacaccauccggcucgggcagggccuggucgugggguccguggagcugcccagccuccccauccagcaggucgagacgcugaagcuggaguccagcugcaacuucgaccuccacaccuccaccgcgggccagcagagcuucaccaaguggacgugggagaucaagggcgaccuggccgagaacacccaggccuccagcaccuccuuccagaccaagagcuccgaggugaaccugcgcgggcucugccugauccccacgcugguggucgagaccgccgcccggaugcgcaagaccaucgcgugcuacgaccucagcugcaaccagaccgugugccagccgacgguguaccugaugggccccauccagaccugcaucaccaccaaguccugccugcucagccugggggaccagcggauccaggucaacuacgagaagacguacugcguguccggccagcugguggaggggaucugcuucaaccccauccacaccauggcccucagccagcccucccacaccuacgacaucaugaccaugaugguccgcugcuuccuggugaucaagaaggugacgagcggcgacuccaugaagaucgagaagaacuucgagacccugguccagaagaacggcugcaccgccaacaacuuccagggguacuacaucugccucaucggcagcagcuccgagccgcuguacgugcccgcccuggacgacuaccggagcgcggaggugcucucccgcauggccuucgcgccccacggggaggaccacgacaucgagaagaacgccgucagcgccaugcggaucgccggcaaggugaccggcaaggcccccuccacggagagcuccgacaccgugcaggggaucgccuucagcggcuccccgcuguacaccagcaccgggguccugacguccaaggacgaccccguguacaucugggcccccggcaucaucauggaggggaaccacagcaucugcgagaagaagacccucccccugaccuggaccggcuucaucucccugccgggcgagaucgagaagacgacccagugcaccguguucugcacccucgccgggcccggcgcggacugcgaggccuacagcgagacggggaucuucaacaucuccagcccgaccugcuccaucaaccgcguccagcgguuccgcggcagcgagcagcagaucaaguucgugugccagcgggucgacauggacaucaccguguacugcaacgggaugaagaaggugauccugaccaagacccuggucaucggccagugcaucuacacguucaccuccaucuucagccucauccccggcguggcccacagccuggccguggagcugugcguccccgggcuccacggcugggccaccaugcugcugcuccugacccugugcuucgggugggugcugauccccacgaucaccaugauccuccugaagauccugaucgcguucgccuaccucugcuccaaguacaacaccgacagcaaguuccgcauccugaucgagaaggugaagcgggaguaccagaagaccaugggcuccauggucugcgaggugugccaguacgagugcgagacggccaaggagcuggagagccaccgcaaguccugcagcaucggguccugccccuacugccucaaccccagcgaggccaccaccuccgcccugcaggcgcacuucaaggugugcaagcugaccagccgguuccaggagaaccuccgcaagucccugacggucuacgagccgaugcagggcugcuaccggacccugagccucuuccgcuaccggucccgcuucuucgugggccugguguggugcguccugcucgugcuggagcugaucgugugggccgccagcgccgagacccagaaccucaacgcgggguggaccgacacggcccacggcuccgggaucauccccaugaagaccgaccuggagcuggacuucagccuccccuccagcgccagcuacaccuaccgccggcagcugcagaaccccgccaacgagcaggagaagaucccguuccaccuccagcucuccaagcaggucauccacgccgagauccagcaccugggccacuggauggacgcgaccuucaaccugaagacggccuuccacugcuacggcagcugcgagaaguacgccuaccccuggcagaccgccgggugcuucaucgagaaggacuacgaguacgagaccggcugggggugcaacccgcccgacugccccggcguggggaccggcugcacggccugcggcguguaccucgacaagcugaaguccgucgggaagguguucaagaucgugagccugcgcuacacccggaaggucugcauccagcucggcaccgagcagaccugcaagacgguggacuccaacgacugccugaucaccaccagcgugaaggucugccugaucgggaccaucuccaaguuccagcccagcgacacgcuccuguuccugggcccccuccagcagggcgggcugaucuucaagcaguggugcaccacgaccugccaguucggcgacccgggggacaucauguccacccccaccggcaugaagugccccgagcugaacgggagcuuccgcaagaagugcgcguucgccaccacccccgugugccaguucgacggcaacaccaucuccggguacaagcggaugaucgccacgaaggacagcuuccaguccuucaacgugaccgagccgcacaucagcaccuccgcccucgaguggaucgaccccgacagcucccugcgcgaccacaucaacgucaucgugagccgggaccuguccuuccaggaccucagcgagacccccugccagaucgaccuggccacggcgagcaucgacggcgccuggggcuccggggugggcuucaaccuggucugcaccgugagccucaccgagugcuccgccuuccugaccagcaucaaggccugcgacgcggccaugugcuacggguccacgaccgccaaccuggugcgcggccagaacaccauccacaucgucgggaagggcggccacagcggguccaaguucaugugcugccacgacaccaagugcagcuccacgggccucguggccgccgcgccccaccuggaccgggugaccggguacaaccaggccgacagcgacaagaucuucgacgacggcgccccggagugcggcauguccugcugguucaagaaguccggggaguggauccugggcguccucaacgggaacuggauggugguggccguccugguggugcugcucauccugagcauccugcuguucacccugugcugcccccgccggcccagcuaccgcaaggagcacaagcccuga

SEQ ID NO: 11785 - RNA, 3447 nt, Artificial Sequence
  derived and/or modified CDS sequence (opt1) from PUUV(13891)__U22418.1__GP
augggcaagaucauccccgugugccuguaccuccuguuccugugccuccugcuguggaaccgcggggacgcccggaaccucaacgagcugaagauggagugcccgcacaccaucggccuggggcagggccucgucaucgggagcguggagcugccgcccgugccccugacccaggucgagucccucaagcuggagagcuccugcaacuucgaccugcacacgagcaccuccagccagcaguccuucaccaaguggaccugggagaucaagaacgaccucgccgagaacacgcaggcgagcuccaccagcuuccagaccaaguccagcgagaucaaccugcgcggccugugccucaucccgccccuggugaucgagaccgccgcccggacgcgcaagaccaucgccugcuucgaccuguccugcaaccagaccgccugccagcccaccguguuccucaucggccccauccagacgugcaucaccaccaagagcugccugcuggggcucggcgaccagcggauccaggucaacuacgagaagaccuacugcguguccgggcagcugguggagggcgucugcuucaacccggugcacacgauggcgcugagccagcccucccacaccuacgacaucgugaccgucauggugcgcugcuuccucaucgugaagaaggucagcaccggggacuccaugaagcuggagaaguccuucgagacgcuggugcagaagaccggcugcaccggcaacggguuccagggcuacuacgugugccucgucgggagcagcagcgagccccuguacauccccacccuggacgacuaccgguccgccgagauccucagccgcauggccuucgccccgcacggcgaggaccacgacguggagaagaacgcgaucuccgccaugcggaucgugggcaaggucacggggaaggcccccagcaccgaguccagcgacaccauccagggcaucgccuucuccgggaacccccuguacaccagcacgggcgugcugaccgccaaggacgaccccguguacaucugggcgccggggaucaucauggagggcaaccacuccgucugcgacaagaagacccucccccugaccuggacgggcuucaucccccugcccggggagaucgagaagaccacccagugcaccguguucugcacgcucgccggcccgggggccgacugcgaggccuacagcgagaccggcaucuucaacaucuccagcccgaccugccugaucaaccgcguccagcgguuccgcggggccgagcagcagaucaaguucaucugccagcggguggacauggacaucaccguguacugcaacggccugaagaaggucauccucaccaagacgcuggugaucggccagugcaucuacaccuucaccuccaucuucagccugauccccgggguggcgcacucccucgccgucgagcugugcgugcccggccugcacgggugggccaccaugcuccugcugcugacguucugcuucggcuggauccucauccccuucuucagcaugauccugcugaagauccucaucgccuucgccuaccugugcuccaaguacaacaccgacagcaaguucaagauccugaucgagaaggugaagcgcgaguaccagaagaccauggggagcauggucugcgaggugugccaguacgagugcgagaccgcgaaggagcucgagucccaccgcaagagcugccccaucggcuccugccccuacugccugaaccccgccgaggccacgaccagcgcccugcaggcccacuucaaggugugcaagcucaccucccgguuccaggacaaccugcgcaagagccugggcgcguacgagccgaagcaggggugcuaccggacccucucccuguuccgguaccgcagccgguucuucgucggcuucaacuggugccugcuccuggugcuggagcucaucgugugggccgccuccgccgagacgcagagccugaacuccggguggaccgacaccgcgcacggcagcggcaucauccccaugcgcaccgaccuggagcucgacuucucccugcccagcuccgccagcuacacguaccgccggcagcugcagaacccggccaacgagcaggagaagauccccuuccaccuccagaucuccaagcaggucauccacgccgagauccagcaccuggggcacuggauggacggcaccuucaaccugaagaccgccuuccacugcuacgggagcugcgagaaguacgcguaccccuggcagaccgccggcugcuucaucgagaaggacuacgaguacgagagcggguggggcugcaacccgcccgacugccccggcguggggacgggcugcaccgccugcgggguguaccucgacaagcugaaguccgucggcaaggccuucaagaucgugagccugcgcuacacccggaaggccugcauccagcucgggaccgagcagacgugcaaguccguggacagcaacgacugccuggucaccaccuccgugaaggugugccugaucggcaccgucagcaaguuccagcccuccgacacgcuccuguuccugggcccccucgagcagggcgggcugaucuucaagcaguggugcaccacgaccugccaguucggggaccccggcgacaucaugagcacccccguggggaugaagugccccgagcuguccggcagcuuccgcaagaagugcgcguucgccaccacccccgugugccaguucgacggcaacacccucuccggguacaagcggaugaucgccacgaaggacagcuuccaguccuucaacgucaccgagccgcacaucagcgccuccagccuggaguggaucgaccccgacuccagccugcgcgaccacaucaacgugaucgugggccgggaccucuccuuccaggaccugagcgagacccccugccaggucgaccuggccaccaccagcaucgacggggcguggggcuccggggugggcuucaaccucgugugcagcgucucccugacggagugcagcaccuuccugaccuccaucaaggccugcgacagcgccaugugcuacggcuccaccacggccaaccuccugcgcgggcagaacaccgugcacaucgugggcaagggcgggcacagcggcuccaaguucaugugcugccacgacaccaagugcagcuccaccgggcuggucgcggccgcgccccaccucgaccgggugacgggcuacaaccaggccgacagcgacaagaucuucgacgacggggccccggagugcggcaucuccugcugguucaccaagagcggggaguggauccugggcgugcugaacggcaacuggauggucguggccgugcucaucgcccuguucaucuucuccaucuuccuguucacccucugcugcccccgccggcccagcuacgccaaggagcacaagcccuga

SEQ ID NO: 11786 - RNA, 3447 nt, Artificial Sequence
  derived and/or modified CDS sequence (opt1) from PUUV(CG17/Baskiria-2001)__AF442614.1__GP
augggcgagcugagccccgugugccucuaccugcugcuccaggggcugcugcucugcaacaccggcgccgcccgcaaccugaacgagcugaagauggagugcccgcacaccaucgggcucggccaggggcuggucgugggcuccguggagcugcccagccuccccauccagcaggucgagacgcugaagcuggaguccagcugcaacuucgaccuccacaccuccaccgccggccagcagagcuucaccaaguggacgugggagaucaagggggaccuggccgagaacacccaggccuccagcaccuccuuccagaccaagagcuccgaggugaaccugcggggccucugccugauccccacgcugguggucgagaccgccgcccgcaugcggaagaccaucgcgugcuacgaccucagcugcaaccagaccgugugccagccgacgguguaccugauggggcccauccagaccugcaucaccaccaaguccugccugcucagccugggcgaccagcgcauccaggucaacuacgagaagacguacugcguguccgggcagcugguggagggcaucugcuucaaccccauccacaccauggcccucagccagcccucccacaccuacgacaucaugaccaugaugguccggugcuuccuggugaucaagaaggugacgagcggcgacuccaugaagaucgagaagaacuucgagacccugguccagaagaacgggugcaccgccaacaacuuccagggcuacuacaucugccucaucgggagcagcuccgagccgcuguacgugcccgcccuggacgacuaccgcagcgcggaggugcucucccggauggccuucgcgccccacggcgaggaccacgacaucgagaagaacgccgucagcgccaugcgcaucgccggcaaggugaccgggaaggcccccuccacggagagcuccgacaccgugcagggcaucgccuucagcggguccccgcuguacaccagcaccggcguccugacguccaaggacgaccccguguacaucugggcccccgggaucaucauggagggcaaccacagcaucugcgagaagaagacccucccccugaccuggaccggcuucaucucccugccgggggagaucgagaagacgacccagugcaccguguucugcacccucgccggccccggggcggacugcgaggccuacagcgagacgggcaucuucaacaucuccagcccgaccugccugaucaaccggguccagcgcuuccgcggggccgagcagcagaucaaguucgugugccagcgggucgacauggacaucaccguguacugcaacggcaugaagaaggugauccugaccaagacccucgucaucggccagugcaucuacacguucaccuccaucuucagccugauccccgggguggcccacucccuggccguggagcucugcguccccggccugcacgggugggcgaccaugcugcuccugcugaccuucugcuucggcugggugcugauccccacgaucaccaugauccuccugaagauccugaucgccuucgccuaccucugcagcaaguacaacaccgacagcaaguuccggauccugaucgagaaggugaagcgcgaguaccagaagaccaugggguccauggucugcgaggugugccaguacgagugcgagacggccaaggagcuggagagccaccggaaguccugcagcaucggcuccugccccuacugccucaaccccagcgaggccaccaccuccgcgcugcaggcccacuucaaggugugcaagcugaccagccgcuuccaggagaaccuccggaagucccugacggucuacgagccgaugcagggcugcuaccgcacccugagccucuuccgguaccgcucccgguucuucguggggcugguguggugcguccugcucgugcuggagcugaucgugugggccgccagcgcggagacccagaaccucaacgccggcuggaccgacacggcccacggguccggcaucauccccaugaagaccgaccuggagcuggacuucagccuccccuccagcgccuccuacaccuaccgccgccagcugcagaaccccgccaacgagcaggagaagaucccguuccaccuccagcucagcaagcaggucauccacgcggagauccagcaccugggccacuggauggacgccaccuucaaccugaagacggccuuccacugcuacgggagcugcgagaaguacgccuaccccuggcagaccgccggcugcuucaucgagaaggacuacgaguacgagaccggguggggcugcaacccgcccgacugccccggggugggcaccggcugcacggcgugcgggguguaccucgacaagcugaaguccgucggcaagguguucaagaucgugagccugcgguacacccgcaaggucugcauccagcucgggaccgagcagaccugcaagacgguggacuccaacgacugccugaucaccaccagcgugaaggucugccugaucggcaccaucuccaaguuccagcccagcgacacgcuccuguuccuggggccccuccagcagggcggccugaucuucaagcaguggugcaccacgaccugccaguucggggacccgggcgacaucauguccacccccaccgggaugaagugccccgagcugaacggcagcuuccggaagaagugcgccuucgccaccacccccgugugccaguucgacgggaacaccaucuccggcuacaagcgcaugaucgccacgaaggacagcuuccaguccuucaacgugaccgagccgcacaucagcaccuccgcccucgaguggaucgaccccgacagcucccugcgggaccacaucaacgucaucgugagccgcgaccuguccuuccaggaccucagcgagacccccugccagaucgaccuggcgacggccuccaucgacggcgccugggggagcggcgugggguucaaccuggucugcaccgugagccucaccgagugcuccgccuuccugaccagcaucaaggcgugcgacgccgccaugugcuacggcuccacgaccgccaaccuggugcgggggcagaacaccauccacaucgucggcaagggcgggcacagcggcuccaaguucaugugcugccacgacaccaagugcagcuccacggggcucguggccgcggcgccccaccuggaccacgugaccggcuacaaccaggccgacagcgacaagaucuucgacgacggcgccccggagugcgggauguccugcugguucaagaaguccggcgaguggauccuggggguccucaacggcaacuggauggugguggccguccugguggugcugcucauccugagcauccugcuguucacccugugcugcccccgccggcccagcuaccgcaaggagcacaagcccuga

SEQ ID NO: 11787 - RNA, 3447 nt, Artificial Sequence
  derived and/or modified CDS sequence (opt1) from PUUV(CG215/Omsk)__AF442615.1__GP
augggcaagcugagccccgugugccucuaccugcugcuccagugccugcugcucggggaccgcggcgacgcccggaaccugaacgagcugaagauggagugcccgcacaccaucgggcucggccaggggcuggucgugggcuccguggagcugccgcccguccccauccagcaggucgagagccucaagcuggaguccagcugcaacuucgaccugcacaccuccacggccggccagcagagcuucaccaaguggaccugggagaucaagaacgaccucgcggagaacacccaggccuccagcacguccuuccagaccaagagcuccgaggugaaccugcgcgggcugugccucauccccacccuggugguggagaccgccgcccggacgcgcaagaccaucgccugcuacgaccugaccugcaaccagaccgugugccagcccacggucuaccucaugggccccauccagaccugcgugaccaccaagagcugccugcuggggcucggcgaccagcggauccaggugaacuacgagaagacguacugcgucuccgggcagcugguggagggcgugugcuucaaccccauccacaccauggcgcugagccagccgucccacaccuacgacgucaugacccucauggugcgcugcuuccugaucaucaagaaggugacgagcggcgacuccaugaagaucgagaagaacuucgagacccugguccagaagaccgggugcaccggcaacaacuuccagggguacuacaucugccucaucggcagcuccagcgagccccuguacgugcccacgcuggacgacuaccggagcgccgaggugcucucccgcauggccuucgcgccccacggcgaggaccacgacaucgagaagaacgccgucagcaccaugcggaucgccgggaaggugaccggccgcgccccguccaccgaggccagcgacacggugcaggggaucgccuucuccggcagcccccuguacaccuccaccgggguccugaccgcgaaggacgaccccguguacaucugggcccccggcaucaucauggagggcaaccacagcuccugcgacaagaagacgcucccgcugaccuggaccggguucaucagccugcccggcgagaucgagaagaccacgcagugcaccgucuucugcacccucgccgggcccggcgccgacugcgaggccuacuccgagaccgggaucuucaacaucagcuccccgaccugccugaucaaccgggugcagcgcuuccggggcgcggagcagcagaucaaguucgugugccagcgcgucgacauggacaucaucguguacugcaacggcaucaagaaggugauccugacgaagacccucgucaucgggcagugcaucuacaccuucaccagcaucuucucccugauccccggcguggcccacagccuggccguggagcucugcguccccgggcugcacggcuggacgaccaugcugcuccugcugaccuucugcuucgggugggugcugauccccuucaucaccaugauccuccugaagauccugaucgccuucgccuaccucugcuccaaguacaacacggacagcaaguuccggauccugguggagaaggucaagaaggaguaccagaagaccaugggcuccauggugugcgaggugugccaguacgagugcgagaccgcgaaggagcuggagagccaccgcaagagcugcuccaucggcagcugccccuacugccucaacccguccgaggccaccacgagcgcccugcaggcccacuucaaggucugcaagcugaccucccgguuccaggagaaccuccgcaagagccugaccguguacgagcccaugcaggggugcuaccggacccugucccucuuccgcuaccggagcaaguucuucgugggccuggucuggugccugcuccuggugauggagcugaucgugugggccgcguccgccgagacgcagaaccucaacagcggguggaccgacaccgcccacggcuccggcaucauccccaugaagaccgaccuggagcuggacuucagccuccccuccagcgccuccuacacguaccgccgccagcugcagaacccggcgaacgagcaggagaagauccccuuccaccuccagaucagcaagcaggucauccacgccgagauccagcaccuggggcacuggauggacgccaccuucaaccugaagaccgccuuccacugcuacggcuccugcgagaaguacgccuaccccuggcagaccgcggggugcuucaucgagaaggacuacgaguacgagacgggcugggggugcaacccgcccgacugccccggcgugggcaccgggugcaccgccugcggcguguaccuggacaagcucaagagcgucgggaagguguucaagaucgugagccugaaguacacccggaaggucugcauccagcugggcacggagcagaccugcaagaccguggacuccaacgacugccucaucaccacgagcgugaaggucugcaugaucgggaccaucuccaaguuccagcccagcgacacccugcuguuccucggcccgcugcagcagggcgggcugaucuucaagcaguggugcaccacgaccugccaguucggcgaccccggggacaucauguccacccccaccggcaugaagugccccgagcucaacgggagcuuccgcaagaagugcgccuucgccaccacgccggugugccaguucgacggcaacaccaucuccggcuacaagcggaugaucgccaccaaggacagcuuccaguccuucaacgugaccgagccccacaucagcgcguccgcccuggaguggaucgaccccgacagcucccugcgcgaccacaucaacgucgugguggggcgggaccucagcuuccaggaccuguccgagacgcccugccaggucgaccugaugaccagcaccaucgacggcgccuggggguccggcgugggguucaaccucgugugcaccgucagccugacggagugcuccccguuccugaccagcaucaaggccugcgacagcgccaugugcuacggcuccaccaccgugaaccucgugcgcggccagaacacgguccacaucguggggaagggcgggcacagcggcuccaaguucaugugcugccacgacaccaagugcagcuccaccggccugguggcggccgcgccccaccuggaccgggucaccggguacaaccaggccgacagcgacaagaucuucgacgacggcgcccccgagugcgggauguccugcugguucaagaaguccggcgaguggauccucggggugcugaacggcaacuggaugguggucgccgugcugaucgcccuccugauccugagcauccucauguucacgcugugcugcccccgccggccgagcuaccgcaaggagcacaagcccuga

SEQ ID NO: 11788 - RNA, 3447 nt, Artificial Sequence
  derived and/or modified CDS sequence (opt1) from PUUV(CG222/Omsk)__AF442616.1__GP
augggcaagcugagccccgugugccucuaccugcugcuccagugccugcugcucggggaccgcggcgacgcccggaaccugaacgagcugaagauggagugcccgcacaccaucgggcucggccaggggcuggucgugggcuccguggagcugccgcccguccccauccagcaggucgagagccucaagcuggaguccagcugcaacuucgaccugcacaccuccacggccggccagcagagcuucaccaaguggaccugggagaucaagaacgaccucgcggagaacacccaggccuccagcacguccuuccagaccaagagcuccgaggugaaccugcgcgggcugugccucauccccacccuggugguggagaccgccgcccggacgcgcaagaccaucgccugcuacgaccugaccugcaaccagaccgugugccagcccacggucuaccucaugggccccauccagaccugcgugaccaccaagagcugccugcuggggcucggcgaccagcggauccaggugaacuacgagaagacguacugcgucuccgggcagcugguggagggcgugugcuucaaccccauccacaccauggcgcugagccagccgucccacaccuacgacgucaugacccucauggugcgcugcuuccugaucaucaagaaggugacgagcggcgacuccaugaagaucgagaagaacuucgagacccugguccagaagaccgggugcaccggcaacaacuuccagggguacuacaucugccucaucggcagcuccagcgagccccuguacgugcccacgcuggacgacuaccggagcgccgaggugcucucccgcauggccuucgcgccccacggcgaggaccacgacaucgagaagaacgccgucagcaccaugcggaucgccgggaaggugaccggccgcgccccguccaccgaggccagcgacacggugcaggggaucgccuucuccggcagcccccuguacaccuccaccgggguccugaccgcgaaggacgaccccguguacaucugggcccccggcaucaucauggagggcaaccacagcuccugcgacaagaagacgcucccgcugaccuggaccggguucaucagccugcccggcgagaucgagaagaccacgcagugcaccgucuucugcacccucgccgggccccgggccgacugcgaggccuacuccgagaccggcaucuucaacaucagcuccccgaccugccugaucaaccgcgugcagcgguuccgcggggcggagcagcagaucaaguucgugugccagcgggucgacauggacaucaucguguacugcaacggcaucaagaaggugauccugacgaagacccucgucaucggccagugcaucuacaccuucaccagcaucuucucccugauccccgggguggcccacagccuggccguggagcucugcguccccggccugcacggguggacgaccaugcugcuccugcugaccuucugcuucggcugggugcugauccccuucaucaccaugauccuccugaagauccugaucgccuucgccuaccucugcuccaaguacaacacggacagcaaguuccgcauccugguggagaaggucaagaaggaguaccagaagaccaugggguccauggugugcgaggugugccaguacgagugcgagaccgcgaaggagcuggagagccaccgcaagagcugcuccaucggcagcugccccuacugccucaacccguccgaggccaccacgagcgcccugcaggcccacuucaaggucugcaagcugaccucccgguuccaggagaaccuccgcaagagccugaccguguacgagcccaugcagggcugcuaccggacccugucccucuuccgguaccgcagcaaguucuucguggggcuggucuggugccugcuccuggugauggagcugaucgugugggccgcguccgccgagacgcagaaccucaacagcggcuggaccgacaccgcccacggguccggcaucauccccaugaagaccgaccuggagcuggacuucagccuccccuccagcgccuccuacacguaccgccggcagcugcagaacccggcgaacgagcaggagaagauccccuuccaccuccagaucagcaagcaggucauccacgccgagauccagcaccugggccacuggauggacgccaccuucaaccugaagaccgccuuccacugcuacggguccugcgagaaguacgccuaccccuggcagaccgcgggcugcuucaucgagaaggacuacgaguacgagacgggguggggcugcaacccgcccgacugccccggggugggcaccggcugcaccgccugcgggguguaccuggacaagcucaagagcgucggcaagguguucaagaucgugagccugaaguacacccgcaaggucugcauccagcuggggacggagcagaccugcaagaccguggacuccaacgacugccucaucaccacgagcgugaaggucugcaugaucggcaccaucuccaaguuccagcccagcgacacccugcuguuccucgggccgcugcagcagggcggccugaucuucaagcaguggugcaccacgaccugccaguucggggaccccggcgacaucauguccacccccaccgggaugaagugccccgagcucaacggcagcuuccggaagaagugcgccuucgccaccacgccggugugccaguucgacgggaacaccaucuccggcuacaagcgcaugaucgccaccaaggacagcuuccaguccuucaacgugaccgagccccacaucagcgcguccgcccuggaguggaucgaccccgacagcucccugcgggaccacaucaacgucguggugggccgcgaccucagcuuccaggaccuguccgagacgcccugccaggucgaccugaugaccagcaccaucgacggggccuggggcuccggggugggcuucaaccucgugugcaccgucagccugacggagugcuccgccuuccugaccagcaucaaggccugcgacagcgcgaugugcuacggguccaccaccgugaaccucgugcggggccagaacacgguccacaucgugggcaagggcgggcacagcggguccaaguucaugugcugccacgacaccaagugcagcuccaccggccugguggccgccgccccgccccuggaccgcgucaccggcuacaaccaggcggacagcgacaagaucuucgacgacggggcccccgagugcggcauguccugcugguucaagaaguccggggaguggauccucggcgugcugaacgggaacuggaugguggucgccgugcugaucgcccuccugauccugagcauccucauguucacgcugugcugcccccggcgcccgagcuaccggaaggagcacaagcccuga

SEQ ID NO: 11789 - RNA, 3447 nt, Artificial Sequence
  derived and/or modified CDS sequence (opt1) from PUUV(CRF161)__AF367061.1__GP
augggcaagcugagccccgugugccucuaccugcugcuccagugccugcugcucggggaccgcggcgacgcccggaaccugaacgagcugaagauggagugcccgcacaccaucgggcucggccaggggcuggucgugggcuccguggagcugccgcccguccccauccagcaggucgagagccucaagcuggaguccagcugcaacuucgaccugcacaccuccacggccggccagcagagcuucaccaaguggaccugggagaucaagaacgaccucguggagaacacccaggcguccagcacguccuuccagaccaagagcuccgaggugaaccugcgcgggcugugccucauccccacccuggugguggagaccgccgcccggacgcgcaagaccaucgccugcuacgaccugaccugcaaccagaccgucugccagcccacgguguaccucaugggccccauccagaccugcaucaccaccaagagcugccugcuggggcucggcgaccagcggauccaggugaacuacgagaagacguacugcgucuccgggcagcugguggagggcgugugcuucaaccccauccacaccauggcccugagccagccgucccacaccuacgacgucaugacccucauggugcgcugcuuccugaucaucaagaaggugacgagcggcgacuccaugaagaucgagaagaacuucgagacccugguccagaagaccgggugcaccggcaacaacuuccagggguacuacaucugccucaucggcagcuccagcgagccccuguacgugcccacgcuggacgacuaccggagcgcggaggugcucucccgcauggccuucgcgccccacggcgaggaccacgacaucgagaagaacgccgucagcaccaugcggaucgccgggaagguggccggccgcgccccguccaccgaggccagcgacaccgugcaggggaucgccuucuccggcagcccccuguacacguccaccgggguccugaccgcgaaggacgaccccguguacaucugggcccccggcaucaucauggagggcaaccacagcuccugcgacaagaagacccucccgcugacguggaccggguucaucagccugcccggcgagauccagaagaccacccagugcacggucuucugcacccucgccgggccccgggccgacugccaggccuacuccgagaccggcaucuucaacaucagcuccccgaccugccugaucaaccgcgugcagcgguuccgcggggcggagcagcagaucaaguucgugugccagcgggucgacauggacaucaucguguacugcaacggcaucaagaaggugauccugaccaagacgcucgucaucggccagugcaucuacaccuucaccagcaucuucucccugauccccgggguggcccacagccuggccguggagcucugcguccccggccugcacggguggaccacgaugcugcuccugcugaccuucugcuucggcugggugcugauccccuucaucaccaugauccuccugaagauccugaucgccuucgccuaccucugcuccaaguacaacaccgacagcaaguuccgcauccugguggagaaggucaagaaggaguaccagaagacgaugggguccauggugugcgaggugugccaguacgagugcgagaccgcgaaggagcuggagagccaccgcaagagcugcuccaucggcagcugccccuacugccucaacccguccgaggccaccaccagcgcccugcaggcccacuucaaggucugcaagcugacgucccgguuccaggagaaccuccgcaagagccugaccguguacgagcccaugcagggcugcuaccggacccugucccucuuccgguaccgcagcaaguucuucguggggcuggucuggugccugcuccuggugauggagcugaucgugugggccgcguccgccgagacccagaaccucaacagcggcuggacggacaccgcccacggguccggcaucauccccaugaagaccgaccuggagcuggacuucagccuccccuccagcgccuccuacaccuaccgccggcagcugcagaacccggcgaacgagcaggagaagauccccuuccaccuccagaucagcaagcaggucauccacgccgagauccagcaccugggccacuggauggacgccacguucaaccugaagaccgccuuccacugcuacggguccugcgagaaguacgccuaccccuggcagaccgcgggcugcuucaucgagaaggacuacgaguacgagaccggguggggcugcaacccgcccgacugccccggggugggcacgggcugcaccgccugcgggguguaccuggacaagcucaagagcgucggcaagguguucaagaucgugagccugaaguacacccgcaaggucugcauccagcuggggaccgagcagacgugcaagaccguggacuccaacgacugccucaucaccaccagcgugaaggucugcaugaucggcacgaucuccaaguuccagcccagcgacacccugcugauccucgggccgcugcagcagggcggccugaucuucaagcaguggugcaccaccacgugccaguucggggaccccggcgacaucauguccacccccaccgggaugaagugccccgagcucaacggcagcuuccggaagaagugcgccuucgccaccaccccggugugccaguucgacgggaacacgaucuccggcuacaagcgcaugaucgccaccaaggacagcuuccaguccuucaacgugaccgagccccacaucagcgcguccgcccuggaguggaucgaccccgacagcucccugcgggaccacaucaacgucguggugggccgcgaccucagcuuccaggaccuguccgagacccccugccaggucgaccugaugacgagcaccaucgacggggccuggggcuccggggugggcuucaaccucgugugcaccgucagccugaccgagugcuccgccuuccugacgagcaucaaggccugcgacagcgcgaugugcuacggguccaccaccgccaaccucgugaagggccagaacaccgugcacauggucggcaagggcgggcacagcggguccaaguucaugugcugccacgacacgaagugcagcuccaccggccugguggccgccgcgccgcaccuggaccgggugaccggcuacaaccaggccgacagcgacaagaucuucgacgacggggcccccgagugcggcauguccugcugguucaagaaguccggggaguggauccucggcguccugaacgggaacuggauggugguggccguccugaucgcccuccugauccugagcauccucauguucacccugugcugcccccgccggcccagcuaccgcaaggagcacaagccguga

SEQ ID NO: 11790 - RNA, 3447 nt, Artificial Sequence
  derived and/or modified CDS sequence (opt1) from PUUV(CRF308/Omsk)__AF442617.1__GP
augggcaagcugagccccgugugccucuaccugcugcuccagugccugcugcucggggaccgcggcgacgcccggaaccugaacgagcugaagauggagugcccgcacaccaucgggcucggccaggggcuggucgugggcuccguggagcugccgcccguccccauccagcaggucgagagccucaagcuggaguccagcugcaacuucgaccugcacaccuccacggccggccagcagagcuucaccaaguggaccugggagaucaagaacgaccucgcggagaacacccaggccuccagcacguccuuccagaccaagagcuccgaggugaaccugcgcgggcugugccucauccccacccuggugguggagaccgccgcccggacgcgcaagaccaucgccugcuacgaccugaccugcaaccagaccgugugccagcccacggucuaccucaugggccccauccagaccugcaucaccaccaagagcugccugcuggggcucggcgaccagcggauccaggugaacuacgagaagacguacugcguguccgggcagcuggucgagggcgugugcuucaaccccauccacaccauggcgcugagccagccgucccacaccuacgacgugaugacccucaugguccgcugcuuccugaucaucaagaaggugacgagcggcgacuccaugaagaucgagaagaacuucgagacccuggugcagaagaccgggugcaccggcaacaacuuccagggguacuacaucugccucaucggcagcuccagcgagccccuguacguccccacgcuggacgacuaccggagcgccgaggugcucucccgcauggccuucgcgccccacggcgaggaccacgacaucgagaagaacgccgugagcaccaugcggaucgccgggaaggucgccggccgcgccccguccaccgaggccagcgacaccgugcaggggaucgcguucuccggcagcccccuguacacguccaccggggugcugaccgccaaggacgaccccgucuacaucugggcccccggcaucaucauggagggcaaccacagcuccugcgacaagaagacccucccgcugacguggaccggguucaucagccugcccggcgagaucgagaagaccacccagugcacgguguucugcacccucgccgggcccggcgccgacugcgaggcguacuccgagaccgggaucuucaacaucagcuccccgaccugccugaucaaccggguccagcgcuuccggggcgccgagcagcagaucaaguucgugugccagcgcguggacauggacaucaucgucuacugcaacggcaucaagaaggugauccugaccaagacgcucgugaucgggcagugcaucuacaccuucaccagcaucuucucccugauccccggcaucgcccacagccuggccgucgagcucugcgugcccgggcugcacggcuggaccacgaugcugcuccugcugaccuucugcuucgggugggugcugauccccuucaucaccaugauccuccugaagauccugaucgccuucgcguaccucugcuccaaguacaacaccgacagcaaguuccggauccuggucgagaaggugaagaaggaguaccagaagacgaugggcuccauggugugcgaggucugccaguacgagugcgagaccgccaaggagcuggagagccaccgcaagagcugcuccaucggcagcugccccuacugccucaacccguccgaggccaccaccagcgcccugcaggcccacuucaaggugugcaagcugacgucccgguuccaggagaaccuccgcaagagccugaccguguacgagcccaugcaggggugcuaccggacccugucccucuuccgcuaccggagcaaguucuucgucggccugguguggugccugcuccuggugauggagcugaucgucugggcggccuccgccgagacccagaaccucaacagcggguggacggacaccgcccacggcuccggcaucauccccaugaagaccgaccuggagcuggacuucagccuccccuccagcgcguccuacaccuaccgccgccagcugcagaacccggccaacgagcaggagaagauccccuuccaccuccagaucagcaagcaggucauccacgccgagauccagcaccuggggcacuggauggacgccacguucaaccugaagaccgccuuccacugcuacggcuccugcgagaaguacgcguaccccuggcagaccgccgggugcuucaucgagaaggacuacgaguacgagaccggcugggggugcaacccgcccgacugccccggcgugggcacggggugcaccgccugcggcguguaccuggacaagcucaagagcguggggaagguguucaagaucgucagccugaaguacacccggaaggugugcauccagcugggcaccgagcagacgugcaagaccguggacuccaacgacugccucaucaccaccagcgucaaggugugcaugaucgggacgaucuccaaguuccagcccagcgacacccugcuguuccucggcccgcugcagcagggcgggcugaucuucaagcaguggugcaccaccacgugccaguucggcgaccccggggacaucauguccacccccaccggcaugaagugccccgagcucaacgggagcuuccgcaagaagugcgccuucgccaccaccccggugugccaguucgacggcaacacgaucuccggcuacaagcggaugaucgcgaccaaggacagcuuccaguccuucaacgucaccgagccccacaucagcgccuccgcccuggaguggaucgaccccgacagcucccugcgcgaccacaucaacgugguggucgggcgggaccucagcuuccaggaccuguccgagacccccugccagguggaccugaugacgagcaccaucgacggcgccuggggguccggcgugggguucaaccucgucugcaccgugagccugaccgagugcuccgccuuccugacgagcaucaaggcgugcgacagcgccaugugcuacggcuccaccaccgccaaccucgugcgcggccagaacaccguccacaucguggggaagggcgggcacagcggcuccaaguucaugugcugccacgacacgaagugcagcuccaccggccugguggccgcggccccgcaccuggaccgggucaccggguacaaccaggccgacagcgacaagaucuucgacgacggcgcccccgagugcgggauguccugcugguucaagaaguccggcgaguggauccucggggugcugaacggcaacuggaugguggucgccgugcugaucgcgcuccugauccugagcauccucauguucacccugugcugcccccgccggcccagcuaccgcaaggagcacaagccguga

SEQ ID NO: 11791 - RNA, 3447 nt, Artificial Sequence
  derived and/or modified CDS sequence (opt1) from PUUV(Mu/07/1219)__KJ994777.1__GP
auggagaagaucauccccgugugccuguaccucccguuccugugccugcuccuguggagccgcggcgacacccggaaccugaacgagcucaagauggagugcccccacaccaucgggcugggccaggggcuggucaucggcuccaucgagcucccgcccgugccccugauccagguggagagccugaagcucgaguccagcugcaacuucgaccugcacacguccaccagcucccagcaggccuucaccaaguggaccugggaggucaagagcgaccuggccgagaacacgcaggcguccagcaccuccuuccagaccaagagcuccgaggugaaccuccgcgggcugugccuggugccgccccucgucaucgagaccgccgcccggacgcgcaagaccaucgccugcuucgaccugagcugcaaccagacgaccugccagcccaccguguuccugaugggccccauccagaccugcaucaccaccaaguccugccuccugggccugggggaccagcggauccaggugaacuacgagaagacguacugcgucagcggccagcucaucgaggggaucugcuucaaccccgugcacaccauggcccugucccagcccagccacaccuacgacaucgugaccgucauggugcgcugcuuccugaucgugaagaaggucacgaccggcgacuccaugaagaucgagaaguccuucgagacccucgugcagaagaccgggugcacggacaacggcuuccagggcuacuacgugugccugaucgggagcagcagcgagccccuguacaucccgacccucgacgacuaccgguccgcggagguccugagccgcauggccuucgcgccccacggcgaggaccacgacaucgagaagaacgccaucuccgccaugcggaucguggggaaggugaccggcaaggcccccagcaccgaguccagcgacacgguccagggcaucgccuucuccgggaacccccuguacaccagcaccggcgugcucaccgccaaggacgacccgguguacgucugggcccccgggaucaugauggagggcaaccacuccgugugcgagaagaagacgcugccccugaccuggaccggguucaucccccucccgggcgagaucgagaagaccacgcagugcaccgucuucugcacccuggcgggccccggggccgacugcgaggccuacagcgagaccggcaucuucaacaucuccagcccgaccugccugaucaaccgcgugcagcgguuccgcggggccgagcagcagaucaaguucaucugccagcggguggacauggacaucacggucuacugcaacggccucaagaaggugauccugaccaagacccuggugaucgggcagugcaucuacaccuucacguccaucuucagccucauccccggcgucgcccacucccuggcgguggagcugugcgugcccggccuccacgggugggccaccaugcugcugcuccugaccuucugcuucggcuggauccugauccccuucuucgccaugauccugcucaagguccugaucgcccuggccuaccucugcagcaaguacaacaccgacuccaaguucaaggugcugaucgagaaggugaagaaggaguaccagaagacgauggggagcauggucugcgaggugugccaguacgagugcgagaccgcgaaggagcuggagagccaccgcaaguccugccccaugggcagcugccccuacugccucaacccggccgaggccaccaccuccgcccugcaggcccacuucaaggugugcaagcugacgagccgguuccaggacaaccuccgcaagucccugggggcguacgagcccaagcagggcugcuaccggacccugagccucuuccgcuaccggucccgcuucuucgucggcuucaucuggugccugcugcucgugcuggagcugaucgugugggccgccagcgccgagacccagaaccucaacuccggguggaccgacacggcgcacggcagcggggucauccccaugcggaccgaccuggagcuggacuucucccucccgagcuccgccagcuacaccuaccgccgccagcugcagaaccccgccaacgagcaggagaagauccccuuccaccuccagaucuccaagcaggucauccacgccgagauccagcaccucggccacuggauggacggcaccuucaaccugaagacggccuuccacugcuacgggagcugcgagaaguacgcguaccccuggcagaccgccggcugcuucguggagaaggacuacgaguacgaguccggguggggcugcaacccggccgacugccccggggugggcaccggcugcaccgccugcgggguguaccuggacaagcucaagagcgugggcaaggccuucaagaucgucagccugcgguacacgcgcaaggcgugcauccagcuggggaccgagcagaccugcaagaacguggacuccaacgacugccucgugaccacgagcgucaaggugugccugaucggcaccguguccaaguuccagcccagcgacacccugcuguuccuggggccccuggagcagggcggccucaucuucaagcaguggugcaccacgaccugccaguucggggacccgggcgacaucauguccacccccgucgggaugaagugccccgagcugagcggcuccuuccggaagaagugcgccuucgccaccacgcccgugugccaguucgacgggaacaccaucagcggcuacaagcgcaugaucgccaccaaggacuccuuccagagcuucaacgugaccgagccgcacaucuccgccagcucccuggaguggaucgaccccgacagcucccuccgggaccacaucaacgucaucgugggccgcgaccugagcuuccaggaccuguccgagacccccugccagguggaccucacgaccaccagcaucgacggggcguggggcuccggggucggcuucaaccugaucugcagcgugagccugaccgagugcuccacguuccucaccagcaucaaggccugcgacuccgccaugugcuacgggagcaccaccgccaaccuggugcggggccagaacacgguccacaucgugggcaagggcgggcacuccgggagcaaguucaugugcugccacgacaccaagugcuccagcaccggccugguggcggccgcgccccaccucgaccgcgucaccggcuacaaccaggccgacuccgacaagaucuucgacgacggggccccggagugcggcaucagcugcugguucacgaaguccggggaguggauccugggcgugcugaacgggaacuggaugguggucgccgugcucguggcccuguucauccugagcaucuuccucuucacccugugcugcccccggcgccccuccuacgccaaggagcacaagcccuga

SEQ ID NO: 11792 - RNA, 3447 nt, Artificial Sequence
  derived and/or modified CDS sequence (opt1) from PUUV(Puu/Kazan)__Z84205.1__GP
augggcaagcugagccccgugugccucuaccugcugcuccaggggcugcugcuguucaacaccggcaccgcccgcaaccugaacgagcugaagauggagugcccgcacacgaucgggcucggccaggggcuggucgugggcuccguggagcugccgcccguccccauccagcaggucgagacccucaagcuggagagcuccugcaacuucgaccugcacaccagcaccgccggccagcaggcguucacgaaguggaccugggagaucaagggggaccucgccgagaacacccaggccuccagcaccuccuuccagacgaaguccuccgaggugaaccugcggggccugugccucauccccacccuggugaucgagaccgccgcccgcaugcggaagaccaucgcgugcuacgaccugagcugcaaccagacggugugccagcccaccguguaccucauggggcccauccagaccugcaucaccacgaaguccugccugcugggccucggggaccagcgcauccaggucaacuacgagaagaccuacugcgugagcggccagcugguggagggcgucugcuucaaccccauccacaccauggcccugucccagccgagccacaccuacgacaucgugacgaugauggugcggugcuuccucgucaucaagaaggugaccuccggggacagcaugaagaucgagaagaacuucgagacccuggugcagaagaacggcugcaccgccaacuccuuccagggguacuacaucugccugaucggcagcuccagcgagccccucuacguccccacgcuggacgacuaccgcagcgccgaggugcugucccggauggcguucgcgccccacggcgaggaccacgacguggagaagaacgccaucagcgcccuccgcaucgccgggaaggucaccggcaaggccccguccaccgagagcuccgacaccgugcaggggguggccuucagcggcagcccccuguacacgagcaccgggguccugaccgccaaggacgaccccguguacaucugggcccccggcaucaucauggagggcaaccacuccgucugcgagaagaagacccucccgcugacguggaccggguucaucagccugcccggcgagaucgagaagaccacccagugcacgguguucugcacccucgccgggcccggcgcggacugcgaggccuacuccgagaccgggaucuucaacaucagcuccccgaccugccugaucaaccgggugcagcgcuuccggggcgccgagcagcagaucaaguucgucugccagcgcguggacauggacaucaccguguacugcaacggcgucaagaaggugauccugacgaagacccucgugaucgggcagugcaucuacaccuucaccagcaucuucucccugauccccggcgucgcccacagccuggccguggagcucugcgugcccgggcugcacggcugggcgacgaugcugcuccugcugaccuucugcuucggguggguccugauccccaccaucaccaugauccuccugaagauccugaucgccuucgccuaccucugcuccaaguacaacacggacagcaaguuccggauccugaucgagaaggugaagaaggaguaccagaagaccaugggcuccauggugugcgaggucugccaguacgagugcgagaccgccaaggagcuggagagccaccgcaagagcugcuccaucggcagcugccccuacugccucaacccguccgaggccaccacgagcgcgcugcaggcccacuucaaggugugcaagcugaccucccggauccaggagaaccuccgcaagagccugaccguguacgagcccaugcaggggugcuaccggacccugucccucuuccgcuaccggagccgcuucuucgucggccugguguggugcgugcugcucguccuggagcugaucgugugggccgccuccgcggagacgcagaaccucaacgccggguggaccgacaccgcccacggcagcggcaucauccccaugaagaccgaccuggagcuggacuucucccuccccagcuccgccagcuacacguaccggcgccagcugcagaacccggccaacgagcaggagaacauccccuuccaccuccagaucuccaagcaggucauccacgcggagauccagcaccucgggcacuggauggacgccaccuucaaccugaagaccgccuuccacugcuacggcagcugcgagaaguacgccuaccccuggcagaccgccgggugcuucguggagaaggacuacgaguacgagacgggcugggggugcaacccgcccgacugccccggcgugggcaccgggugcaccgcgugcggcgccuaccuggacaagcucaaguccguggggaaggucuucaagaucgugagccugcgcuacacccggaaggugugcauccagcugggcacggagcagaccugcaagaccgucgacagcaacgacugccucaucaccacguccgugaaggugugccugaucgggaccaucagcaaguuccagcccuccgacacccuccuguuccugggcccgcugcagcagggcgggcucaucuucaagcaguggugcaccacgaccugccaguucggcgaccccggggacaucaugagcacccccaccggcaugaagugccccgaccugaacggguccuuccgcaagaagugcgccuucgccaccacgccggucugccaguucgacggcaacaccaucagcggcuacaagcggaugaucgccaccaaggacuccuuccagagcuucaacgugaccgagccccacaucuccgcgagcgcccuggaguggaucgaccccgacuccagccuccgcgaccacaucaacgugaucgucucccgggaccugagcuuccaggaccuguccgagacgcccugccagaucgaccucagcaccgccuccaucgacggggccuggggcagcggggugggcuucaaccuggugugcaccgucucccugaccgagugcagcgcguuccucacgagcaucaaggccugcgacgccgccaugugcuacggguccaccaccgccaaccuggugcgcggccagaacaccauccacaucgugggcaagggcgggcacagcggguccaaguucaugugcugccacgacacgaagugcagcaccaccggccuggucgcggccgccccgcaccucgaccgggugaccggcuacaaccaggccgacuccgacaagaucuucgacgacggggcccccgagugcggcaugagcugcugguucaagaaguccggggaguggauccugggcgugcugaacgggaacuggauggucguggcggugcucaucgcccugcugauccucagcauccugcuguucacgcucugcugcccccgccggcccuccuaccgcaaggagcacaagccguga

SEQ ID NO: 11793 - RNA, 3447 nt, Artificial Sequence
  derived and/or modified CDS sequence (opt1) from PUUV(PUUV/Ardennes/Mg156/2011)__KT247603.1__GP
augggcaagaucauccccgugugccuguaccuccuguuccugugccuccugcugugggaccgcggggacacccggaaccucaacgagcugaagauggagugcccgcacaccaucggccuggggcagggccucgucaucgggagcguggagcugccgcccgugccccugacgcaggucgagucccucaagcuggagagcuccugcaacuucgaccugcacaccagcaccuccagccagcaguccuucaccaaguggacgugggagaugaagguggaccucgccgagaacacccaggccagcuccaccagcuuccagaccaaguccagcgagaucaaccugcgcggccugugccucgugccgccccuggucaucgagacggcggcccggacccgcaagaccaucgccugcuucgaccuguccugcaaccagaccgccugccagcccacgguguuccucaucggccccauccagaccugcaucaccaccaagagcugccugcuggggcucggcgaccagcggauccaggugaacuacgagaagacguacugcgucuccgggcagcugguggagggcaucugcuucaaccccgugcacaccauggcccugagccagcccucccacaccuacgacaucgucaccgugauggugcgcugcuuccucaucgucaagaaggugagcacgggggacuccaugaagcuggagaaguccuucgagacccuggugcagaagaccggcugcaccggcaacggguuccagggcuacuacgucugccucaucgggagcagcagcgagccccuguacauccccacgcuggacgacuaccgguccgcggaggugcucagccgcauggccuucgccccgcacggcgaggaccacgacaucgagaagaacgccaucuccgcgaugcggaucgugggcaaggucaccgggaaggcccccagcaccgaguccagcgacaccgugcagggcaucgccuucuccgggaacccccuguacacgagcaccggcgugcugaccgccaaggacgaccccaucuacaucugggccccggggaucaucauggagggcaaccacuccgucugcgacaagaagacccucccccugacguggaccggcuucaucccccugcccggggagaucgagaagaccacccagugcacgguguucugcacccucgcgggcccgggggccgacugcgaggccuacagcgagaccggcaucuucaacaucuccagcccgaccugccugaucaaccgcguccagcgguuccgcggggccgagcagcagaucaaguucaucugccagcggguggacauggacaucaccguguacugcaacggccugaagaaggucauccucacgaagacccuggugaucggccagugcaucuacaccuucaccuccaucuucagccugauccccgggguggcccacucccucgcggucgagcugugcgugcccggccugcacgggugggccacgaugcuccugcugcugaccuucugcuucggcuggauccucauccccuucuucagcaugauccugcugaagauccucaucgccuucgccuaccugugcuccaaguacaacaccgacagcaaguucaagauccugaucgagaaggugaagaaggaguaccagaagaccauggggagcauggucugcgaggugugccaguacgagugcgagacggccaaggagcucgagucccaccgcaagagcugccccaugggcuccugccccuacugccugaaccccgcggaggccaccaccagcgcccugcaggcccacuucaaggugugcaagcucaccucccgguuccaggacaaccugcgcaagagccugggcgccuacgagccgaagcaggggugcuaccggacgcucucccuguuccgcuaccggagccgcuucuucgucggcuucaucuggugcuuccugcucgugcuggagcugaucgugugggcggccuccgccgagacccagaaccucaacagcggguggaccgacaccgcccacggcuccggcaucauccccaugcggacggaccuggagcuggacuucagccuccccuccagcgcguccuacaccuaccgccgccagcugcagaacccggccaacgagcaggagaagauccccuuccaccuccagaucagcaagcaggucauccacgccgagauccagcaccuggggcacuggauggacggcaccuucaaccugaagaccgccuuccacugcuacggguccugcgagaaguacgccuaccccuggcagacggcgggcugcuucguggagaaggacuacgaguacgagagcggguggggcugcaacccgcccgacugccccggcguggggaccggcugcaccgccugcggggucuaccuggacaagcucaagagcgugggcaaggccuucaagaucgugucccugcgguacacccgcaaggccugcauccagcuggggacggagcagaccugcaagagcgucgacuccaacgacugccucgugaccaccagcgugaaggucugccugaucggcacgguguccaaguuccagcccagcgacacccuccuguuccugggcccccuggagcagggcgggcucaucuucaagcaguggugcaccaccacgugccaguucggggacccgggcgacaucauguccacccccguggggaugaagugccccgagcugagcggcuccuuccggaagaagugcgccuucgcgaccacccccgucugccaguucgacggcaacacgcugagcggguacaagcgcaugaucgccaccaaggacuccuuccagagcuucaacgugaccgagccgcacaucuccgccagcucccucgaguggaucgaccccgacagcucccugcgggaccacaucaacgugaucgucggccgcgaccugagcuuccaggaccucuccgagacccccugccagguggaccuggccaccagcagcaucgacggggccuggggcuccggggugggcuucaaccuggucugcagcgugucccucacggagugcagcaccuuccugaccuccaucaaggcgugcgacagcgccaugugcuacggcuccaccacggccaaccugcuccgggggcagaacaccgugcacaucgucggcaagggcgggcacagcggcuccaaguucaugugcugccacgacaccaagugcagcuccaccgggcugguggccgcggcgccccaccuggaccgcgugacgggcuacaaccaggccgacagcgacaagaucuucgacgacggggccccggagugcggcaucuccugcugguucaccaagagcggggaguggauccucggcguccugaacggcaacuggauggugguggccguccugguggcccucuucauccuguccaucuuccuguucacccucugcugcccccggcgccccagcuacgccaaggagcacaagcccuga

SEQ ID NO: 11794 - RNA, 3447 nt, Artificial Sequence
  derived and/or modified CDS sequence (opt1) from PUUV(PUUV/Ardennes/Mg75/2011)__KT247602.1__GP
augggcaagaucauccccgugugccuguaccuccuguuccugugccuccugcugugggaccgcggggacacccggaaccucaacgagcugaagauggagugcccgcacaccaucggccuggggcagggccucgucaucgggagcguggagcugccgcccgugccccugacgcaggucgagucccucaagcuggagagcuccugcaacuucgaccugcacaccagcaccuccagccagcaguccuucaccaaguggacgugggagaugaagguggaccucgccgagaacacccaggccagcuccaccagcuuccagaccaaguccagcgagaucaaccugcgcggccugugccucgugccgccccuggucaucgagacggcggcccggacccgcaagaccaucgccugcuucgaccuguccugcaaccagaccgccugccagcccacgguguuccucaucggccccauccagaccugcaucaccaccaagagcugccugcuggggcucggcgaccagcggauccaggugaacuacgagaagacguacugcgucuccgggcagcugguggagggcaucugcuucaaccccgugcacaccauggcccugagccagcccucccacaccuacgacaucgucaccgugauggugcgcugcuuccucaucgucaagaaggugagcacgggggacuccaugaagcuggagaaguccuucgagacccuggugcagaagaccggcugcaccggcaacggguuccagggcuacuacgucugccucaucgggagcagcagcgagccccuguacauccccacgcuggacgacuaccgguccgcggaggugcucagccgcauggccuucgccccgcacggcgaggaccacgacaucgagaagaacgccaucuccgcgaugcggaucgugggcaaggucaccgggaaggcccccagcaccgaguccagcgacaccgugcagggcaucgccuucuccgggaacccccuguacacgagcaccggcgugcugaccgccaaggacgaccccaucuacaucugggccccggggaucaucauggagggcaaccacuccgucugcgacaagaagacccucccccugacguggaccggcuucaucccccugcccggggagaucgagaagaccacccagugcacgguguucugcacccucgcgggcccgggggccgacugcgaggccuacagcgagaccggcaucuucaacaucuccagcccgaccugccugaucaaccgcguccagcgguuccgcggggccgagcagcagaucaaguucaucugccagcggguggacauggacaucaccguguacugcaacggccugaagaaggucauccucacgaagacccuggugaucggccagugcaucuacaccuucaccuccaucuucagccugauccccgggguggcccacucccucgcggucgagcugugcgugcccggccugcacgggugggccacgaugcuccugcugcugaccuucugcuucggcuggauccucauccccuucuucagcaugauccugcugaagauccucaucgccuucgccuaccugugcuccaaguacaacaccgacagcaaguucaagauccugaucgagaaggugaagaaggaguaccagaagaccauggggagcauggucugcgaggugugccaguacgagugcgagacggccaaggagcucgagucccaccgcaagagcugccccaugggcuccugccccuacugccugaaccccgcggaggccaccaccagcgcccugcaggcccacuucaaggugugcaagcucaccucccgguuccaggacaaccugcgcaagagccugggcgccuacgagccgaagcaggggugcuaccggacgcucucccuguuccgcuaccggagccgcuucuucgucggcuucaucuggugcuuccugcucgugcuggagcugaucgugugggcggccuccgccgagacccagaaccucaacagcggguggaccgacaccgcccacggcuccggcaucauccccaugcggacggaccuggagcuggacuucagccuccccuccagcgcguccuacaccuaccgccgccagcugcagaacccggccaacgagcaggagaagauccccuuccaccuccagaucagcaagcaggucauccacgccgagauccagcaccuggggcacuggauggacggcaccuucaaccugaagaccgccuuccacugcuacggguccugcgagaaguacgccuaccccuggcagacggcgggcugcuucguggagaaggacuacgaguacgagagcggguggggcugcaacccgcccgacugccccggcguggggaccggcugcaccgccugcggggucuaccuggacaagcucaagagcgugggcaaggccuucaagaucgugucccugcgguacacccgcaaggccugcauccagcuggggacggagcagaccugcaagagcgucgacuccaacgacugccucgugaccaccagcgugaaggucugccugaucggcacgguguccaaguuccagcccagcgacacccuccuguuccugggcccccuggagcagggcgggcucaucuucaagcaguggugcaccaccacgugccacuucggggacccgggcgacaucauguccacccccgugagcaugaagugccccgagcuguccgggagcuuccggaagaagugcgccuucgcgaccacccccgucugccaguucgacggcaacacgcuguccggcuacaagcgcaugaucgccaccaaggacagcuuccaguccuucaacgugaccgagccgcacaucagcgccuccagccucgaguggaucgaccccgacuccagccugcgggaccacaucaacgugaucgucgggcgcgaccuguccuuccaggaccucagcgagacccccugccagguggaccuggccaccagcuccaucgacggcgccugggggagcggcgugggguucaaccuggucugcuccgugagccucacggagugcuccaccuuccugaccagcaucaaggcgugcgacuccgccaugugcuacggcagcaccacggccaaccugcuccggggccagaacaccgugcacaucgucgggaagggcgggcacuccggcagcaaguucaugugcugccacgacaccaagugcuccagcaccggccugguggccgcggcgccccaccuggaccgcgugacgggguacaaccaggccgacuccgacaagaucuucgacgacggcgccccggagugcgggaucagcugcugguucaccaaguccggcgaguggauccucgggguccugaacggcaacuggauggugguggccguccugguggcccucuucauccugagcaucuuccuguucacccucugcugcccccggcgccccuccuacgccaaggagcacaagcccuga

SEQ ID NO: 11795 - RNA, 3447 nt, Artificial Sequence
  derived and/or modified CDS sequence (opt1) from PUUV(PUUV/Jura/Mg2/2010)__KT247598.1__GP
augggcaagaucauccccgugugccuguaccuccuguuccugugccuccugcuguggaaccgcggggacacccggaaccucaacgagcugaagauggagugcccgcacaccaucggccuggggcagggccucgucaucgggagcguggagcugccgcccgugccccugacgcaggucgagucccucaagcuggagagcuccugcaacuucgaccugcacaccagcaccuccagccagcaguccuucaccaaguggacgugggagaugaaguccgaccucgccgagaacacccaggccagcagcaccuccuuccagaccaagagcuccgagaucaaccugcgcggccugugccucgugccgccccuggugaucgagacggcggcccggacccgcaagaccaucgccugcuucgaccugagcugcaaccagaccgccugccagcccacggucuuccucaucggccccauccagaccugccugaccaccaaguccugccugcucgggcugggcgaccagcggauccaggugaacuacgagaagacguacugcgugagcgggcagcuggucgagggcgugugcuucaaccccauccacaccauggcccucucccagcccagccacaccuacgacaucgugaccgucauggugcgcugcuuccugaucgugaagaaggucuccacgggggacagcaugaagaucgagaaguccuucgagacccuggugcagaagaccggcugcaccggcaacggguuccagggcuacuacgugugccucaucgggagcagcuccgagccccuguacauccccacgcuggacgacuaccggagcgcggagguccucucccgcauggccuucgccccgcacggcgaggaccacgacaucgagaagaacgccaucagcgcgaugcggaucgugggcaaggugaccgggaaggcccccuccaccgagagcuccgacaccguccagggcaucgccuucagcgggaacccccuguacacguccaccggcgugcugaccgccaaggacgaccccaucuacaucugggccccggggaucaucauggagggcaaccacagcgugugcgagaagaagacccucccccugacguggaccggcuucaucccccugcccggggagaucgagaagaccacccagugcacggucuucugcacccucgcgggcccgggggccgacugcgaggccuacuccgagaccggcaucuucaacaucagcuccccgaccugccugaucaaccgcgugcagcgguuccgcggggccgagcagcagaucaaguucaucugccagcgggucgacauggacaucaccguguacugcaacggccugaagaaggugauccucacgaagacccuggucaucggccagugcaucuacaccuucaccagcaucuucucccugauccccgggguggcccacagccucgcgguggagcugugcguccccggccugcacgggugggccacgaugcuccugcugcugaccuucugcuucggcuggauccucauccccuucaccgccaugcugcugcucaagauccugaucgccuucgccuaccugugcuccaaguacaacaccgacagcaaguucaagauccucaucgagaaggugaagaaggaguaccagaagacgauggggagcauggugugcgaggucugccaguacgagugcgagaccgcgaaggagcuggagucccaccgcaagagcugccccaugggcuccugccccuacugccugaaccccgccgaggccaccaccagcgcccuccaggcccacuucaaggugugcaagcugacgucccgguuccaggacaaccugcgcaagagccucggcgcguacgagccgaagcaggggugcuaccggacccugucccuguuccgcuaccggagccgcuucuucgugggccucgucuggugcuuccugcuggugcucgagcugaucaucugggccgccuccgccgagacccagaaccugaacagcggguggaccgacacggcgcacggcuccggcgugauccccaugcggaccgaccucgagcuggacuucagccugcccuccagcgccuccuacaccuaccgccgccagcuccagaacccggccaacgagcaggagaagauccccuuccaccuccagaucagcaagcaggucauccacgccgagauccagcaccuggggcacuggauggacggcaccuucaaccugaagacggccuuccacugcuacggguccugcgagaaguacgcguaccccuggcagaccgccggcugcuucguggagaaggacuacgaguacgagagcggguggggcugcaacccgcccgacugccccggcguggggaccggcugcaccgccugcggggucuaccuggacaagcucaagagcgugggcaaggccuuccggaucgugucccugaaguacacgcgcaaggccugcauccagcuggggaccgagcagaccugcaagagcgucgacuccaacgacugccuggugaccacgagcgugaaggucugccucaucggcaccguguccaaguuccagcccagcgacacccugcuguuccucggcccccuggagcagggcgggcugaucuucaagcaguggugcaccacgaccugccaguucggggacccgcgggacaucauguccacccccgugggcaugcgcugccccgagcucagcggguccuuccggaagaagugcgcguucgccaccacgcccgucugccaguucgacggcaacaccaucagcggcuacaagcgcaugaucgccaccaaggacuccuuccagagcuucaacgugaccgagccgcacaucuccgccagcucccuggaguggaucgaccccgacagcucccugcgggaccacaucaacgugaucgucgggcgcgaccucagcuuccaggaccuguccgagacccccugccagguggaccugacgaccaccagcaucgacggcgccugggggagcggcgugggguucaaccucaucugcuccgucagccugaccgagugcuccacguuccugaccagcaucaaggcgugcgacuccgccaugugcuacggcagcaccaccgccaaccucaugcggggccagaacacgauccacaucguggggaagggcgggcacuccggcagcaaguucaugugcugccacgacaccaagugcuccagcaccggccugguggccgcggcgccccaccuggaccgcgucaccggguacaaccaggccgacuccgacaagaucuucgacgacggcgccccggagugcgggaucagcugcugguucacgaaguccggcgaguggauccucggggugcugaacggcaacuggaugguggucgccgugcuggugguccucuucauccugagcaucuuccuguucacccucugcugcccccggcgccccuccuacgccaaggagcacaagcccuga

SEQ ID NO: 11796 - RNA, 3447 nt, Artificial Sequence
  derived and/or modified CDS sequence (opt1) from PUUV(PUUV/Jura/Mg214/2010)__KT247599.1__GP
augggcaagaucauccccgugugccuguaccuccuguuccugugccuccugcuguggaaccgcggggacacccggaaccucaacgagcugaagauggagugcccgcacaccaucggccuggggcagggccucgucaucgggagcguggagcugccgcccgugccccugacgcaggucgagucccucaagcuggagagcuccugcaacuucgaccugcacaccagcaccuccagccagcaguccuucaccaaguggacgugggagaugaaguccgaccucgccgagaacacccaggccagcagcaccuccuuccagaccaagagcuccgagaucaaccugcgcggccugugccucgugccgccccuggugaucgagacggcggcccggacccgcaagaccaucgccugcuucgaccugagcugcaaccagaccgccugccagcccacggucuuccucaucggccccauccagaccugccugaccaccaaguccugccugcucgggcugggcgaccagcggauccaggugaacuacgagaagacguacugcgugagcgggcagcuggucgagggcgugugcuucaaccccauccacaccauggcccucucccagcccagccacaccuacgacaucgugaccgucauggugcgcugcuuccugaucgugaagaaggucuccacgggggacagcaugaagaucgagaaguccuucgagacccuggugcagaagaccggcugcaccggcaacggguuccagggcuacuacgugugccucaucgggagcagcuccgagccccuguacauccccacgcuggacgacuaccggagcgcggagguccucucccgcauggcccuggccccgcacggcgaggaccacgacaucgagaagaacgccaucagcgcgaugcggaucgugggcaaggugaccgggaaggcccccuccaccgagagcuccgacaccguccagggcaucgccuucagcgggaacccccuguacacguccaccggcgugcucaccgccaaggacgaccccaucuacaucugggccccggggaucaucauggagggcaaccacagcgugugcgagaagaagacccugccccugacguggaccggcuucaucccccuccccggggagaucgagaagaccacccagugcacggucuucugcacccuggcgggcccgggggccgacugcgaggccuacuccgagaccggcaucuucaacaucagcuccccgaccugccugaucaaccgcgugcagcgguuccgcggggccgagcagcagaucaaguucaucugccagcgggucgacauggacaucaccguguacugcaacggccucaagaaggugauccugacgaagacccuggucaucggccagugcaucuacaccuucaccagcaucuucucccucauccccgggguggcccacagccuggcgguggagcugugcguccccggccuccacgggugggccacgaugcugcugcugcucaccuucugcuucggcuggauccugauccccuucaccgccaugcugcuccugaagauccugaucgccuucgccuaccucugcuccaaguacaacaccgacagcaaguucaagauccugaucgagaaggugaagaaggaguaccacaagagcaugggguccauggugugcgaggucugccaguacgagugcgagacggcgaaggagcuggagagccaccgcaaguccugccccaugggcagcugccccuacugccucaaccccgccgaggccaccaccuccgcccugcaggcccacuucaaggugugcaagcugaccagccgguuccaggacaaccuccgcaagucccugggcgcguacgagccgaagcaggggugcuaccggacgcugagccucuuccgcuaccggucccgcuucuucgugggccuggucuggugcuuccugcucgugcuggagcugaucaucugggccgccagcgccgagacccagaaccucaacuccggguggaccgacaccgcgcacggcagcggcgugauccccaugcggacggaccuggagcuggacuucucccuccccagcuccgccagcuacaccuaccgccgccagcugcagaacccggccaacgagcaggagaagauccccuuccaccuccagaucuccaagcaggucauccacgccgagauccagcaccuggggcacuggauggacggcaccuucaaccugaagaccgccuuccacugcuacgggagcugcgagaaguacgcguaccccuggcagacggccggcugcuucguggagaaggacuacgaguacgagagcggguggggcugcaacccgcccgacugccccggcguggggaccggcugcaccgccugcggggucuaccuggacaagcucaaguccgugggcaaggccuuccggaucgugagccugaaguacacccgcaaggccugcauccagcuggggacggagcagaccugcaaguccgucgacagcaacgacugccucgugaccaccuccgugaaggucugccugaucggcacggugagcaaguuccagcccuccgacacccuccuguuccugggcccccuggagcagggcgggcucaucuucaagcaguggugcaccaccacgugccaguucggggacccgggcgacaucaugagcacccccguggggaugcggugccccgagcuguccggcagcuuccgcaagaagugcgcguucgccaccacccccgucugccaguucgacggcaacacgaucuccggguacaagcggaugaucgccaccaaggacagcuuccaguccuucaacgugaccgagccgcacaucagcgccuccagccuggaguggaucgaccccgacuccagccuccgcgaccacaucaacgugaucgucggccgggaccuguccuuccaggaccugagcgagacccccugccagguggaccucaccacgaccagcaucgacggggccuggggcuccggggugggcuucaaccugaucugcagcgucucccugaccgagugcagcaccuuccucacguccaucaaggcgugcgacagcgccaugugcuacggcuccaccaccgccaaccugaugcgcgggcagaacaccauccacaucgugggcaagggcgggcacagcggcuccaaguucaugugcugccacgacacgaagugcagcuccaccgggcugguggccgcggcgccccaccucgaccgggucaccggcuacaaccaggccgacagcgacaagaucuucgacgacggggccccggagugcggcaucuccugcugguucaccaagagcggggaguggauccugggcgugcugaacggcaacuggaugguggucgccgugcucgugguccuguucauccuguccaucuuccucuucacgcugugcugcccccgccggcccagcuacgccaaggagcacaagcccuga

SEQ ID NO: 11797 - RNA, 3447 nt, Artificial Sequence
  derived and/or modified CDS sequence (opt1) from PUUV(PUUV/Orleans/Mg23/2010)__KT247600.1__GP
augggcaagaucauccccgugugccuguaccuccuguuccgcugccugcuccugugggaccgggggaacgcccgcaaccugaacgagcucaagauggagugcccgcacaccaucggccuggggcagggccuggucaucgggagcguggagcucccgcccgugccccugacccagaucgagucccugaagcucgagagcuccugcaacuucgaccugcacacgagcaccuccagccagcaguccuucaccaaguggaccugggagaucaagagcgaccuggccgagaacacgcaggcguccagcaccuccuuccagaccaagagcuccgaggucaaccuccggggccugugccuggugccgccccucgugaucgagaccgccgcccgcacgcggaagaccaucgccugcuucgaccugagcugcaaccagaccgccugccagcccaccgucuuccugaucggccccauccagacgugcaucaccaccaaguccugccuccuggggcugggcgaccagcgcauccaggugaacuacgagaagaccuacugcgugagcgggcagcucaucgagggcaucugcuucaaccccguccacacgauggcgcugucccagcccagccacaccuacgacguggugaccgucauggugcggugcuuccugaucgugaagaaggucuccaccggggacagcaugaagaucgagaaguccuucgagacgcucgugcagaagaccggcugcaccggcaacggguuccagggcuacuacgugugccugaucggguccagcuccgagccccuguacauccccacccucgacgacuaccgcagcgccgagguccugucccggauggccuucgccccgcacggcgaggaccacgacaucgagaagaacgcgaucagcgccaugcgcaucgugggcaaggugacggggaaggcccccuccaccgaggccagcgacaccguccagggcaucgccuucuccgggaacccccuguacaccagcacgggcgugcucaccgcgaaggacgaccccaucuacaucugggccccggggaucaucauggagggcaaccacuccgugugcgagaagaagacccugccccugaccuggacgggcuucaucccccuccccggggagaucgagaagaccacccagugcaccgucuucugcacgcuggccggcccgggggccgacugcgaggccuacagcgagaccggcaucuucaacaucagcagcccgaccugccugaucaaccgggugcagcgcuuccgcggggcggagcagcagaucaaguucaucugccagcgggucgacauggacaucaccguguacugcaacggccucaagaaggugauccugaccaagacguucaucaucggccagugcaucuacaccuucaccuccaucuucagccugauccccggggucgcccacucccucgccguggagcugugcgugcccggccugcacgggugggccaccaugcuccugcugcucacguucugcuucggcuggguccugauccccuucuucagcaugauccugcugaagauccucaucgccuucgcguaccugugcuccaaguacaacaccgacagcaaguuccggauccugaucgagaaggugaagcgcgaguaccagaagaccauggggagcauggugugcgaggucugccaguacgagugcgagaccgccaaggagcucgagucccaccgcaagagcugccccaugggcuccugccccuacugccugaaccccgccgaggccacgaccagcgcccugcaggcgcacuucaaggugugcaagcucaccucccgguuccaggacaaccugcgcaagagccugggcgccuacgagccgaagcaggggugcuaccggacccucucccuguuccgguaccgcagccgcuucuucgugggcuucaucuggugcuuccugcucguccuggagcugaucaucugggccgccuccgcggagacgcagaaccucaacagcggguggaccgacaccgcccacggcuccggcgugauccccaugcggaccgaccuggagcuggacuucagccuccccuccagcgccuccuacacguaccgccggcagcugcagaacccggccaacgagcaggagaagauccccuuccaccuccagaucagcaagcaggucauccacgccgagauccagcaccuggggcacuggauggacggcaccuucaaccugaagaccgcguuccacugcuacggguccugcgagaaguacgccuaccccuggcagaccgccggcugcuucaucgagaaggacuacgaguacgagagcggguggggcugcaacccgcccgacugccccggcguggggacgggcugcaccgccugcgggguguaccuggacaagcucaagagcgugggcaaggccuucaagaucgucucccugcgcuacacccggaaggcgugcauccagcuggggaccgagcagacgugcaagagcguggacuccaacgacugccucgugaccaccagcgucaaggugugccugaucggcaccguguccaaguuccagcccagcgacacgcuccuguuccugggcccccuggagcagggcgggcucaucuucaagcaguggugcaccacgaccugccacuucggggacccgggcgacaucauguccacccccgccgggaugaagugccccgagcugagcggcuccuucaccaagaagugcgccuucgcccccaccccggucugccaguucgacggcgacaccacgagcggguacaagaagaugaucgccaccaaggacuccuuccagagcuucaacgugaccgagccccacaucuccgcgagcucccuggaguggaucgaccccgaccgcagccuccgggaccacaucaacgugaucgucggccgcgaccuguccuuccaggaccugagcgagacccccugccagguggaccucaccacgaccuccaucgacggggccuggggcagcggggugggcuucaaccugaucugcagcgucucccugaccgagugcagcaccuuccucacguccaucaaggccugcgacagcgccaugugcuacggcuccaccaccgcgaaccugcugcgggggcagaacaccgugcacaucgugggcaagggcgggcacagcggcuccaaguucaugugcugccacgacacgaagugcagcuccaccgggcucgucgccgccgccccgcaccuggaccgcgugaccggcuacaaccaggccgacagcgacaagaucuucgacgacggggcgcccgagugcggcaucuccugcuggcugaccaagagcggggaguggauccucggcgugcugaacggcaacuggauggucguggccgugcuggucgcccucuucaucuucuccaucuuccuguucacgcugugcugcccccggcgccccagcuacgccaaggagcacaagccguga

SEQ ID NO: 11798 - RNA, 3447 nt, Artificial Sequence
  derived and/or modified CDS sequence (opt1) from PUUV(PUUV/Orleans/Mg29/2010)__KT247601.1__GP
augggcaagaucauccccgugugccuguaccuccuguuccgcugccugcuccugugggaccgggggaacgcccgcaaccugaacgagcucaagauggagugcccgcacaccaucggccuggggcagggccuggucaucgggagcguggagcucccgcccgugccccugacccagaucgagucccugaagcucgagagcuccugcaacuucgaccugcacacgagcaccuccagccagcaguccuucaccaaguggaccugggagaucaagagcgaccuggccgagaacacgcaggcguccagcaccuccuuccagaccaagagcuccgaggucaaccuccggggccugugccuggugccgccccucgugaucgagaccgccgcccgcacgcggaagaccaucgccugcuucgaccugagcugcaaccagaccgccugccagcccaccgucuuccugaucggccccauccagacgugcaucaccaccaaguccugccuccuggggcugggcgaccagcgcauccaggugaacuacgagaagaccuacugcgugagcgggcagcucgucgagggcgugugcuucaaccccauccacacgauggcgcugucccagcccagccacaccuacgacaucgugaccgucauggugcggugcuuccugaucgugaagaaggucuccaccggggacagcaugaagaucgagaaguccuucgagacgcucgugcagaagaccggcugcaccggcaacggguuccagggcuacuacgugugccugaucggguccagcuccgagccccuguacauccccacccucgacgacuaccgcagcgccgagguccugucccggauggccuucgccccgcacggcgaggaccacgacaucgagaagaacgcgaucagcgccaugcgcaucgugggcaaggugacggggaaggcccccuccaccgaggccagcgacaccguccagggcaucgccuucuccgggaacccccuguacaccagcacgggcgugcucaccgcgaaggacgaccccaucuacaucugggccccggggaucaucauggagggcaaccacuccgugugcgagaagaagacccugccccugaccuggacgggcuucaucccccuccccggggagaucgagaagaccacccagugcaccgucuucugcacgcuggccggcccgggggccgacugcgaggccuacagcgagaccggcaucuucaacaucagcagcccgaccugccugaucaaccgggugcagcgcuuccgcggggcggagcagcagaucaaguucaucugccagcgggucgacauggacaucaccguguacugcaacggccucaagaaggugauccugaccaagacguucaucaucggccagugcaucuacaccuucaccuccaucuucagccugauccccggggucgcccacucccucgccguggagcugugcgugcccggccugcacgggugggccaccaugcuccugcugcucacguucugcuucggcuggguccugauccccuucuucagcaugauccugcugaagauccucaucgccuucgcguaccugugcuccaaguacaacaccgacagcaaguuccggauccugaucgagaaggugaagcgcgaguaccagaagaccauggggagcauggugugcgaggucugccaguacgagugcgagaccgccaaggagcucgagucccaccgcaagagcugccccaugggcuccugccccuacugccugaaccccgccgaggccacgaccagcgcccugcaggcgcacuucaaggugugcaagcucaccucccgguuccaggacaaccugcgcaagagccugggcgccuacgagccgaagcaggggugcuaccggacccucucccuguuccgguaccgcagccgcuucuucgugggcuucaucuggugcuuccugcucguccuggagcugaucaucugggccgccuccgcggagacgcagaaccucaacagcggguggaccgacaccgcccacggcuccggcgugauccccaugcggaccgaccuggagcuggacuucagccuccccuccagcgccuccuacacguaccgccggcagcugcagaacccggccaacgagcaggagaagauccccuuccaccuccagaucagcaagcaggucauccacgccgagauccagcaccuggggcacuggauggacggcaccuucaaccugaagaccgcguuccacugcuacggguccugcgagaaguacgccuaccccuggcagaccgccggcugcuucaucgagaaggacuacgaguacgagagcggguggggcugcaacccgcccgacugccccggcguggggacgggcugcaccgccugcgggguguaccuggacaagcucaagagcgugggcaaggccuucaagaucgucucccugcgcuacacccggaaggcgugcauccagcuggggaccgagcagacgugcaagagcguggacuccaacgacugccucgugaccaccagcgucaaggugugccugaucggcaccguguccaaguuccagcccagcgacacgcuccuguuccugggcccccuggagcagggcgggcucaucuucaagcaguggugcaccacgaccugccacuucggggacccgggcgacaucauguccacccccgccgggaugaagugccccgagcugagcggcuccuuccgcaagaagugcgccuucgcccccaccccggucugccacuucgacggcaagaccaucagcggguacaagcggaugaucgccaccaaggacuccuuccagagcuucaacgugacggagccccacaucuccgcgagcucccuggaguggaucgaccccgacagcucccuccgcgaccacaucaacgugaucgucggccgggaccugagcuuccaggaccuguccgagacccccugccagguggaccucaccaccaccagcaucgacggggccuggggcagcggggugggcuucaaccugaucugcuccgucagccugacggagugcuccaccuuccucaccagcaucaaggccugcgacuccgccaugugcuacggcagcaccacggcgaaccugcugcgcgggcagaacaccgugcacaucgugggcaagggcgggcacuccggcagcaaguucaugugcugccacgacaccaagugcuccagcaccgggcucgucgccgccgccccgcaccuggaccgggugacgggcuacaaccaggccgacuccgacaagaucuucgacgacggggcgcccgagugcggcaucagcugcuggcugaccaaguccggggaguggauccucggcgugcugaacggcaacuggauggucguggccgugcuggucgcccucuucaucuucagcaucuuccuguucacccugugcugcccccgccggcccuccuacgccaaggagcacaagccguga

SEQ ID NO: 11799 - RNA, 3447 nt, Artificial Sequence
  derived and/or modified CDS sequence (opt1) from PUUV(Vranica)__U14136.1__GP
augggcaagcugagccccgugugccucuaccuguuccugcagugccuccugcuguggaaccgcggguccgcccggaaccucaacgagcugaagauggagugcccgcacaccaucggccuggggcagggccucgucaucgggagcguggagcugccgcccgugcccauccagcaggucgagucccugaagcucgagagcuccugcaacuucgaccugcacaccagcacggccacccagcaguccuucaccaaguggaccugggagaugaaggacgaccuggcggagaacacgcaggccagcuccaccagcuuccagaccaaguccagcgaggugaaccuccgcggccugugccugaucccgccccucguggucgagaccgccucccggacgcgcaagaccaucgccugcuucgacaucagcugcaaccagaccgugugccagcccaccguguaccuggucggccccauccagacgugcaucaccaccaaguccugccugcucgggcugggcgaccagcggauccaggugaacuacgagaagaccuacugcgugagcgggcagcugaucgagggcgucugcuucaaccccgugcacacgcgcgcccucucccagcccagccacaccuacgacaucgugaccaugaugguccggugcuuccugguggugaagaaggucaccuccggggacagcaugaagaucgagaagaacuucgagacgcuggugcagaagaccgacugcaacgcgaacggcuuccagggcuacuacaucugccucguggggagcuccagcgagccccuguacguccccacccuggacgacuaccgcuccgccgaggugcucagccggauggccuucgccccgcacggcgaggaccacgacguggagcgcaacgcggucuccgcccugcggaucguggggaaggucaccggcaaggcccccagcacggaggccuccgacaccgugcagggcaucgccuucagcgggagcccccuguacaccuccaccggcgugcucacggcgaaggacaaccccgucuacaucugguccccggggaucaucauggagggcaaccacagcgugugcgagaagaagacccugccccugaccuggaccggguucaucccccuccccggcgagaucgagaagacgccgcagugcaccguguucugcacccuggccggccccggggccgacugcgaggccuacuccgagaccggcaucuucaacaucagcucccccacgugccugcucaaccgcguccagcgguuccgcggggccgagcagcagaucaaguucgugugccagcggguggacauggacaucaccgucuacugcaacggcaugaagaaggugauccugaccaagacccuggugaucgggcagugcaucuacaccuucacgagcaucuucucccucauccccggcaucgcgcacagccuggccgucgagcugugcgugccgggccuccacgggugggccaccgugcugcugcuccugaccuucugcuucggcuggauccugauccccuucaucgccaugauccugcucaagauccugaucgccuucgcguaccugugcuccaaguacaacaccgacagcaaguucaagauccucaucgagaaggucaagaaggaguaccagaagacgauggggagcauggugugcgaggugugccaguacgagugcgagaccgccaaggagcuggagucccaccgcaagagcugccccaucggcuccugccccuacugccugaacccgagcgaggccaccaccuccgcccuccaggcccacuucaaggucugcaagcugacgagccgguuccaggacaaccugcgcaagucccucgcggccuacgagcccaagcaggggugcuaccggacccugagccuguuccgcuaccggucccgcuucuucgugggcuucaucuggugcauccuccuggugcuggagcucgucaucugggccgccagcgcggagacccagaaccugaacuccggcuggaccgacacggcccacgggagcggcguggugcccaugcgcaccgaccuggagcucgacuucucccugccgagcuccgccagcuacaccuaccggcgccagcugcagaaccccgccaacgagcacgagaagauccccuuccaccuccagaucuccaagcaggucauccacgccgagauccagcaccuggggcacuggauggacgcgaccuucaaccugaagacggccuuccacugcuacggccucugcgagaaguacgccuaccccuggcagaccgccggcugcuucuucgagaaggacuacgaguucgagagcggguggggcugcaacccgcccgacugccccgggaucggcaccgggugcaccgccugcggcguguaccuggacaagcucaagagcgugggcaaggucuucaagaucaucucccugcgguacacgcgcaaggcgugcauccagcuggggaccgagcagaccugcaagagcguggacuccaacgacugccuggugaccacgagcaucaaggucugccucaucggcaccguguccaaguuccagcccagcgacacccugcuguuccucgggccgcuggagcagggcgggcugaucuucaagcaguggugcaccacgaccugccaguucggcgaccccggcgacaucauguccacccucaccgggaugaagugccccgagcugaacggcagcuuccggaagaagugcgccuucgccacgacccccgugugccaguucgacgggaacaccaucuccggcuacaagcgcaugauggccaccaaggacagcuuccaguccuucaacgucacggagccgcacaucagcaccuccgcccuggaguggaucgaccccgacagcucccuccgggaccacaucaacgugguggucagccgcgaccuguccuuccaggaccugagcgagacccccugccagguggaccucaccaccuccagcaucgacggggcguggggcagcggcgugggguucaaccuggucugcacggugucccugaccgagugccccaccuuccucaccagcaucaaggccugcgacuccgccaugugcuacggcagcacgaccaccaaccuggugcgggggcagaacaccguccacaucgugggcaagggcgggcacuccggcagcaaguucaugugcugccacgacacgaagugcuccagcaccgggcugaucgccgcggccccgcaccucgaccgcgugaccggcuucaaccaggccgacuccgacaagaucuucgacgacggggcccccggcugcggcaugagcugcugguucaagaaguccggggaguggauccugggcguccugaacgggaacuggcucgugguggccguccugaucgcgcuguucauccucagcaucuuccuguucacccugugcugcccccggcgccccacguacaccaaggagcacaagccguga

SEQ ID NO: 11800 - RNA, 3447 nt, Artificial Sequence
  derived and/or modified CDS sequence (opt1) from PUUV(CG1820/POR)__KT885051.1__GP
augggcgagcugagccccgugugccucuaccugcugcuccaggggcugcugcucugcaacaccggcgccgcccgcaaccugaacgagcugaagauggagugcccgcacaccauccggcucgggcagggccuggucgugggguccguggagcugcccagccuccccauccagcaggucgagacgcugaagcuggaguccagcugcaacuucgaccuccacaccuccaccgcgggccagcagagcuucaccaaguggacgugggagaucaagggcgaccuggccgagaacacccaggccuccagcaccuccuuccagaccaagagcuccgaggugaaccugcgcgggcucugccugauccccacgcugguggucgagaccgccgcccggaugcgcaagaccaucgcgugcuacgaccucagcugcaaccagaccgugugccagccgacgguguaccugaugggccccauccagaccugcaucaccaccaaguccugccugcucagccugggggaccagcggauccaggucaacuacgagaagacguacugcguguccggccagcugguggaggggaucugcuucaaccccauccacaccauggcccucagccagcccucccacaccuacgacaucaugaccaugaugguccgcugcuuccuggugaucaagaaggugacgagcggcgacuccaugaagaucgagaagaacuucgagacccugguccagaagaacggcugcaccgccaacaacuuccagggguacuacaucugccucaucggcagcagcuccgagccgcuguacgugcccgcccuggacgacuaccggagcgcggaggugcucucccgcauggccuucgcgccccacggggaggaccacgacaucgagaagaacgccgucagcgccaugcggaucgccggcaaggugaccggcaaggcccccuccacggagagcuccgacaccgugcaggggaucgccuucagcggcuccccgcuguacaccagcaccgggguccugacguccaaggacgaccccguguacaucugggcccccggcaucaucauggaggggaaccacagcaucugcgagaagaagacccucccccugaccuggaccggcuucaucucccugccgggcgagaucgagaagacgacccagugcaccguguucugcacccucgccgggcccggcgcggacugcgaggccuacagcgagacggggaucuucaacaucuccagcccgaccugccugaucaaccgcguccagcgguuccgcggcuccgagcagcagaucaaguucgugugccagcgggucgacauggacaucaccguguacugcaacgggaugaagaaggugauccugaccaagacccucgucaucggccagugcaucuacacguucaccagcaucuucucccugauccccggcguggcccacagccuggccguggagcucugcguccccgggcugcacggcugggccaccaugcugcuccugcugaccuucugcuucgggugggugcugauccccacgaucaccaugauccuccugaagauccugaucgcguucgccuaccucugcagcaaguacaacaccgacuccaaguuccgcauccugaucgagaaggugaagcgggaguaccagaagaccaugggcagcauggucugcgaggugugccaguacgagugcgagacggccaaggagcuggagucccaccgcaagagcugcuccaucgggagcugccccuacugccucaaccccuccgaggccaccaccagcgcccugcaggcgcacuucaaggugugcaagcugaccucccgguuccaggagaaccuccgcaagagccugacggucuacgagccgaugcagggcugcuaccggacccugucccucuuccgcuaccggagccgcuucuucgugggccugguguggugcguccugcucgugcuggagcugaucgugugggccgccuccgccgagacccagaaccucaacgcgggguggaccgacacggcccacggcagcgggaucauccccaugaagaccgaccuggagcuggacuucucccuccccagcuccgccagcuacaccuaccgccggcagcugcagaaccccgccaacgagcaggagaagaucccguuccaccuccagcucagcaagcaggucauccacgccgagauccagcaccugggccacuggauggacgcgaccuucaaccugaagacggccuuccacugcuacggcuccugcgagaaguacgccuaccccuggcagaccgccgggugcuucaucgagaaggacuacgaguacgagaccggcugggggugcaacccgcccgacugccccggcguggggaccggcugcacggccugcggcguguaccucgacaagcucaagagcgucgggaagguguucaagaucgugucccugcgcuacacccggaaggucugcauccagcugggcaccgagcagaccugcaagacgguggacagcaacgacugccugaucaccaccuccgugaaggucugccugaucgggaccaucagcaaguuccagcccuccgacacgcuccuguuccugggcccccuccagcagggcgggcugaucuucaagcaguggugcaccacgaccugccaguucggcgacccgggggacaucaugagcacccccaccggcaugaagugccccgagcugaacggguccuuccgcaagaagugcgcguucgccaccacccccgugugccaguucgacggcaacaccaucagcggguacaagcggaugaucgccacgaaggacuccuuccagagcuucaacgugaccgagccgcacaucuccaccagcgcccucgaguggaucgaccccgacuccagccugcgcgaccacaucaacgucaucgugucccgggaccugagcuuccaggaccucuccgagacccccugccagaucgaccuggccacggcgagcaucgacggcgccuggggcagcggggugggcuucaaccuggucugcaccgugucccucaccgagugcagcgccuuccugaccuccaucaaggccugcgacgcggccaugugcuacgggagcacgaccgccaaccuggugcgcggccagaacaccauccacaucgucgggaagggcggccacuccgggagcaaguucaugugcugccacgacaccaagugcuccagcacgggccucguggccgccgcgccccaccuggaccgggugaccggguacaaccaggccgacuccgacaagaucuucgacgacggcgccccggagugcggcaugagcugcugguucaagaaguccggggaguggauccugggcguccucaacgggaacuggauggugguggccguccugguggugcugcucauccugagcauccugcuguucacccugugcugcccccgccggcccuccuaccgcaaggagcacaagcccuga

SEQ ID NO: 11801 - RNA, 3447 nt, Artificial Sequence
  derived and/or modified CDS sequence (opt1) from PUUV(DTK/Ufa-97)__AB297666.2__GP
augggcgagcugagccccgugugccucuaccugcugcuccaggggcugcugcucugcaacaccggcgccgcccgcaaccugaacgagcugaagauggagugcccgcacaccguccggcucgggcagggccugguggugggguccgucgagcugcccagccuccccauccagcaggucgagacgcugaagcuggaguccagcugcaacuucgaccuccacaccuccaccgcgggccagcagagcuucaccaaguggacgugggagaucaagggcgaccuggccgagaacacccaggccuccagcaccuccuuccagaccaagagcuccgaggugaaccugcgcgggcucugccugauccccacgcuggugguggagaccgccgcccggaugcgcaagaccaucgcgugcuacgaccucagcugcaaccagaccgugugccagccgacggucuaccugaugggccccauccagaccugcaucaccaccaaguccugccugcucagccugggggaccagcggauccaggugaacuacgagaagacguacugcguguccggccagcuggucgaggggaucugcuucaaccccauccacaccauggcccucagccagcccucccacaccuacgacaucaugaccaugauggugcgcugcuuccuggugaucaagaaggucacgagcggcgacuccaugaagaucgagaagaacuucgagacccuggugcagaagaacggcugcaccgccaacaacuuccagggguacuacaucugccucaucggcagcagcuccgagccgcuguacgugcccgcccuggacgacuaccggagcgcggagguccucucccgcauggccuucgcgccccacggggaggaccacgacaucgagaagaacgccgugagcgccaugcggaucgccggcaaggugaccggcaaggcccccuccacggagagcuccgacaccguccaggggaucgccuucagcggcuccccgcuguacaccagcaccggggugcugacguccaaggacgaccccguguacaucugggcccccggcaucaucauggaggggaaccacagcaucugcgagaagaagacccucccccugaccuggaccggcuucaucucccugccgggcgagaucgagaagacgacccagugcaccgucuucugcacccucgccgggcccggcgcggacugcgaggccuacagcgagacggggaucuucaacaucuccagcccgaccugccugaucaaccgcgugcagcgguuccgcggcuccgagcagcagaucaaguucgucugccagcggguggacauggacaucaccguguacugcaacgggaugaagaaggucauccugaccaagacccucgugaucggccagugcaucuacacguucaccagcaucuucucccugauccccggcguggcccacagccuggccgucgagcucugcgugcccgggcugcacggcugggccaccaugcugcuccugcugaccuucugcuucgggugggugcugauccccacgaucaccaugauccuccugaagauccugaucgcguucgccuaccucugcagcaaguacaacaccgacuccaaguuccgcauccugaucgagaaggucaagcgggaguaccagaagaccaugggcagcauggugugcgaggugugccaguacgagugcgagacggccaaggagcuggagucccaccgcaagagcugcuccaucgggagcugccccuacugccucaaccccuccgaggccaccaccagcgcccugcaggcgcacuucaaggucugcaagcugaccucccgguuccaggagaaccuccgcaagagccugacgguguacgagccgaugcagggcugcuaccggacccugucccucuuccgcuaccggagccgcuucuucgugggccuggucuggugcgugcugcucgugcuggagcugaucgucugggccgccuccgccgagacccagaaccucaacgcgggguggaccgacacggcccacggcagcgggaucauccccaugaagaccgaccuggagcuggacuucucccuccccagcuccgccagcuacaccuaccgccggcagcugcagaaccccgccaacgagcaggagaagaucccguuccaccuccagcucagcaagcaggucauccacgccgagauccagcaccugggccacuggauggacgcgaccuucaaccugaagacggccuuccacugcuacggcuccugcgagaaguacgccuaccccuggcagaccgccgggugcuucaucgagaaggacuacgaguacgagaccggcugggggugcaacccgcccgacugccccggcguggggaccggcugcacggccugcggcguguaccucgacaagcucaagagcguggggaagguguucaagaucgucucccugcgcuacacccggaaggugugcauccagcugggcaccgagcagaccugcaagacgguggacagcaacgacugccugaucaccaccuccgucaaggugugccugaucgggaccaucagcaaguuccagcccuccgacacgcuccuguuccugggcccccuccagcagggcgggcugaucuucaagcaguggugcaccacgaccugccaguucggcgacccgggggacaucaugagcacccccaccggcaugaagugccccgagcugaacggguccuuccgcaagaagugcgcguucgccaccacccccgugugccaguucgacggcaacaccaucagcggguacaagcggaugaucgccacgaaggacuccuuccagagcuucaacgucaccgagccgcacaucuccaccagcgcccucgaguggaucgaccccgacuccagccugcgcgaccacaucaacgugaucgugucccgggaccugagcuuccaggaccucuccgagacccccugccagaucgaccuggccacggcgagcaucgacggcgccuggggcagcggggucggcuucaaccuggugugcaccgugucccucaccgagugcagcgccuuccugaccuccaucaaggccugcgacgcggccaugugcuacgggagcacgaccgccaaccugguccgcggccagaacaccauccacaucguggggaagggcggccacuccgggagcaaguucaugugcugccacgacaccaagugcuccagcacgggccucguggccgccgcgccccaccuggaccgggucaccggguacaaccaggccgacuccgacaagaucuucgacgacggcgccccggagugcggcaugagcugcugguucaagaaguccggggaguggauccugggcgugcucaacgggaacuggaugguggucgccgugcuggugguccugcucauccugagcauccugcuguucacccugugcugcccccgccggcccuccuaccgcaaggagcacaagcccuga

SEQ ID NO: 11802 - RNA, 3447 nt, Artificial Sequence
  derived and/or modified CDS sequence (opt1) from PUUV(PUU/Cg-Erft)__AJ238778.1__GP
augggcaagaucauccccgugugccuguaccuccuguuccugugccuccugcuguggaaccgcggggacgcccggaaccucaacgagcugaagaucgagugcccgcacaccaucggccuggggcagggccucgucaucgggagcguggagcugccgcccgugccccugacccaggucgagucccucaagcuggagagcuccugcaacuucgaccugcacacgagcaccuccagccagcagcccuucaccaaguggaccugggagaugaaguccgaccucgccgagaacacgcaggcgagcuccaccagcuuccagaccaaguccagcgagaucaaccugcgcggccugugccucgugccgccccuggugaucgagaccgccgcccggacgcgcaagaccaucgccugcuucgaccuguccugcaaccagaccgccugccagcccaccgucuuccucaucggccccauccagacgugcaucaccaccaagagcugccugcuggggcucggcgaccagcggauccaggugaacuacgagaagaccuacugcguguccgggcagcuggucgagggcgugugcuucaaccccgugcacacgauggcgcugagccagcccucccacaccuacgacaucgucaccgugauggugcgcugcuuccucaucgccaagaaggucagcaccggggacuccaugaagcuggagaaguccuucgagacgcuggugcagaagaccagcugcaccggcaacggcuuccagggguacuacaucugccucgugggcagcagcuccgagccccuguacaucccgacccuggacgacuaccggagcgccgagguccucucccgcauggccuucgcgccccacggggaggaccacgacguggagaagaacgccaucagcgccaugcggaucaucggcaaggugacgggcaaggcccccuccaccgagagcuccgacaccauccagggggucgccuucagcggcaacccccuguacaccuccacgggggugcugaccgcgaaggacgacccgguguacaucugggcccccggcaucaucauggaggggaaccacagcgucugcgacaagaagacccucccccugaccuggacgggcuucaucccccugccgggcgagaucgagaagaccacccagugcaccguguucugcacgcucgccgggcccggcgccgacugcgaggccuacuccgagaccgggaucuucaacaucagcuccccgaccugccugaucaaccgcguccagcgguuccgcggcgcggagcagcagaucaaguucaucugccagcggguggacauggacaucaccguguacugcaacgggcugaagaaggucauccucaccaagacgcugaucaucggccagugcaucuacaccuucaccagcaucuucucccugauccccggcguggcccacagccucgccguggagcugugcguccccgggcugcacggcugggccaccaugcuccugcugcugacguucugcuucggguggauccucauccccuucuucuccaugauccugcugaagauccucaucgccuucgcguaccugugcagcaaguacaacaccgacagcaaguucaagauccugaucgagaaggugaagaaggaguaccagaagaccaugggcuccauggugugcgaggucugccacuacgagugcgagaccgccaaggagcucgagagccaccgcaaguccugccccauggggagcugccccuacugccugaacccggccgaggccacgaccuccgcccugcaggcgcacuucaaggugugcaagcucaccagccgguuccaggacaaccugcgcaagucccugggcgccuacgagcccaagcagggcugcuaccggacccucagccuguuccgcuaccggucccgcuucuucgugggguucaucuggugccugcuccugguccuggagcucaucgugugggccgccagcgcggagacgcagaaccugaacuccggcuggaccgacaccgcccacgggagcggcaucauccccaugcggaccgaccuggagcucgacuucucccugccgagcuccgccagcuacacguaccgccgccagcugcagaaccccgccaacgagcaggagaagauccccuuccaccuccagaucuccaagcaggucauccacgccgagauccagcaccugggccacuggauggacgggaccuucaaccugaagaccgcguuccacugcuacggcagcugcgagaaguacgccuaccccuggcagaccgccgggugcuucaucgagaaggacuacgaguacgagagcggcugggggugcaacccgcccgacugccccggcgugggcacggggugcaccgccugcggcguguaccucgacaagcugaaguccguggggaaggccuucaagaucgucagccugcgguacacccgcaaggcgugcauccagcucggcaccgagcagacgugcaaguccguggacagcaacgacugccuggugaccaccuccgucaaggugugccugaucgggaccgugagcaaguuccagcccuccgacacgcuccuguuccugggcccgcucgagcagggcgggcugaucuucaagcaguggugcaccacgaccugccaguucggcgaccccggggacaucaugagcacccccgucggcaugaagugccccgagcugaacggguccuuccggaagaagugcgccuucgccaccaccccggugugccaguucgacggcaacacccucagcggcuacaagcgcaugaucgccacgaaggacuccuuccagagcuucaacgugaccgagccccacaucuccgccagcucccuggaguggaucgaccccgacagcucccugcgggaccacaucaacgucaucguggggcgcgaccucagcuuccaggaccuguccgagacccccugccagguggaccuggcgaccaccagcaucgacggcgccugggggagcggcgucggguucaaccucgugugcuccgugagccugacggagugcuccaccuuccugaccagcaucaaggccugcgacuccgccaugugcuacggcagcaccacggcgaaccuccugcggggccagaacaccguccacaucguggggaagggcgggcacuccggcagcaaguucaugugcugccacgacaccaagugcuccagcaccggccugguggccgccgccccgcaccucgaccgcgucacgggguacaaccaggccgacuccgacaagaucuucgacgacggcgcgcccgagugcgggaucagcugcugguucaccaaguccggcgaguggauccugggggugcugaacggcaacuggaugguggucgccgugcucguggcccuguucauccugagcaucuuccucuucacccugugcugcccccggcgccccuccuacgccaaggagcacaagccguga

SEQ ID NO: 11803 - RNA, 3447 nt, Artificial Sequence
  derived and/or modified CDS sequence (opt1) from PUUV(PUUV/Konnevesi/Mg_M105A/2005)__JQ319173.1__GP
augggcaagagcucccccgugugccuguaccucauccugcaggggcugcuccugaucggcgccgucaacgcccgcaaccugaacgagcucaagauggagugcccgcacaccaucgggcugggccaggggcugguggugggcagcgucgagcucccgcccgugcccauccagcaggucgagucccugaagcuggagagcuccugcaacuucgaccuccacaccagcacggcgggccagcaguccuucaccaaguggaccugggagaccaagagcgaccuggccgagaacacgcaggccuccagcaccuccuuccagaccaagagcuccgaggugaaccugcgggggcucugccugauccccacccuggugguggagacggccgcccgcaugcggaagaccaucgcgugcuacgaccucagcugcaaccagaccgucugccagcccaccguguaccugaugggccccauccagacgugccugaccaccaaguccugccuccuggggcugggcgaccagcgcauccaggugaacuacgagcggaccuacugcgucagcgggcagcucguggagggcgugugcuucaaccccauccacacgauggcccugucccagccgagccacaccuacgacaucgucaccgugauggugcgcugcuuccuggucaucaagaaggugaccuccggcgacagcaugaagaucgagaagaacuucgagacgcucgugcagaagaccgggugcaccgccaacagcuuccagggcuacuacaucugccuggucggguccagcuccgagccccuguacgugcccacccucgacgacuaccggagcgccgaggugcugucccgcauggcguucgcgccccacggcgaggaccacgacaucgagaagaacgccaucagcgcccugcggaucgccggcaaggucacggggaaggccccguccaccgagagcuccgacaccgugcagggcaucgccuucagcgggagcccccucuacaccagcacgggcguccugaccgccaaggacgaccccguguacaucugggcccccgggaucaucauggagggcaaccacuccgugugcgagaagaagacccugccgcucaccuggacgggcuucaucccccugcccggggagaucgagaagaccacccagugcaccgucuucugcacgcuggccggccccggggcggacugcgaggccuacagcgagaccggcaucuucaacaucuccagcccgaccugccucaucaaccgcgugcagcgguuccgcggggccgagcagcagaucaaguucgugugccagcgggucgacauggacaucaccguguacugcaacggcgugaagaaggucauccugaccaagacgcuggugaucggccagugcaucuacaccuucaccuccaucuucagccucauccccgggaucgcccacucccuggccguggagcugugcguccccggccuccacgggugggcgaccgugcugcugcuccugacguucugcuucggcugggugcugauccccaccaucaccaugauccugcucaagauccugaucgccuucgccuaccugugcagcaaguacaacaccgacagcaaguucaagauccucgucgagaaggugaagaaggaguaccagaagacgaugggguccauggugugcgaggucugccaguacgagugcgagaccgccaaggagcuggagagccaccgcaaguccugcagcaucggcuccugcccguacugccugaaccccagcgaggccacccccuccgcgcuccaggcccacuucaaggugugcaagcugaccagccgguuccaggagaaccugaagaagucccucacgauguacgagcccaugcagggcugcuaccgcacccugagccuguuccgguaccgcucccgguucuucguggggcucgucuggugcaugcugcuggugcucgagcugaucgugugggccgccagcgcggagacccagaaccugaacgccggcuggaccgacacggcccacggguccggcaucaucccgaugaaggccgaccucgagcuggacuucagccugcccuccagcgccuccuacaccuaccgccggcagcuccagaaccccgcgaacgagcaggagaagaucccguuccaccuccagaucagcaagcaggucauccacgccgagauccagcaccugggccacuggauggacgccaccuucaaccugaagaccgccuuccacugcuacgggagcugcgagaaguacgccuaccccuggcagacggcgggcugcuucguggagaaggacuacgaguacgagaccggguggggcugcaacccgcccgacugccccggggugggcaccggcugcaccgccugcggggucuaccuggacaagcugaaguccgugggcaagguguucaagaucgucagccuccgcuacacgcgcaaggugugcauccagcuggggaccgagcagaccugcaagaccguggacuccaacgacugccugaucacgaccagcgucaaggugugccucaucggcaccaucuccaaguuccagcccagcgacacccugcuguuccucgggccccugcagcagggcggccugaucuucaagcaguggugcacgacgaccugccaguucggggaccccggcgacaucauguccaccccgaccgggaugaagugccccgagcucaacggcagcuuccggaagaagugcgccuucgccaccacccccgugugccaguucgacgggaacaccaucuccggcuacaagcgcaugaucgccaccaaggacagcuuccaguccuucaacgucacggagccccacaucagcaccuccgcgcuggaguggaucgacccggacagcucccugcgggaccacaucaacgugaucgugagccgcgaccucuccuuccaggaccugagcgagacccccugccagaucgaccugaccgccuccgccaucgacggcgccugggggagcggcgucggguucaaccucgugugcacgaucagccugaccgagugcuccaccuuccugaccagcaucaaggcgugcgacgccgccaugugcuacggcuccacgaccaccaaccucgugcgggggcagaacaccauccacgucgugggcaagggcgggcacagcggcuccaaguucaugugcugccacgacacgaagugcagcuccaccgggcugguggccgccgcgccccaccugaaccgcgucaccggcuucaaccaggccgacagcgacaagaucuucgacgacggcgcccccgagugcgggguguccugcugguucaagaaguccggcgagugggugcucgggguccugaacggcaacuggauggugguggccguccugaucgcccuccugauccuguccaucuuccucuucgcgcugugcugcccgcggcgccccagcuacaagaaggagcacaagcccuga

SEQ ID NO: 11804 - RNA, 3447 nt, Artificial Sequence
  derived and/or modified CDS sequence (opt1) from PUUV(PUUV/Konnevesi/Mg_M114B/2005)__JQ319175.1__GP
augggcaagagcucccccgugugccuguaccucauccugcaggggcugcuccuguucggcgccgucaacgcccgcaaccugaacgagcucaagauggagugcccgcacaccaucgggcugggccaggggcugguggugggcagcgucgagcucccgcccgugcccauccagcaggucgagucccugaagcuggagagcuccugcaacuucgaccuccacaccagcacggcgggccagcaguccuucaccaaguggaccugggagaucaagaacgaccuggccgagaacacccaggccagcuccacgagcuuccagaccaaguccagcgaggugaaccugcgggggcucugccugauccccacccuggugguggagaccgccgcccgcaugcggaagacgaucgcgugcuacgaccucuccugcaaccagaccgucugccagcccaccguguaccugaugggccccauccagaccugccugacgaccaagagcugccuccuggggcugggcgaccagcgcauccaggugaacuacgagcggaccuacugcgucuccgggcagcucguggagggcgugugcuucaaccccauccacaccauggcccugagccagccgucccacacguacgacaucgucaccaucauggugcgcugcuuccuggugaucaagaaggucaccagcggcgacaacaugaagaucgagaagaacuucgagacccucgugcagaagacggggugcaccgccaacuccuuccagggcuacuacaucugccugguggggagcagcuccgagccccuguacguccccacccucgacgacuaccggagcgccgaggugcugucccgcauggcguucgcgccccacggcgaggaccacgacaucgagaagaacgccaucagcgcccugcggaucgccggcaaggugaccgggaaggccccguccacggagagcuccgacaccguccagggcaucgccuucagcgggagcccccucuacaccagcaccggcgugcugacggccaaggacgaccccgucuacaucugggcccccgggaucaucauggagggcaaccacuccgugugcgagaagaagacccugccgcucaccuggaccggcuucaucccccugcccggggagaucgagaagacgacccagugcaccguguucugcacccuggccggccccggggcggacugcgaggccuacagcgagacgggcaucuucaacaucuccagcccgaccugccucaucaaccgcguccagcgguuccgcggggccgagcagcagaucaaguucgugugccagcggguggacauggacaucaccgucuacugcaacggcgugaagaaggugauccugaccaagacccuggucaucggccagugcaucuacacguucaccuccaucuucagccucauccccgggaucgcccacucccuggccguggagcugugcgugcccggccuccacgggugggcgaccguccugcugcuccugaccuucugcuucggcugggugcugauccccacgaucaccaugauccugcucaagauccugaucgccuucgccuaccugugcagcaaguacaacaccgacuccaaguucaagauccucguggagaaggucaagaaggaguaccagaagaccauggggagcauggugugcgaggugugccaguacgagugcgagacggccaaggagcuggagagccaccgcaaguccugcagcaucggcuccugcccguacugccugaaccccagcgaggccacccccuccgcgcuccaggcccacuucaaggucugcaagcugaccagccgguuccaggagaaccugaagaagucccucaccauguacgagcccaugcagggcugcuaccgcacgcugagccuguuccgguaccgcucccgguucuucguggggcucguguggugcaugcugcugguccucgagcugaucgugugggccgccagcgcggagacccagaaccugaacgccggcuggaccgacaccgcccacggguccggcaucaucccgaugaaggccgaccucgagcuggacuucagccugcccuccagcgccuccuacacguaccgccggcagcuccagaaccccgcgaacgagcaggagaagaucccguuccaccuccagaucagcaagcaggucauccacgccgagauccagcaccugggccacuggauggacgccaccuucaaccugaagaccgccuuccacugcuacggguccugcgagaaguacgccuaccccuggcagaccgcgggcugcuucguggagaaggacuacgaguacgagacgggguggggcugcaacccgcccgacugccccggggugggcaccggcugcaccgccugcgggguguaccuggacaagcucaagagcgucggcaagguguucaagaucgugagccugcgcuacacccgcaaggucugcauccagcuggggacggagcagaccugcaagaccguggacuccaacgacugccugaucaccacgagcgugaaggucugccucaucggcaccaucuccaaguuccagcccagcgacacccugcuguuccucgggccccugcagcagggcggccugaucuucaagcaguggugcaccacgaccugccaguucggggaccccggcgacaucauguccaccccgaccgggaugaagugccccgagcucaacggcagcuuccggaagaagugcgccuucgccacgacccccgugugccaguucgacgggaacaccaucuccggcuacaagcgcaugaucgccaccaaggacagcuuccaguccuucaacgugaccgagccccacaucagcacguccgcgcuggaguggaucgacccggacagcucccugcgggaccacaucaacgucaucgugagccgcgaccucuccuuccaggaccugagcgagacccccugccagaucgaccugaucgccuccgccaucgacggcgccugggggagcggcgugggguucaaccucgucugcaccgugucccugaccgagugcagcacguuccugaccagcaucaaggcgugcgacgccgccaugugcuacggcuccaccaccaucaaccucauccgggggcagaacacgauccacguggucggcaagggcgggcacagcggcuccaaguucaugugcugccacgacaccaagugcagcuccaccgggcugguggccgccgcgccccaccuggaccgcgugaccggcuucaaccaggccgacagcgacaagaucuucgacgacggcgcccccgagugcggggucuccugcugguucaagaaguccggcgagugggugcucggggugcugaacggcaacuggauggucguggccgugcugaucgcccuccugauccuguccaucuuccucuucgcgcugugcugcccgcggcgccccagcuacaagaaggagcacaagcccuga

SEQ ID NO: 11805 - RNA, 3447 nt, Artificial Sequence
  derived and/or modified CDS sequence (opt1) from PUUV(PUUV/Konnevesi/Mg_M78B/2005)__JQ319174.1__GP
augggcaagagcucccccgugugccuguaccucauccugcaggggcugcuccuguucggcgccgucaacgcccgcaaccugaacgagcucaagauggagugcccgcacaccaucgggcugggccaggggcugguggugggcagcgucgagcucccgcccgugcccauccagcaggucgagucccugaagcuggagagcuccugcaacuucgaccuccacaccagcacggcgggccagcaguccuucaccaaguggaccugggagaucaagaacgaccuggccgagaacacccaggccagcuccacgagcuuccagaccaaguccagcgaggugaaccugcgggggcucugccugauccccacccuggugguggagaccgccgcccgcaugcggaagacgaucgcgugcuacgaccucuccugcaaccagaccgucugccagcccaccguguaccugaugggccccauccagaccugccugacgaccaagagcugccuccuggggcugggcgaccagcgcauccaggugaacuacgagcggaccuacugcgucuccgggcagcucguggagggcgugugcuucaaccccauccacaccauggcccugagccagccgucccacacguacgacaucgucaccaucauggugcgcugcuuccuggugaucaagaaggucaccagcggcgacaacaugaagaucgagaagaacuucgagacccucgugcagaagacggggugcaccgccaacggcuuccagggguacuacaucugccuggugggcuccagcagcgagccccuguacguccccacccucgacgacuaccgguccgccgaggugcugagccgcauggcguucgcgccccacggcgaggaccacgacaucgagaagaacgccaucuccgcccugcggaucgccgggaaggugaccggcaaggccccgagcacggaguccagcgacaccguccaggggaucgccuucuccggcagcccccucuacaccuccaccggggugcugacggccaaggacgaccccgucuacaucugggcccccggcaucaucauggagggcaaccacagcgugugcgagaagaagacccugccgcucaccuggaccggguucaucccccugcccggcgagaucgagaagacgacccagugcaccguguucugcacccuggccgggcccggcgcggacugcgaggccuacuccgagacggggaucuucaacaucagcuccccgaccugccucaucaaccgcguccagcgguuccgcggcgccaagcagcagaucaaguucgugugccagcggguggacauggacaucaccgucuacugcaacggcgugaagaaggugauccugaccaagacccuggucaucgggcagugcaucuacacguucaccagcaucuucucccucauccccggcaucgcccacagccuggccguggagcugugcgugcccgggcuccacggcugggcgaccguccugcugcuccugaccuucugcuucgggugggugcugauccccacgaucaccaugauccugcucaagauccugaucgccuucgccuaccugugcuccaaguacaacaccgacagcaaguucaagauccucguggagaaggucaagaaggaguaccagaagaccaugggcuccauggugugcgaggugugccaguacgagugcgagacggccaaggagcuggagagccaccgcaagagcugcuccaucggcagcugcccguacugccugaaccccuccgaggccacccccagcgcgcuccaggcccacuucaaggucugcaagcugaccucccgguuccaggagaaccugaagaagucccucaccauguacgagcccaugcaggggugcuaccgcacgcugagccuguuccgguaccgcagccgguucuucgugggccucguguggugcaugcugcugguccucgagcugaucgugugggccgccuccgcggagacccagaaccugaacgccggguggaccgacaccgcccacggcagcggcaucaucccgaugaaggccgaccucgagcuggacuucucccugcccagcuccgccagcuacacguaccgccggcagcuccagaaccccgcgaacgagcaggagaagaucccguuccaccuccagaucuccaagcaggucauccacgccgagauccagcaccuggggcacuggauggacgccaccuucaaccugaagaccgccuuccacugcuacggcagcugcgagaaguacgccuaccccuggcagaccgcggggugcuucguggagaaggacuacgaguacgagacgggcugggggugcaacccgcccgacugccccggcgugggcaccgggugcaccgccugcggcguguaccuggacaagcugaaguccgucgggaagguguucaagaucgugagccuccgcuacacccgcaaggucugcauccagcugggcacggagcagaccugcaagaccguggacagcaacgacugccugaucaccacguccgugaaggucugccucaucgggaccaucagcaaguuccagcccuccgacacccugcuguuccucggcccccugcagcagggcgggcugaucuucaagcaguggugcaccacgaccugccaguucggcgaccccggggacaucaugagcaccccgaccggcaugaagugccccgagcucaacggguccuuccggaagaagugcgccuucgccacgacccccgugugccaguucgacggcaacaccaucagcggcuacaagcgcaugaucgccaccaaggacuccuuccagagcuucaacgugaccgagccccacaucuccacgagcgcgcuggaguggaucgacccggacuccagccugcgggaccacaucaacgucaucgugucccgcgaccucagcuuccaggaccuguccgagacccccugccagaucgacaugaccgccagcgccaucgacggggccuggggcuccggggugggcuucaaccuggucugcaccgugagccucacggagugcuccaccuuccugaccagcaucaaggcgugcgacgccgccaugugcuacgggagcaccacgaccaaccuggugcggggccagaacaccauccacgucgugggcaagggcgggcacuccgggagcaaguucaugugcugccacgacaccaagugcuccagcaagggccucguggccgccgcgccccaccuggaccgcgucacgggcuucaaccaggccgacuccgacaagaucuucgacgacggggcccccgagugcggcgugagcugcugguucaagaaguccggggagugggugcugggcguccucaacgggaacuggauggugguggccguccugaucgcccugcucauccugagcaucuuccuguucgcgcucugcugcccgcggcgccccuccuacaagaaggagcacaagcccuga

SEQ ID NO: 11806 - RNA, 3447 nt, Artificial Sequence
  derived and/or modified CDS sequence (opt1) from PUUV(PUUV/Konnevesi/Mg_O78A/2005)__JQ319172.1__GP
augggcaagagcucccccgugugccuguaccucauccugcaggggcugcuccuguucggcgccgucaacgcccgcaaccugaacgagcucaagauggagugcccgcacaccaucgggcugggccaggggcugguggugggcagcgucgagcucccgcccgugcccauccagcaggucgagucccugaagcuggagagcuccugcaacuucgaccuccacaccagcacggcgggccagcaguccuucaccaaguggaccugggagaucaagagcgaccuggccgagaacacccaggccuccagcacguccuuccagaccaagagcuccgaggugaaccugcgggggcucugccugauccccacccuggugguggagaccgccgcccgcaugcggaagacgaucgcgugcuacgaccucagcugcaaccagaccgucugccagcccaccguguaccugaugggccccauccagaccugccugacgaccaaguccugccuccuggggcugggcgaccagcgcauccaggugaacuacgagcggaccuacugcgucagcgggcagcucguggagggcgugugcuucaaccccauccacaccauggcccugucccagccgagccacacguacgacaucgucaccaucauggugcgcugcuuccuggugaucaagaaggucaccuccggcgacagcaugaagaucgagaagaacuucgagacccucgugcagaagacggggugcaccgccaacagcuuccagggcuacuacaucugccuggugggguccagcuccgagccccuguacguccccacccucgacgacuaccggagcgccgaggugcugucccgcauggcguucgcgccccacggcgaggaccacgacaucgagaagaacgccaucagcgcccugcggaucgccggcaaggugaccgggaaggccccguccacggagagcuccgacaccguccagggcaucgccuucagcgggagcccccucuacaccagcaccggcgugcugacggccaaggacgaccccgucuacaucugggcccccgggaucaucauggagggcaaccacuccgugugcgagaagaagacccugccgcucaccuggaccggcuucaucccccugcccggggagaucgagaagacgacccagugcaccguguucugcacccuggccggccccggggcggacugcgaggccuacagcgagacgggcaucuucaacaucuccagcccgaccugccucaucaaccgcguccagcgguuccgcggggccgagcagcagaucaaguucgugugccagcggguggacauggacaucaccgucuacugcaacggcgugaagaaggugauccugaccaagacccuggucaucggccagugcaucuacacguucaccuccaucuucagccucauccccgggaucgcccacucccuggccguggagcugugcgugcccggccuccacgggugggcgaccguccugcugcuccugaccuucugcuucggcugggugcugauccccacgaucaccaugauccugcucaagauccugaucgccuucgccuaccugugcagcaaguacaacaccgacagcaaguucaagauccucguggagaaggucaagaaggaguaccagaagaccaugggguccauggugugcgaggugugccaguacgagugcgagacggccaaggagcuggagagccaccgcaaguccugcagcaucggcuccugcccguacugccugaaccccagcgaggccacccccuccgcgcuccaggcccacuucaaggucugcaagcugaccagccgguuccaggagaaccugaagaagucccucaccauguacgagcccaugcagggcugcuaccgcacgcugagccuguuccgguaccgcucccgguucuucguggggcucguguggugcaugcugcugguccucgagcugaucgugugggccgccagcgcggagacccagaaccugaacgccggcuggaccgacaccgcccacggguccggcaucaucccgaugaaggccgaccucgagcuggacuucagccugcccuccagcgccuccuacacguaccgccggcagcuccagaaccccgcgaacgagcaggagaagaucccguuccaccuccagaucagcaagcaggucauccacgccgagauccagcaccugggccacuggauggacgccaccuucaaccugaagaccgccuuccacugcuacgggagcugcgagaaguacgccuaccccuggcagaccgcgggcugcuucguggagaaggacuacgaguacgagacgggguggggcugcaacccgcccgacugccccggggugggcaccggcugcaccgccugcgggguguaccuggacaagcugaaguccgucggcaagguguucaagaucgugagccuccgcuacacccgcaaggucugcauccagcuggggacggagcagaccugcaagaccguggacuccaacgacugccugaucaccacgagcgugaaggucugccucaucggcaccaucuccaaguuccagcccagcgacacccugcuguuccucgggccccugcagcagggcggccugaucuucaagcaguggugcaccacgaccugccaguucggggaccccggcgacaucauguccaccccgaccgggaugaagugccccgagcucaacggcagcuuccggaagaagugcgccuucgccacgacccccgugugccaguucgacgggaacaccaucuccggcuacaagcgcaugaucgccaccaaggacagcuuccaguccuucaacgugaccgagccccacaucagcacguccgcgcuggaguggaucgacccggacagcucccugcgggaccacaucaacgucaucgugagccgcgaccucuccuuccaggaccugagcgagacccccugccagaucgaccugaccgccuccgccaucgacggcgccugggggagcggcgugggguucaaccucgucugcaccaucagccugacggagugcuccaccuuccugaccagcaucaaggcgugcgacgccgccaugugcuacggcuccaccacgaccaaccucgugcgggggcagaacaccauccacguggucggcaagggcgggcacagcggcuccaaguucaugugcugccacgacaccaagugcagcuccacggggcugguggccgccgcgccccaccugaaccgcgugaccggcuucaaccaggccgacagcgacaagaucuucgacgacggcgcccccgagugcggggucuccugcugguucaagaaguccggcgagugggugcucggggugcugaacggcaacuggauggucguggccgugcugaucgcccuccugauccuguccaucuuccucuucgcgcugugcugcccgcggcgccccagcuacaagaaggagcacaagcccuga

SEQ ID NO: 11807 - RNA, 3447 nt, Artificial Sequence
  derived and/or modified CDS sequence (opt1) from PUUV(PUUV/Pieksamaki/human_kidney/2008)__JN831951.1__GP
augggcaagagcucccccgugugccuguaccucauccugcaggggcugcuccuguucggcgccgucaacgcccgcaaccugaacgagcucaagauggagugcccgcacaccaucgggcugggccaggggcugguggugggcagcgucgagcucccgcccgugcccauccagcaggucgagucccugaagcuggagagcuccugcaacuucgaccuccacaccagcacggcgggccagcaguccuucaccaaguggaccugggagaucaagagcgaccuggccgagaacacccaggccuccagcacguccuuccagaccaagagcuccgaggugaaccugcgggggcucugccugauccccacccuggugguggagaccgccgcccgcaugcggaagacgaucgcgugcuacgaccucagcugcaaccagaccgucugccagcccaccguguaccugaugggccccauccagaccugccugacgaccaaguccugccuccuggggcugggcgaccagcgcauccaggugaacuacgagcggaccuacugcgucagcgggcagcucguggagggcgugugcuucaaccccauccacaccauggcccugucccagccgagccacacguacgacgucgugaccaucauggugcgcugcuuccuggucaucaagaaggugaccuccggcgacagcaugaagaucgagaagaacuucgagacccucgugcagaagacggggugcaccgccaacaacuuccagggcuacuacaucugccuggucgggagcuccagcgagccccuguacgugcccacccucgacgacuaccgguccgccgaggugcugagccgcauggcguucgcgccccacggcgaggaccacgacaucgagaagaacgccaucuccgcccugcggaucgccggcaaggucaccgggaaggccccgagcacggaguccagcgacaccgugcagggcaucgccuucuccgggagcccccucuacaccuccaccggcguccugacggccaaggacgaccccguguacaucugggcccccgggaucaucauggagggcaaccacagcgugugcgagaagaagacccugccgcucaccuggaccggcuucaucccccugcccggggagaucgagaagacgacccagugcaccgucuucugcacccuggccggccccggggcggacugcgaggccuacuccgagacgggcaucuucaacaucagcuccccgaccugccucaucaaccgcgugcagcgguuccgcggggccgagcagcagaucaaguucgugugccagcgggucgacauggacaucaccguguacugcaacggcgugaagaaggucauccugaccaagacccuggugaucggccagugcaucuacacguucaccagcaucuucucccucauccccgggaucgcccacagccuggccguggagcugugcguccccggccuccacgggugggcgaccgugcugcugcuccugaccuucugcuucggcugggugcugauccccacgaucaccaugauccugcucaagauccugaucgccuucgccuaccugugcuccaaguacaacaccgacagcaaguucaagauccucgucgagaaggugaagaaggaguaccagaagaccauggggagcauggugugcgaggucugccaguacgagugcgagacggccaaggagcuggagucccaccgcaagagcugcuccaucggcagcugcccguacugccugaaccccuccgaggccacccccagcgcgcuccaggcccacuucaaggugugcaagcugaccucccgguuccaggagaaccugaagaagucccucaccauguacgagcccaugcagggcugcuaccgcacgcugagccuguuccgguaccgcagccgguucuucguggggcucgucuggugcaugcugcuggugcucgagcugaucgugugggccgccuccgcggagacccagaaccugaacgccggcuggaccgacaccgcccacgggagcggcaucaucccgaugaaggccgaccucgagcuggacuucucccugcccagcuccgccagcuacacguaccgccggcagcuccagaaccccgcgaacgagcaggagaagaucccguuccaccuccagaucuccaagcaggucauccacgccgagauccagcaccugggccacuggauggacgccaccuucaaccugaagaccgccuuccacugcuacgggagcugcgagaaguacgccuaccccuggcagaccgcgggcugcuucguggagaaggacuacgaguacgagacgggguggggcugcaacccgcccgacugccccggggugggcaccggcugcaccgccugcggggucuaccuggacaagcucaagagcgugggcaagguguucaagaucgucucccugcgcuacacccgcaaggugugcauccagcuggggacggagcagaccugcaagaccguggacagcaacgacugccugaucaccacguccgucaaggugugccucaucggcaccaucagcaaguuccagcccuccgacacccugcuguuccucgggccccugcagcagggcggccugaucuucaagcaguggugcaccacgaccugccaguucggggaccccggcgacaucaugagcaccccgaccgggaugaagugccccgagcucaacggcuccuuccggaagaagugcgccuucgccacgacccccgugugccaguucgacgggaacaccaucagcggcuacaagcgcaugaucgccaccaaggacuccuuccagagcuucaacgucaccgagccccacaucuccacgagcgcgcuggaguggaucgacccggacuccagccugcgggaccacaucaacgugaucgugucccgcgaccucagcuuccaggaccuguccgagacccccugccagaucgaccugaccgccagcgccaucgacggcgccuggggguccggcgucggguucaaccucgugugcaccaucagccugacggagugcagcaccuuccugaccuccaucaaggcgugcgacgccgccaugugcuacggcagcaccacgaccaaccucgugcgggggcagaacaccauccacgucgugggcaagggcgggcacuccggcagcaaguucaugugcugccacgacaccaagugcuccagcacggggcugguggccgccgcgccccaccuggaccgcgucaccggcuucaaccaggccgacuccgacaagaucuucgacgacggcgcccccgagugcggggugagcugcugguuccggaaguccggcgagugggugcucgggguccugaacggcaacuggauggugguggccguccugaucgcccuccugauccugagcaucuuccucuucgcgcugugcugcccgcgccggcccuccuacaagaaggagcacaagcccuga

SEQ ID NO: 11808 - RNA, 3447 nt, Artificial Sequence
  derived and/or modified CDS sequence (opt1) from PUUV(Samara_49/CG/2005)__AB433850.2__GP
augggcaagcugagccccgugugccucuaccugcugcuccaggggcugcugcucugcaagaccggcaccgcccgcaaccugaacgagcugaagauggagugcccgcacacgaucgggcucggccaggggcuggucgugggcuccguggagcugccgcccguccccauccagcaggucgagacccucaagcuggagagcuccugcaacuucgaccugcacaccagcaccgccggccagcaggcguucacgaaguggaccugggagaucaagggggaccucgccgagaacacccaggccuccagcaccuccuuccagaccaagagcuccgaggugaaccugcggggccugugccucauccccacccuggugaucgagaccgccgcccgcaugcggaagaccaucgcgugcuacgaccugagcugcaaccagacggugugccagcccaccguguaccucauggggcccauccagaccugcaucaccacgaaguccugccugcugggccucggggaccagcgcauccaggucaacuacgagaagaccuacugcgugagcggccagcugguggagggcgucugcuucaaccccauccacaccauggcccugucccagccgagccacaccuacgacaucgugacgaugauggugcggugcuuccucgucaucaagaaggugaccuccggggacagcaugaagaucgagaagaacuucgagacccuggugcagaagaacggcugcaccgccaacuccuuccagggguacuacaucugccugaucggcagcuccagcgagccccucuacguccccacgcuggacgacuaccgcagcgccgaggugcugucccggauggcguucgcgccccacggcgaggaccacgacguggagaagaacgccaucagcgcccuccgcaucgccgggaaggucaccggcaaggccccguccaccgagagcuccgacaccgugcaggggaucgccuucagcggcagcccccuguacacgagcaccggggugcugaccgccaaggacgaccccgucuacaucugggcccccggcaucaucauggagggcaaccacuccgugugcgagaagaagacccucccgcugacguggaccggguucaucagccugcccggcgagaucgagaagaccacccagugcacggucuucugcacccucgccgggcccggcgcggacugcgaggccuacuccgagaccgggaucuucaacaucagcucccccacgugccugaucaaccgggugcagcgcuuccggggcgccgagcagcagaucaaguucgugugccagcgcgucgacauggacaucaccguguacugcaacggcgugaagaaggucauccugacgaagacccucgugaucgggcagugcaucuacaccuucaccagcaucuucucccugaucccgggcguggcccacagccuggccgucgagcucugcgugcccgggcugcacggcugggcgacgaugcugcuccugcugaccuucugcuucgggugggugcugauccccaccaucaccaugauccuccugaagauccugaucgccuucgccuaccucugcuccaaguacaacacggacagcaaguuccggauccugaucgagaaggucaagcgcgaguaccagaagaccaugggcuccauggugugcgaggugugccaguacgagugcgagaccgccaaggagcuggagagccacaagaaguccugcuccaucggcagcugccccuacugccucaacccguccgaggccaccacgagcgcgcugcaggcccacuucaaggucugcaagcugaccucccgguuccaggagaaccuccgcaagagccugaccguguacgagcccaugcaggggugcuaccggacccugucccucuuccgcuaccggagccgcuucuucgugggccuggucuggugcgugcugcucgugcuggagcugaucgucugggccgccuccgcggagacgcagaaccucaacgccggguggaccgacaccgcccacggcagcggcaucauccccaugaagaccgaccuggagcuggacuucucccuccccagcuccgccagcuacacguaccggcgccagcugcagaacccggccaacgagcaggagaacauccccuuccaccuccagaucuccaagcaggucauccacgcggagauccagcaccucgggcacuggauggacgccaccuucaaccugaagaccgccuuccacugcuacggcagcugcgagaaguacgccuaccccuggcagaccgccgggugcuucguggagaaggacuacgaguacgagacgggcugggggugcaacccgcccgacugccccggcgugggcaccgggugcaccgcgugcggcgccuaccuggacaagcucaaguccguggggaagguguucaagaucgucagccugcgcuacacccggaaggugugcauccagcugggcacggagcagaccugcaagaccguggacagcaacgacugccucaucaccacguccgucaaggugugccugaucgggaccaucagcaaguuccagcccuccgacacccugcuguuccugggcccgcugcagcagggcgggcucaucuucaagcaguggugcaccacgaccugccaguucggcgaccccggggacaucaugagcacccccaccggcaugaagugccccgaccugaacggguccuuccgcaagaagugcgccuucgccaccacgccggugugccaguucgacggcaacaccaucagcggcuacaagcggaugaucgccaccaaggacuccuuccagagcuucaacgucaccgagccccacaucuccgcgagcgcccuggaguggaucgaccccgacuccagccuccgcgaccacaucaacgugaucgugucccgggaccugagcuuccaggaccuguccgagacgcccugccagaucgaccucagcaccgccuccaucgacggggccuggggcagcggggucggcuucaaccuggugugcaccgugucccugaccgagugcagcgcguuccucacgagcaucaaggccugcgacgccgccaugugcuacggguccaccaccgccaaccugauccgcggccagaacaccauccacaucgucggcaagggcgggcacagcggguccaaguucaugugcugccacgacacgaagugcagcaccaccggccugguggcggccgccccgcaccucgaccgggugaccggcuacaaccaggccgacuccgacaagaucuucgacgacggggcccccgagugcggcaugagcugcugguucaagaaguccggggaguggauccugggcguccugaacgggaacuggauggugguggcgguccucaucgcccugcuggugcucagcauccugcuguucacgcucugcugcccccgccggcccuccuaccgcaaggagcacaagccguga

SEQ ID NO: 11809 - RNA, 3447 nt, Artificial Sequence
  derived and/or modified CDS sequence (opt1) from PUUV(Samara_94/CG/2005)__AB433852.2__GP
augggcaagcugagccccgugugccucuaccugcugcuccaggggcugcugcucugcaacaccggcaccgcccgcaaccugaacgagcugaagaucgagugcccgcacacgaucgggcucggccaggggcuggucgugggcuccguggagcugccgcccguccccauccagcaggucgagacccucaagcuggagagcuccugcaacuucgaccugcacaccagcaccgccggccagcaggcguucacgaaguggaccugggagaucaagggggaccucgccgagaacacccaggccuccagcaccuccuuccagacgaaguccuccgaggugaaccugcggggccugugccucauccccacccuggugaucgagaccgccgcccgcaugcggaagaccaucgcgugcuacgaccugagcugcaaccagacggugugccagcccaccguguaccucauggggcccauccagaccugcaucaccacgaaguccugccugcugggccucggggaccagcgcauccaggucaacuacgagaagaccuacugcgugagcggccagcugguggagggcgucugcuucaaccccauccacaccauggcccugucccagccgagccacaccuacgacaucgugacgaugauggugcggugcuuccucaucaucaagaaggucaccuccggggacagcaugaagaucgagaagaacuucgagacccuggugcagaagaacgacugcaccgccaacuccuuccagggcuacuacaucugcuucaucgggagcuccagcgagccccuguacgugcccacgcucgacgacuaccgcagcgccgagguccugucccggauggcguucgcgccccacggcgaggaccacgacguggagaagaacgccaucagcgcccugcgcaucgccggcaaggugaccgggaaggccccguccaccgagagcuccgacaccguccagggcaucgccuucagcgggagcccccucuacacgagcaccggcgugcuggccgccaaggacgaccccguguacaucugggcccccgggaucaucauggagggcaaccacuccaucugcgagaagaagacccugccgcucaccuggacgggcuucaucagccugcccggggagaucgagaagaccacccagugcaccgucuucugcacgcuggcgggccccggggccgacugcgaggccuacuccgagaccggcaucuucaacaucagcuccccgaccugccucaucaaccgggugcagcgcuuccgcggggccgagcagcagaucaaguucgucugccagcggguggacauggacaucaccguguacugcaacggcgucaagaaggugauccugaccaagacgcuggugaucggccagugcaucuacaccuucaccagcaucuucucccucauccccggggucgcccacagccuggcgguggagcugugcgugcccggccuccacgggugggccaccaugcugcugcuccugacguucugcuucggcuggguccugauccccaccaucaccaugauccugcucaagauccugaucgccuucgccuaccugugcuccaaguacaacaccgacagcaaguuccggauccucaucgagaaggugaagaaggaguaccagaagacgaugggguccauggugugcgaggucugccaguacgagugcgagaccgccaaggagcuggagagccaccgcaagagcugcuccaucggcagcugccccuacugccugaacccguccgaggcgaccaccagcgcccuccaggcccacuucaaggugugcaagcugacgucccgguuccaggagaaccugcgcaagagccucaccguguacgagcccaugcagggcugcuaccggacccugucccuguuccgcuaccggagccgcuucuucgucgggcucguguggugcgugcugcugguccucgagcugaucgugugggccgcguccgccgagacccagaaccugaacgccggcuggacggacaccgcccacgggagcggcaucauccccaugaagaccgaccucgagcuggacuucucccugcccagcuccgccagcuacaccuaccggcgccagcuccagaacccggcgaacgagcaggagaacauccccuuccaccuccagaucuccaagcaggucauccacgccgagauccagcaccugggccacuggauggacgccacguucaaccugaagaccgccuuccacugcuacgggagcugcgagaaguacgccuaccccuggcagaccgcgggcugcuucguggagaaggacuacgaguacgagaccggguggggcugcaacccgcccgacugccccggggugggcacgggcugcaccgccugcggggccuaccuggacaagcugaaguccgugggcaaggucuucaagaucgugagccuccgcuacacccggaaggugugcauccagcuggggaccgagcagacgugcaagaccgucgacagcaacgacugccugaucaccaccuccgugaaggugugccucaucggcacgaucagcaaguuccagcccuccgacacccugcuguuccucgggccgcugcagcagggcggccugaucuucaagcaguggugcaccaccacgugccaguucggggaccccggcgacaucaugagcacccccaccgggaugaagugccccgaccucaacggcuccuuccgcaagaagugcgccuucgccaccaccccggucugccaguucgacgggaacacgaucagcggcuacaagcggaugaucgcgaccaaggacuccuuccagagcuucaacgugaccgagccccacaucuccgccagcgcccuggaguggaucgaccccgacuccagccugcgcgaccacaucaacgugaucgucucccgggaccucagcuuccaggaccuguccgagacccccugccagaucgaccugagcacgaccuccaucgacggcgccugggggagcggcgugggguucaaccucgugugcaccgucucccugaccgagugcagcgcguuccugacgagcaucaaggccugcgacgccgccaugugcuacggcuccaccaccgccaaccucauccgcgggcagaacaccauccacaucgugggcaagggcgggcacagcggcuccaaguucaugugcugccacgacacgaagugcagcaccaccgggcugguggcggccgccccgcaccuggaccgggucaccggcuacaaccaggccgacuccgacaagaucuucgacgacggcgcccccgagugcgggaugagcugcugguucaagaaguccggcgaguggauccucggggugcugaacggcaacuggaugguggucgcggugcugaucgcccuccuggugcugagcauccuccuguucacgcugugcugcccccgccggcccuccuaccgcaaggagcacaagccguga

SEQ ID NO: 11810 - RNA, 3447 nt, Artificial Sequence
  derived and/or modified CDS sequence (opt1) from PUUV(Sotkamo)__NC_005223.1__GP
augggcaagagcucccccgugugccuguaccucauccugcaggggcugcuccuguucgacaccgucaacgccaagaaccugaacgagcucaagauggagugcccgcacaccaucggccuggggcagggccuggugguggggagcgucgagcucccgcccgugcccauccagcagaucgagucccugaagcuggagagcuccugcaacuucgaccuccacacgagcaccgccggccagcaguccuucaccaaguggaccugggagacgaagggcgaccuggcggagaacacccaggccagcuccaccagcuuccagaccaaguccagcgaggugaaccugcgcgggcucugccugauccccacgcuggucguggagaccgccgcccggaugcgcaagaccaucgccugcuacgaccucuccugcaaccagaccgugugccagcccacggucuaccugaugggccccauccagaccugccugaccaccaagagcugccuccuggggcugggcgaccagcggauccaggugaacuacgagcgcacguacugcguguccgggcagcucgucgagggcgugugcuucaaccccauccacaccauggcgcugagccagccgucccacaccuacgacaucgugaccaucaugguccggugcuuccuggugaucaagaaggugacgagcggcgacuccaugaagaucgagaagaacuucgagacccucguccagaagaccgggugcaccgccaacggcuuccagggguacuacaucugccugaucggcagcagcuccgagccccuguacgugcccacgcucgacgacuaccgcagcgccgaggugcugucccggauggccuucgcgccccacggcgaggaccacgacaucgagaagaacgccgucagcgcccugcgcaucgccgggaaggugaccggcaaggccccguccaccgagagcuccgacaccgugcaggggaucgcguucagcggcagcccccucuacacgagcaccgggguccugaccgccaaggacgaccccguguacgucugggcccccggcaucaucauggagggcaaccacuccgugugcgagaagaagacccugccgcucacguggaccggguucaucccccugcccggcgagaucgagaagaccacccagugcacgguguucugcacccuggccgggcccggcgccgacugcgaggcguacagcgagaccgggaucuucaacaucuccagcccgaccugccucaucaaccggguccagcgcuuccggggcgccgagcagcagaucaaguucgugugccagcgcguggacauggacaucaccgucuacugcaacggcgugaagaaggugauccugacgaagacccuggucaucgggcagugcaucuacaccuucaccuccaucuucagcaugauccccggcaucgcccacucccucgccguggagcugugcgugcccgggcugcacggcugggccacgguccuccugcugcucaccuucugcuucgggugggugcugauccccaccaucaccaugauccugcugaagauccucaucgcguucgccuaccugugcagcaaguacaacacggacuccaaguuccggauccugguggagaaggucaagaaggaguaccagaagaccaugggcagcauggugugcgaggugugccaguacgagugcgagaccgccaaggagcucgagagccaccgcaaguccugcagcaucggcuccugcccguacugccugaaccccagcgaggccacccccuccgcccugcaggcgcacuucaaggucugcaagcucacgagccgguuccaggagaaccugaagaagucccugaccauguacgagcccaugcaggggugcuaccgcacccucagccuguuccgguaccgcucccgguucuucgugggccugguguggugcaugcuccugguccuggagcucaucgugugggccgccagcgccgagacccagaaccugaacgacggguggacggacaccgcgcacggcuccggcaucaucccgaugaaggccgaccuggagcucgacuucagccugcccuccagcgccuccuacaccuaccgccggcagcugcagaaccccgccaacgagcaggagaagaucccguuccaccuccagaucagcaagcaggucauccacgccgagauccagcaccuggggcacuggauggacgcgaccuucaaccugaagacggccuuccacugcuacggcuccugcgagaaguacgccuaccccuggcagaccgccgggugcuucguggagaaggacuacgaguacgagaccggcugggggugcaacccgcccgacugccccggcgugggcaccgggugcacggccugcggcguguaccucgacaagcugaaguccgucgggaagguguucaagaucgugagccugcgcuacacccgcaaggucugcauccagcucggcaccgggcagaccugcaagacgguggacuccaacgacugccugaucaccaccagcgugaaggucugccugaucggcaccaucuccaaguuccagcccagcgacacgcuccuguuccugggcccccuccagcagggcgggcugaucuucaagcaguggugcaccacgaccugccaguucggggaccccggcgacaucauguccaccccgaccgggaugaagugccccgagcugaacggcagcuuccggaagaagugcgcguucgccaccacccccgugugccaguucgacggcaacaccaucuccggguacaagcgcaugguggccacgaaggacagcuuccaguccuucaacgucaccgagccccacaucagcaccuccgcccucgaguggaucgaccuggacagcucccugcgggaccacaucaacgugaucgugagccgcgaccucuccuuccaggaccugagcgagaccccgugccaggucgaccugacgaccuccgccaccgacggcgcgugggggagcggcgugggguucaaccucgugugcaccgucucccugacggagugcagcgccuuccugaccagcaucaaggccugccacgccgcgaugugcuacggcuccaccaccacgaaccucgugcggggccagaacaccauccacguggucgggaagggcgggcacagcggcuccaaguucaugugcugccacgacaccaagugcagcuccaccggccugguggccgccgcgccccaccuggaccgcgugacgggguucaaccaggccgacagcgacaagaucuucgacgacggcgcccccgagugcgggauguccugcugguucaagaagcucggcgaguggguccugggggugcugaacggcaacuggaugguggucgccgugcucaucgcccugcugauccucagcaucuuccuguucgcccugugcugcccccggcgcccguccuacaagaaggaccacaagcccuga

SEQ ID NO: 11811 - RNA, 3447 nt, Artificial Sequence
  derived and/or modified CDS sequence (opt1) from PUUV(2009)__HE801634.1__GP
augggcaagagcucccccgugugccuguaccucauccugcaggggcugcuccuguucgacaccgucaacgcccgcaaccugaacgagcucaagauggagugcccgcacaccaucggccuggggcagggccuggugguggggagcgucgagcucccgcccgugcccauccagcagaucgagucccugaagcuggagagcuccugcaacuucgaccuccacacgagcaccgccggccagcaguccuucaccaaguggaccugggagacgaagggcgaccuggcggagaacacccaggccagcuccaccagcuuccagaccaaguccagcgaggugaaccugcgggggcucugccugauccccacgcuggucguggagaccgccgcccgcaugcggaagaccaucgccugcuacgaccucuccugcaaccagaccgugugccagcccacggucuaccugaugggccccauccagaccugccugaccaccaagagcugccuccuggggcugggcgaccagcgcauccaggugaacuacgagcggacguacugcguguccgggcagcucgucgagggcgugugcuucaaccccauccacaccauggcgcugagccagccgucccacaccuacgacaucgugaccaucaugguccgcugcuuccuggugaucaagaaggugacgagcggcgacuccaugaagaucgagaagaacuucgagacccucguccagaagaccgggugcaccgccaacggcuuccagggguacuacaucugccugaucggcagcagcuccgagccccuguacgugcccacgcucgacgacuaccggagcgccgaggugcugucccgcauggccuucgcgccccacggcgaggaccacgacaucgagaagaacgccgucagcgcccugcggaucgccgggaaggugaccggcaaggccccguccaccgagagcuccgacaccgugcaggggaucgcguucagcggcagcccccucuacacgagcaccgggguccugaccgccaaggacgaccccguguacgucugggcccccggcaucaucauggagggcaaccacuccgugugcgagaagaagacccugccgcucacguggaccggguucaucccccugcccggcgagaucgagaagaccacccagugcacgguguucugcacccuggccgggcccggcgccgacugcgaggcguacagcgagaccgggaucuucaacaucuccagcccgaccugccucaucaaccgcguccagcgguuccgcggcgccgagcagcagaucaaguucgugugccagcggguggacauggacaucaccgucuacugcaacggcgugaagaaggugauccugacgaagacccuggucaucgggcagugcaucuacaccuucaccuccaucuucagccucauccccggcaucgcccacucccuggccguggagcugugcgugcccgggcuccacggcugggccacgguccugcugcuccugaccuucugcuucgggugggugcugauccccaccaucaccaugauccugcucaagauccugaucgcguucgccuaccugugcagcaaguacaacacggacuccaaguucaagauccucguggagaaggucaagaaggaguaccagaagaccaugggcagcauggugugcgaggugugccaguacgagugcgagaccgccaaggagcuggagagccaccgcaaguccugcagcaucggcuccugcccguacugccugaaccccagcgaggccacccccuccgcccuccaggcgcacuucaaggucugcaagcugacgagccgguuccaggagaaccugaagaagucccucaccauguacgagcccaugcaggggugcuaccgcacccugagccuguuccgguaccgcucccgguucuucgugggccucguguggugcaugcugcugguccucgagcugaucgugugggccgccagcgccgagacccagaaccugaacgcgggguggacggacaccgcccacggcuccggcaucaucccgaugaaggccgaccucgagcuggacuucagccugcccuccagcgccuccuacaccuaccgccggcagcuccagaaccccgccaacgagcaggagaagaucccguuccaccuccagaucagcaagcaggucauccacgcggagauccagcaccuggggcacuggauggacgccaccuucaaccugaagacggccuuccacugcuacggcuccugcgagaaguacgccuaccccuggcagaccgccgggugcuucguggagaaggacuacgaguacgagaccggcugggggugcaacccgcccgacugccccggcgugggcaccgggugcacggcgugcggcguguaccuggacaagcugaaguccgucgggaagguguucaagaucgugagccuccgcuacacccgcaaggucugcauccagcugggcaccgagcagaccugcaagacgguggacuccaacgacugccugaucaccaccagcgugaaggucugccucaucgggaccaucuccaaguuccagcccagcgacacgcugcuguuccucggcccccugcagcagggcgggcugaucuucaagcaguggugcaccacgaccugccaguucggcgaccccggggacaucauguccaccccgaccggcaugaagugccccgagcucaacgggagcuuccggaagaagugcgccuucgccaccacccccgugugccaguucgacggcaacaccaucuccggcuacaagcgcaugguggccacgaaggacagcuuccaguccuucaacgucaccgagccccacaucagcaccuccgcccuggaguggaucgacccggacagcucccugcgggaccacaucaacgugaucgugagccgcgaccucuccuuccaggaccugagcgagacccccugccaggucgaccugacgaccuccgcgaucgacggggccuggggcagcggggugggcuucaaccucgugugcaccgucucccugaccgagugcagcgccuuccugacgagcaucaaggccugcgacgcggccaugugcuacggguccaccaccaccaaccucgugcggggccagaacacgauccacguggucggcaagggcgggcacagcggguccaaguucaugugcugccacgacaccaagugcagcuccaccggccugguggccgccgcgccccaccuggaccgcgugaccggcuucaaccaggccgacagcgacaagaucuucgacgacggggcccccgagugcggcauguccugcugguucaagaagcucggggaguggguccugggcgugcugaacgggaacuggaugguggucgccgugcucaucgcccugcugauccucagcaucuuccuguucgcccugugcugcccgcggcgccccuccuacaagaaggagcacaagcccuga

SEQ ID NO: 11812 - RNA, 3447 nt, Artificial Sequence
  derived and/or modified CDS sequence (opt1) from PUUV(Umea/hu)__AY526218.1__GP
augggcaagcugagccccgugugccucuaccuguuccugcagugccuccugcuguggucccgcgggagcgcccggaaccucaacgagcugaagauggagugcccgcacaccaucggccuggggcagggccucgucaucggguccguggagcugccgcccgugcccguccagcaggucgagagccugaagcucgaguccagcugcaacuucgaccugcacaccuccacggccacccagcagagcuucaccaaguggaccugggagaugaaggacgaccuggcggagaacacgcaggccuccagcaccuccuuccagaccaagagcuccgaggugaaccuccgcggccugugccugaucccgccccucgugguggagaccgccagccggacgcgcaagaccaucgccugcuucgacaucuccugcaaccagaccgugugccagcccaccgucuaccuggugggccccauccagacgugcaucaccaccaagagcugccugcucgggcugggcgaccagcggauccaggugaacuacgagaagaccuacugcgucuccgggcagcugguggagggcgugugcuucaacccgguccacacgauggugcucagccagcccucccacaccuacgacaucgugaccaugaugguccgcugcuuccugguggugaagaaggucaccagcggggacagcaugaagaucgagaagaaccuggagacgcucgugcagaagaccgacugcaacgccaacggcuuccagggcuacuacaucugccuggugggguccagcuccgagccccuguacguccccacccucgacgacuaccggagcgcggaggugcugucccgcauggccuucgccccgcacggcgaggaccacgacaucgagcggaacgccgucagcgcgcugcgcaucguggggaaggugaccggcaaggcccccuccacggaggccagcgacaccauccagggcaucgccuucuccgggagcccccucuacaccuccaccggcguccugacggccaaggacaaccccguguacguguggagcccggggaucaucauggagggcaaccacuccgucugcgagaagaagacccugccccucaccuggaccggguucaucccccugcccggcgagaucggcaagacgagccagugcaccguguucugcacccuggcggggccgggcgccgacugcgaggccuacuccgagaccgggaucuucaacaucagcucccccacgugccucaucaaccgggcccagcgcuuccggggcgccgagcagcagaucaaguucgugugccagcgcgucgacauggacaucaccguguacugcaacgggaugaagaaggugauccugaccaagacccuggucaucggccagugcaucuacaccuucacgagcaucuucucccucauccccggcaucgcgcacagccuggccguggagcugugcgugcccgggcuccacggcugggccaccguccugcugcuccugaccuucugcuucggguggauccugaucccguucaucgccaugaucagccugaagauccucaucgccuucgcguaccugugcuccaaguacaacaccgacagcaaguucaagauccugaucgagaaggugaagaaggaguaccagaagacgaugggcuccauggugugcgaggucugccaguacgagugcgagaccgccaaggagcucgagagccaccggaaguccugccccaucgggagcugccccuacugccugaaccccuccgaggccaccaccagcgcccugcaggcccacuucaaggugugcaagcucacgucccgcgugcaggacaaccugcgcaagagccuggcggccuacgagccgaagcagggcugcuaccggacccucucccuguuccgguaccgcagccgguucuucgucggcuucaucuggugcauccugcucgugcuggagcugaucaucugggccgccuccgcggagacccagaaccucaacagcggguggaccgacacggcccacggcuccgggaucauccccaugcgcaccgaccuggagcuggacuucagccuccccuccagcgccagcuacaccuaccgccggcagcugcagaacccggccaacgagcacgagaagauccccuuccaccuccagaucuccaagcaggucauccacgccgagauccagcaccugggccacuggauggacgcgaccuucaaccugaagacggccuuccacugcuacggcagcugcgagaaguacgccuaccccuggcagaccgccgggugcuucuucgagaaggacuacgaguucgaguccagcuggggcugcaacccgcccgacugccccggggugggcaccgggugcaccgccugcggcguguaccuggacaagcucaaguccgugggcaaggucuucaagaucaucagccugcgcuacacgcggaaggcgugcauccagcuggggaccgagcagaccugcaaguccguggacagcaacgacugccucgugaccacguccgucaaggugugccugaucggcaccgugagcaaguuccagcccuccgacacccuccuguuccuggggccccuggagcagggcgggcucaucuucaagcaguggugcaccacgaccugccaguucggcgaccccggcgacaucaugagcacccccaccgggaugaagugccccgagcugaacggcuccuuccgcaagaagugcgccuucgccacgacccccgucugccaguucgacgggaacaccaucagcggcuacaagcggaugaucgccaccaaggacuccuuccagagcuucaacgugacggacccgcacaucuccaccagcgcccuggaguggaucgaccccgacuccagccuccgcgaccacaucaacguggucgugagccgggaccuguccuuccaggaccugagcgagacccccugccagguggaccucaccaccuccagcaucgacggggcguggggcuccggcgucggguucaaccuggugugcacggugagccugaccgagugcuccaccuuccucaccagcaucaaggccugcgacuccgccaugugcuacggcagcacgaccaucaaccugaugcgcgggcagaacaccguccacaucgugggcaagggcgggcacuccggcagcaaguucaugugcugccacgacaccaagugcuccagcacggggcugguggccgcggcgccccaccucgaccgggucaccggcuucaaccaggccgacuccgacaagaucuucgacgacggggccccggagugcggcaugagcugcugguucaagaaguccggcgaguggauccugggggugcugaacggcaacuggcucguggucgccgugcugguggcccuguucauccucagcaucuuccuguucacccugugcugcccccgccggcccaucuacgccaaggagcacaagcccuga

SEQ ID NO: 11813 - RNA, 3447 nt, Artificial Sequence
  derived and/or modified CDS sequence (opt1) from PUUV(P360)__L08755.1__GP
augggcgagcugagccccgugugccucugccugcugcuccaggggcugcugcucugcaacaccggcgccgcccgcaaccugaacgagcugaagauggagugcccgcacaccauccggcucgggcagggccuggucgugggguccguggagcugcccagccuccccauccagcaggucgagacgcugaagcuggaguccagcugcaacuucgaccuccacaccuccaccgcgggccagcagagcuucaccaaguggacgugggagaucaagggcgaccuggccgagaacacccaggccuccagcaccuccuuccagaccaagagcuccgaggugaaccugcgcgggcucugccugauccccacgcugguggucgagaccgccgcccggaugcgcaagaccaucgcgugcuacgaccucagcugcaaccagaccgugugccagccgacgguguaccugaugggccccauccagaccugcaucaccaccaaguccugccugcucagccugggggaccagcggauccaggucaacuacgagaagacguacugcguguccggccagcugguggaggggaucugcuucaaccccauccacaccauggcccucagccagcccucccacaccuacgacaucaugaccaugaugguccgcugcuuccuggugaucaagaaggugacgagcggcgacuccaugaagaucgagaagaacuucgagacccugguccagaagaacggcugcaccgccaacaacuuccagggguacuacaucugccucaucggcagcagcuccgagccgcuguacgugcccgcccuggacgacuaccggagcgcggaggugcucucccgcauggccuucgcgccccacggggaggaccacgacaucgagaagaacgccgucagcgccaugcggaucgccggcaaggugaccggcaaggcccccuccacggagagcuccgacaccgugcaggggaucgccuucagcggcuccccgcuguacaccagcaccgggguccugacguccaaggacgaccccguguacaucugggcccccggcaucaucauggaggggaaccacagcaucugcgagaagaagacccucccccugaccuggaccggcuucaucucccugccgggcgagaucgagaagacgacccagugcaccguguucugcacccucgccgggcccggcgcggacugcgaggccuacagcgagacggggaucuucaacaucuccagcccgaccugccugaucaaccgcguccagcgguuccgcggcuccgagcagcagaucaaguucgugugccagcgggucgacauggacaucaccguguacugcaacgggaugaagaaggugauccugaccaagacccucgucaucggccagugcaucuacacguucaccagcaucuucucccugauccccggcguggcccacagccuggccguggagcucugcguccccgggcugcacggcugggccaccaugcugcuccugcugaccuucugcuucgggugggugcugauccccacgaucaccaugauccuccugaagauccugaucgcguucgccuaccucugcagcaaguacaacaccgacuccaaguuccgcauccugaucgagaaggugaagcgggaguaccagaagaccaugggcagcauggucugcgaggugugccaguacgagugcgagacggccaaggagcuggagucccaccgcaagagcugcuccaucgggagcugccccuacugccucaaccccuccgaggccaccaccagcgcccugcaggcgcacuucaaggugugcaagcugaccucccgguuccaggagaaccuccgcaagagccugacggucuacgagccgaugcagggcugcuaccggacccugucccucuuccgcuaccggagccgcuucuucgugggccugguguggugcguccugcucgugcuggagcugaucgugugggccgccuccgccgagacccagaaccucaacgcgggguggaccgacacggcccacggcagcgggaucauccccaugaagaccgaccuggagcuggacuucucccuccccagcuccgccagcuacaccuaccgccggcagcugcagaaccccgccaacgagcaggagaagaucccguuccaccuccagcucagcaagcaggucauccacgccgagauccagcaccugggccacuggauggacgcgaccuucaaccugaagacggccuuccacugcuacggcuccugcgagaaguacgccuaccccuggcagaccgccgggugcuucaucgagaaggacuacgaguacgagaccggcugggggugcaacccgcccgacugccccggcguggggaccggcugcacggccugcggcguguaccucgacaagcucaagagcgucgggaagguguucaagaucgugucccugcgcuacacccggaaggucugcauccagcugggcaccgagcagaccugcaagacgguggacagcaacgacugccugaucaccaccuccgugaaggucugccugaucgggaccaucagcaaguuccagcccuccgacacgcuccuguuccugggcccccuccagcagggcgggcugaucuucaagcaguggugcaccacgaccugccaguucggcgacccgggggacaucaugagcacccccaccggcaugaagugccccgagcugaacggguccuuccgcaagaagugcgcguucgccaccacccccgugugccaguucgacggcaacaccaucagcggguacaagcggaugaucgccacgaaggacuccuuccagagcuucaacgugaccgagccgcacaucuccaccagcgcccucgaguggaucgaccccgacuccagccugcgcgaccacaucaacgucaucgugucccgggaccugagcuuccaggaccucuccgagacccccugccagaucgaccuggccacggcgagcaucgacggcgccuggggcagcggggugggcuucaaccuggucugcaccgugucccucaccgagugcagcgccuuccugaccuccaucaaggccugcgacgcggccaugugcuacgggagcacgaccgccaaccuggugcgcggccagaacaccauccacaucgucgggaagggcggccacuccgggagcaaguucaugugcugccacgacaccaagugcuccagcacgggccucguggccgccgcgccccaccuggaccgggugaccggguacaaccaggccgacuccgacaagaucuucgacgacggcgccccggagugcggcaugagcugcugguucaagaaguccggggaguggauccugggcguccucaacgggaacuggauggugguggccguccugguggugcugcucauccugagcauccugcuguucacccugugcugcccccgccggcccuccuaccgcaaggagcacaagcccuga

SEQ ID NO: 11814 - RNA, 3447 nt, Artificial Sequence
  derived and/or modified CDS sequence (opt1) from MUV(11-1)__JX028272.1__GP
augggcaagaucagccccguguaccuguaccuccuguuccaggggcugcuccuguggcgcgacggccuggcccggaaccucaacgagcugaagauggagugcccgcacaccaucgggcugggccaggggcucgucaucggcuccguggagcugccgcccgugccccugcgccaggucgagagccucaagcuggaguccagcugcaacuucgaccugcacaccuccacggccacccagcagagcuucaccaaguggaucugggaguccaagaacgaccucaccgacagcacgcaggcguccagcaccuccuaccagaccaagagcaccgaggugaaccugaagggccugugccucgugcccacgcuggucaucgagaccgccgcccggacccgcaagaccaucgccugcuucgaccuguccugcaaccagacggugugccagcccaccguguaccucaucgggcccauccagaccugcaucaccaccaagagcugccugaucggccugggggaccagcggauccaggucaacuacgagaagaccuacugcguguccggccagcucguggagggggucugcuucaaccccauccacaccauggcccugagccagccgucccacaccuacgacguggugacgaugaugguccgcugcuuccugguggugaagaaggucaccagcggcgacuccaugaagaucgagaagaacuucgagacccucgugcagaagaccggcugcagcaacaacaacuuccagggguacuacgugugccugaucggcagcuccagcgagccccuguacguccccacgcucgacgacuaccgguccgcggagauccugagccgcauggccuucgcgccccacggggaggaccacgacaucgagcggaacgccaucuccgccaugcgcaucgugggcaaggugaccggcaaggccccgagcuccgagagcuccgacaccguccaggggguggccuucagcggcaacccccuguacaccuccacggggguccucaccagcaaggacgaccccguguacgugugggcccccggcaucaucauggaggggaaccacuccgucugcgacaagaagacccugccgcugaccuggacgggcuacaucccccuccccggcgagaucgagaagaccacccagugcaccguguucugcacgcuggccgggcccggcgcggacugcgaggccuacagcgagaccgggaucuucaacaucuccagcccgaccugccugaucaaccgggugcagcgcuuccggggcgccgagcagcagaucaaguucgucugccagcgcguggacauggacaucaccguguacugcaacgggaucaagaaggucauccucaccaagacgcuggugaucggccagugcaucuacaccuucaccuccaucuucagccugaugcccggcguggcccacucccucgccgucgagcugugcgugcccgggcugcacggcugggcgaccaugcuccugcugcucacguucugcuucggguggauccugauccccaccaucacccugauccugcucaagauccugcuggccuucgccuacgugugcagcaaguacaacaccgacagcaaguucaagauccucaucgagaaggucaagcaggaguaccagaagacgaugggcuccauggugugcgaggugugccagcacgagugcgagaccgccaaggagcuggagagccacaagaaguccugcccgaucgggagcugccccuacugccugaaccccgccgaggcgaccaccuccgcccuccaggcccacuucaaggucugcaagcugacgagccgguuccaggagaaccugcgcaagucccucaccguguacgagcccaagcagggcugcuaccggacccugagccuguuccgcuaccggucccgcugcuucgugggccucaucuggugcauccugcugacccucgagcugaucgucugggccgccagcgcggagacgcugaaccucaacccgggguggaccgacaccgcccacggcuccgggaucgugcccaugaagaccgaccuggagcuggacuucagccuccccuccagcgccuccuacacguaccggcgcagccugcagaacccggccaacgagcaggagcagguccccuuccaccuccagaucgagaagcaggucauccacgcggagauccagcaccugggccacuggauggacgccaccuucaaccugaagaccgccuuccacugcuacggcgccugcgagaaguacgccuaccccuggcagaccgcggggugcuucguggagaaggacuucgaguucgagaacggcugggggugcaacccgcccgacugccccggcguggggacgggcugcaccgccugcggcgccuaccuggacaagcucaaguccguggggaagguguucaagaucgugagccugcgcuacacccggaaggccugcauccagcugggcaccgagcagacgugcaagaacgucgacagcaacgacugccucgugaccaccuccgugaaggucugccugaucgggaccaucagcaaguuccagcccuccgacacgcuccuguuccugggcccccuggagcagggcgggaucaucuucaagcaguggugcaccacgaccugccaguucggcgacccgggggacaucaugagcacgcccaucggcaugaagugccccgagcucaacggguccuuccgcaagaagugcagcuucgccaccacccccgugugccaguucgacggcaacaccaucuccggguacaagcggaugaucgcgaccaaggacagcuuccaguccuucaacgugacggagccgcacaucagcgccuccgcccuggaguggaucgaccccgacagcucccugcgcgaccacaucaacgucguggugggccgggaccuccccuuccaggaccugagcgagacccccugccagaucgaccuguccaccagcuccaucgacggcgccugggggagcggcgucggguucaaccucgugugcuccgugagccugaccgagugcuucacguuccugaacagcaucaaggccugcgacaccgcgaugugcuacggcuccaccaccgccaaccucguccgcgggcagaacacggugcacguggucggcaagggcgggcacagcggcuccaaguucaugugcugccacgacaccaagugcagcaacaccgggcugcuggccgccgcgccgcaccucgaccgggugaccggcuacaaccaggccgacuccgacaagguguucgacgacggcgcccccgagugcgggaugacgugcugguucaagaaguccggcgaguggaucauggggguccugagcggcaacuggauggugguggccguccugaucacccuccuggugcugagcaucuuccucuucgcccugugcugcccccgccgggcggccuacaagaaggagcacaagcccuga

SEQ ID NO: 11815 - RNA, 3447 nt, Artificial Sequence
  derived and/or modified CDS sequence (opt1) from MUV(11-4)__JX046483.1__GP
augggcaagaucagccccguguaccugugccuccugcugcaggggcuccugcuguggcgcgacggccucgcccggaaccugaacgagcugaagauggagugcccgcacaccaucgggcucggccaggggcuggucaucggcuccguggagcugccgcccgugccccuccgccaggucgagagccugaagcuggaguccagcugcaacuucgaccuccacaccuccacggccacccagcagagcuucaccaaguggaucugggaguccaagaacgaccugaccgacagcacgcaggcguccagcaccuccuaccagaccaagagcaccgaggugaaccugaagggccucugccuggugcccacgcuggucaucgagaccgccgcccggacccgcaagaccaucgccugcuucgaccucuccugcaaccagacggugugccagcccaccguguaccugaucgggcccauccagaccugcaucaccaccaagagcugccugaucggccucggggaccagcggauccaggucaacuacgagaagaccuacugcguguccggccagcugguggagggggucugcuucaaccccauccacaccauggcccugagccagccgucccacaccuacgacguggugacgaugaugguccgcugcuuccucguggugaagaaggucaccagcggcgacuccaugaagaucgagaagaacuucgagacccuggugcagaagaccggcugcagcaacaacaacuuccagggguacuacgugugccugaucggcagcuccagcgagccccucuacguccccacgcuggacgacuaccgguccgcggagauccugagccgcauggccuucgcgccccacggggaggaccacgacaucgagcggaacgccaucuccgccaugcgcaucgugggcaaggugaccggcaaggccccgagcuccgagagcuccgacaccguccaggggaucgccuucagcggcaacccccucuacaccuccacgggggugcugaccagcaaggacgaccccgucuacgugugggcccccggcaucaucauggaggggaaccacuccgugugcgacaagaagacccugccgcucaccuggacgggcuacaucccccugcccggcgagaucgagaagaccacccagugcaccgucuucugcacgcuggccgggcccggcgcggacugcgaggccuacagcgagaccgggaucuucaacaucuccagcccgaccugccucaucaaccgggugcagcgcuuccggggcgccgagcagcagaucaaguucgugugccagcgcgucgacauggacaucaccguguacugcaacgggaucaagaaggugauccugaccaagacgcuggucaucggccagugcaucuacaccuucaccuccaucuucagccucaugcccggcguggcccacucccuggccguggagcugugcguccccgggcuccacggcugggcgaccaugcugcugcuccugacguucugcuucggguggauccugauccccaccaucacccugauccuccugaagauccugcucgccuucgccuacgugugcagcaaguacaacaccgacagcaaguucaagauccugaucgagaaggugaagcaggaguaccagaagacgaugggcuccauggucugcgaggugugccagcacgagugcgagaccgccaaggagcuggagagccacaagaaguccugcccgaucgggagcugccccuacugccucaaccccgccgaggcgaccaccuccgcccugcaggcccacuucaaggugugcaagcugacgagccgguuccaggagaaccuccgcaagucccugaccgucuacgagcccaagcagggcugcuaccggacccugagccucuuccgcuaccggucccgcugcuucgugggccugaucuggugcauccugcucacccuggagcugaucgugugggccgccagcgcggagacgcucaaccugaacccgggguggaccgacaccgcccacggcuccgggaucguccccaugcggaccgaccuggagcucgacuucagccugcccuccagcgccuccuacacguaccgccgcagccugcagaacccggccaacgagcaggagcagauccccuuccaccuccagaucgagaagcaggucauccacgcggagauccagcaccugggccacuggauggacgccaccuucaaccugaagaccgccuuccacugcuacggcgccugcgagaaguacgccuaccccuggcagaccgcggggugcuucguggagaaggacuucgaguucgagaacggcugggggugcaacccgcccgacugccccggcguggggacgggcugcaccgccugcggcgccuaccucgacaagcugaaguccguggggaagguguucaagaucgucagccugcgguacacccgcaaggccugcauccagcucggcaccgagcagacgugcaagaacguggacagcaacgacugccuggugaccaccuccgucaaggugugccugaucgggaccaucagcaaguuccagcccuccgacacgcuccuguuccugggcccccucgagcagggcgggaucaucuucaagcaguggugcaccacgaccugccaguucggcgacccgggggacaucaugagcacgcccaucggcaugaagugccccgagcugaacggguccuuccggaagaagugcagcuucgccaccacccccgugugccaguucgacggcaacaccaucuccggguacaagcgcaugaucgcgaccaaggacagcuuccaguccuucaacgucacggagccgcacaucagcgccuccgcccuggaguggaucgaccccgacagcucccuccgggaccacaucaacgugguggucggccgcgaccugcccuuccaggaccugagcgagacccccugccagaucgaccucuccaccagcuccaucgacggcgccugggggagcggcgugggguucaaccuggugugcuccgucagccugaccgagugcagcacguuccucaccuccaucaaggccugcgacaccgcgaugugcuacggcagcaccacggccaaccuggugcgggggcagaacaccgugcacgucgugggcaagggcgggcacuccggcagcaaguucgugugcugccacgacaccaagugcuccaacaccgggcugcucgccgccgcgccgcaccuggaccgcgucacgggcuacaaccaggccgacagcgacaagguguucgacgacggcgcccccgagugcgggaugaccugcugguucaagaaguccggcgaguggaucaugggggugcugagcggcaacuggauggucguggccgugcucaucacccugcugguccucuccaucuuccuguucgcccugugcugcccccggcgcgcggccuacaagaaggagcacaagcccuga

SEQ ID NO: 11816 - RNA, 3447 nt, Artificial Sequence
  derived and/or modified CDS sequence (opt1) from MUV(11-5)__JX046486.1__GP
augggcaagaucagccccguguaccugugccuccugcugcaggggcuccugcuguggcgcgacggccucgcccggaaccugaacgagcugaagauggagugcccgcacaccaucgggcucggccaggggcuggucaucggcuccguggagcugccgcccgugccccuccgccaggucgagagccugaagcuggaguccagcugcaacuucgaccuccacaccuccacggccacccagcagagcuucaccaaguggaucugggaguccaagaacgaccugaccgacagcacgcaggcguccagcaccuccuaccagaccaagagcaccgaggugaaccugaagggccucugccuggugcccacgcuggucaucgagaccgccgcccggacccgcaagaccaucgccugcuucgaccucuccugcaaccagacggugugccagcccaccguguaccugaucgggcccauccagaccugcaucaccaccaagagcugccugaucggccucggggaccagcggauccaggucaacuacgagaagaccuacugcguguccggccagcugguggagggggucugcuucaaccccauccacaccauggcccugagccagccgucccacaccuacgacguggugacgaugaugguccgcugcuuccucguggugaagaaggucaccagcggcgacuccaugaagaucgagaagaacuucgagacccuggugcagaagaccggcugcagcaacaacaacuuccagggguacuacgugugccugaucggcagcuccagcgagccccucuacguccccacgcuggacgacuaccgguccgcggagauccugagccgcauggccuucgcgccccacggggaggaccacgacaucgagcggaacgccaucuccgccaugcgcaucgugggcaaggugaccggcaaggccccgagcuccgagagcuccgacaccguccaggggaucgccuucagcggcaacccccucuacaccuccacgggggugcugaccagcaaggacgaccccgucuacgugugggcccccggcaucaucauggaggggaaccacuccgugugcgacaagaagacccugccgcucaccuggacgggcuacaucccccugcccggcgagaucgagaagaccacccagugcaccgucuucugcacgcuggccgggcccggcgcggacugcgaggccuacagcgagaccgggaucuucaacaucuccagcccgaccugccucaucaaccgggugcagcgcuuccggggcgccgagcagcagaucaaguucgugugccagcgcgucgacauggacaucaccguguacugcaacgggaucaagaaggugauccugaccaagacgcuggucaucggccagugcaucuacaccuucaccuccaucuucagccucaugcccggcguggcccacucccuggccguggagcugugcguccccgggcuccacggcugggcgaccaugcugcugcuccugacguucugcuucggguggauccugauccccaccaucacccugauccuccugaagauccugcucgccuucgccuacgugugcagcaaguacaacaccgacagcaaguucaagauccugaucgagaaggugaagcaggaguaccagaagacgaugggcuccauggucugcgaggugugccagcacgagugcgagaccgccaaggagcuggagagccacaagaaguccugcccgaucgggagcugccccuacugccucaaccccgccgaggcgaccaccuccgcccugcaggcccacuucaaggugugcaagcugacgagccgguuccaggagaaccuccgcaagucccugaccgucuacgagcccaagcagggcugcuaccggacccugagccucuuccgcuaccggucccgcugcuucgugggccugaucuggugcauccugcucacccuggagcugguggucugggccgccagcgcggagacgcucaaccugaacccgggguggaccgacaccgcccacggcuccgggaucgugcccaugcggaccgaccuggagcucgacuucagccugcccuccagcgccuccuacacguaccgccgcagccugcagaacccggccaacgagcaggagcagauccccuuccaccuccagaucgagaagcaggucauccacgcggagauccagcaccugggccacuggauggacgccaccuucaaccugaagaccgccuuccacugcuacggcgccugcgagaaguacgccuaccccuggcagaccgcggggugcuucguggagaaggacuucgaguucgagaacggcugggggugcaacccgcccgacugccccggcguggggacgggcugcaccgccugcggcgccuaccucgacaagcugaaguccguggggaaggucuucaagaucgugagccugcgguacacccgcaaggccugcauccagcucggcaccgagcagacgugcaagaacguggacagcaacgacugccuggucaccaccuccgugaaggugugccugaucgggaccaucagcaaguuccagcccuccgacacgcuccuguuccugggcccccucgagcagggcgggaucaucuucaagcaguggugcaccacgaccugccaguucggcgacccgggggacaucaugagcacgcccaucggcaugaagugccccgagcugaacggguccuuccggaagaagugcagcuucgccaccacccccgucugccaguucgacggcaacaccaucuccggguacaagcgcaugaucgcgaccaaggacagcuuccaguccuucaacgugacggagccgcacaucagcgccuccgcccuggaguggaucgaccccgacagcucccuccgggaccacaucaacguggucgugggccgcgaccugcccuuccaggaccugagcgagacccccugccagaucgaccucuccaccagcuccaucgacggcgccugggggagcggcgugggguucaaccuggucugcuccgugagccugaccgagugcagcacguuccucaccuccaucaaggccugcgacaccgcgaugugcuacggcagcaccacggccaaccuggugcgggggcagaacaccguccacguggugggcaagggcgggcacuccggcagcaaguucgucugcugccacgacaccaagugcuccaacaccgggcugcucgccgccgcgccgcaccuggaccgcgugacgggcuacaaccaggccgacagcgacaagguguucgacgacggcgcccccgagugcgggaugaccugcugguucaagaaguccggcgaguggaucauggggguccugagcggcaacuggauggugguggccguccucaucacccugcuggugcucuccaucuuccuguucgcccugugcugcccccggcgcgcggccuacaagaaggagcacaagcccuga

SEQ ID NO: 11817 - RNA, 3408 nt, Artificial Sequence
  derived and/or modified CDS sequence (opt1) from SANGV(SA14)__NC_034516.1__GP
augaucauguggggccugcuccugcuggccgccaucaccuuccccugccagagccucaagaacguguacgacaugaagaucgagugcccgcacuccgucaacuucggggagagcuccgugaugggcaaggugcagcugcccagccuguccaucaccgaggccgagcagcucguccccgagagcuccugcaacauggacaaccaccagagccuguccgugcugcagaaggccacgaagaccaccuggcgcaagaaggccgaccacagcaacgccgggaaggacuccuacgagcucaucaccagcgagauccaguucaagggcgugugcucccugacgcacaagaugaucgaggagagccaccggcugcgccgguccgucaucugcuacgaccucagcugcaacaccacccacugcaagcccacccuguacaugguggugccgguccacuccugcaacaugaugaaguccugccugaucgggcucggccccuaccgcauccaggugguguacgagcggacguacugcaccgucggcgugcugaacgaggggaagugcuucgugcccgaccaguccgucgccaacaucgugaagaacggcaucuucgacaucgugagcguccagaucaucugcuucuucauccgcaucaaggggagcaccuacaagauccuggagaccgugaagacggccaugaacggcaagugcaacgggaccgacgacaaggugcagggcuacuacaucugccuccugggcgggaacuccggccccaucuacgucccgagcgggaccgacuuccgggccauggaggcccuggccaacaugcuccgcgcgccccacggcgaggaccacgaccugcccggcgaggagcuggccuccuacagcaucgccgggaccaucgagggcaagaucccccacacggccuccagccagaaccucgaguucaccgccuacuccgggaucccgagcuacuccagcuucuccgugcacacccugacccaggacggccagcugagcuacucccccggccucuuccccaaccugaaccagagcgacugcaagaagaacgcgcugccccucaucugggaggggacgaucgagcugccgggcuacuacgaggccauccaccccugcaacguguucugcgucuucuccgggcccggcgccagcugcgaggccuucuccgagggcgggaucuucaacaucaccagcccgaccugccugguguccaagcagaaccgguuccgcgccgcggagcagcagaucaccuucgucugccagcggguggacauggacaucaucaucuacugcaacgggcagcgcaaggugauccucacgaagacccuggucaucggccagugcaucuacagcaucaccagccuguucucccuccugcccagcguggcccacuccaucgccaucgagcugugcgugcccggcuuccacgggugggccaccgccgcgcuccugacgaccuucugcuucggcuggcugcucauccccagcaucaccuacaucguccugcugauccucaaguucaucgccgccaucuuccacaacaccacgcaggagaacaaguucaaggccauccugcggaagaucaaggaggaguucgagaagaccaagggguccauggugugcgacaucugcaaguacgagugcgagaccggcaaggagcugaaggcccacaaccucagcugcaaccagucccagugccccuacugcuucacccacugcgagaugacggagagcgcguuccaggcccacuacaaggugugccaggccacccaccgcuuccgggaggaccugaagaagaccaucaccccgcagaccaucucccccgggugcuaccgcacgcugaaccuguuccgguacaagagccgcugcuacauccucaccgucuggcugugccugcucauccuggaguccaucgccugggcggccagcgccuccgagaccagccugaacccccucuggaccgacaacgcccacggcgugggcuccgugcccaugcacacggaccuggagcuggacuucagccucccguccagcagcaaguacaccuacaagcggaagcugaccucccccaccaaccccgagcaggccgucagccugcacaucgagaucgagucccaggggaucgcggccgacgugcacagccucggccacugguacgacgcccgccugaaccugaagacguccuuccacugcuacggggccugcaccaaguaccaguacccguggcacaccgccaagugccacuucgagcacgacuuccaguacgagaacagcuggggcugcaacccgcccgacugccccggcguggggaccggcugcacggcgugcgggcucuaccuggaccagcugaagcccgucggcuccgccuacaagcucaucaccgugcgguacagccgcaaggugugcguccaguucggggaggagaaccugugcaagaccaucgacaugaacgacugcuucaugucccgccacgugaaggugugcaucaucggcaccgucagcaaguucucccagggcgacacgcugguguuccucgggccccuggagggcgggggccugaucuucaaggacuggugcaccagcacgugccaguacggggaccccggcgacaucaugagcccccgggaccgcggcuucagcugcccggaguuccccggguccuuccggaagaagugcaacuucgccaccacccccgugugcgaguacagcggcaacauggucuccggguacaagaaggugauggccaccaucgacagcuuccaguccuucaacaccagccucauccacuucaccgaggagcgcaucgaguggaaggaccccgacggcaugcugcgggaccaccugaacauccucgugacgaaggacaucgacuucgagaaccugggggagaacccgugcaaggucggccugcagaccagcuccaucgagggcgccugggggagcggcgugggguucacccucgugugccaggucucccugaucgacugcgcgcgcuuccugaccagcaucaaggccugcgacauggccaucugcuacggcgcccaguccgugagccucgugcgggggcagaacacggucaagaucaccggcaagggcgggcacuccggcagcuccuucaagugcugccacgagguggacugcagcuccaccgggcugcaggcgagcgcgccccaccuggacaaggugaacggcaucuccgagcaggagaacgacaaggucuacgacgacggcgcgccccagugcggggugagcugcugguucgugaaguccggcgaguggaucagcgggauccuccacggcaacugggucgugguggucgugcuggugauccugcuccuguucucccugauccuccugagcauccugugccccguccgcaagcacaagcgguccuga

SEQ ID NO: 11818 - RNA, 3408 nt, Artificial Sequence; identical to SEQ ID NO: 11817
  derived and/or modified CDS sequence (opt1) from SANGV(SA14)__NC_034516.1__GP

SEQ ID NO: 11819 - RNA, 3402 nt, Artificial Sequence
  derived and/or modified CDS sequence (opt1) from SEOV(L99)__AF288298.1__GP
auguggagccugcuccugcuggccgcccucgugggccagggguucgcccugaagaacgucuucgacaugcgcauccagugcccccacuccgugaacuucggcgagaccagcguguccggguacaccgagcugccgccccucagccugcaggaggccgagcagcugguccccgaguccagcugcaacauggacaaccaccagucccucagcacgaucaacaagcugaccaaggugguguggcggaagaaggccaaccaggagcuggccaaccagaacuccuucgaggucguggagagcgagguguccuucaagggccucugcaugcugaagcaccgcauggucgaggagagcuaccggaaccgccgguccgugaucugcuacgaccuggccugcaacagcaccuucugcaagcccaccguguacaugaucgucccgauccacgcgugcaacaugaugaaguccugccucaucgggcugggccccuaccgcauccaggugguguacgagcggacguacugcaccaccggcauccugaccgaggggaagugcuucguccccgacaaggccguggugagcgcccucaagcgcggcauguacgccaucgcguccaucgagacgaucugcuucuucauccacaagaaggggaacaccuacaagaucgucaccgccaucaccagcgccaugggcuccaagugcaacaacacggacaccaaggugcagggguacuacaucugcaucaucggcggcaacagcgcccccguguacgccccggcgggggaggacuuccgggccauggaggucuucagcggcaucaucaccagcccccacggggaggaccacgaccugcccggcgaggagaucgccaccuaccagaucagcggccagaucgaggccaagaucccccacacgguguccagcaagucccugaagcucaucgccuucgcggggaucccgagcuacuccagcaccuccauccuggccgccagcgaggacggccgcuucaucuucucccccgggcuguuccccaaccucaaccagagcgugugcgacaacaacgcccugccccugaucuggcggggccucaucgaccugaccggguacuacgaggccguccacccgugcaacguguucugcguccuguccggccccggcgcgagcugcgaggccuucuccgagggcgggaucuucaacaucaccagccccaugugccucguguccaagcagaaccgcuuccgggccgccgagcagcagaucagcuucaucugccagcgcguggacauggacaucaucgucuacugcaacgggcagaagaagacgauccugaccaagacccuggugaucggccagugcaucuacaccaucacgucccucuucagccugcugcccgggguggcccacagcaucgcgaucgagcucugcgucccgggcuuccacggcugggccaccgccgcccugcugaucaccuucugcuucgggugggugcucauccccgcgugcacccuggccauccugcucgugcugaaguucuucgccaacauccugcacacguccaaccaggagaaccgguucaaggccauccuccgcaagaucaaggaggaguucgagaagaccaagggcagcauggucugcgagaucugcaaguacgagugcgagacccugaaggagcugaaggcccacaaccucuccugcgugcagggggagugccccuacugcuucacccacugcgagcccacggagaccgcgauccaggcccacuacaaggugugccaggccacccaccgguuccgcgaggaccugaagaagaccgucacgccgaagaacaucggccccgggugcuaccggacccugaaccuguuccgcuacaagagccggugcuacauccucaccauguggacccugcugcucaucaucgaguccauccugugggccgccagcgcggccgagaucccccuggugccccucuggaccgacaacgcccacggcgugggcuccgucccgaugcacacggaccuggagcuggacuucagccuccccuccagcuccaaguacgccuacaagcgccaccugaccaaccccgugaacgaccagcagagcgugucccugcacaucgagaucgagagccaggggaucggcgccgacguccaccaccucgggcacugguacgacgcgcgccugaaccugaagaccuccuuccacugcuacggcgccugcaccaaguaccaguacccguggcacacggccaagugccacuucgagaaggacuacgaguacgagaacagcugggccugcaacccgcccgacugccccggcguggggaccggcugcaccgcgugcgggcucuaccuggaccagcugaagcccgugggcaccgccuucaagaucaucuccguccgguacagccgcaaggugugcgugcaguucggggaggaguaccucugcaagacgaucgacaugaacgacugcuucgucacccggcacgccaagaucugcaucaucggcaccgugagcaaguucucccagggcgacacccugcuguuccucgggcccauggagggcgggggcaucaucuucaagcacuggugcacgagcacgugccacuucggggaccccggcgacgugaugggccccaaggacaagccguucuccugccccgaguuccccgggcaguuccgcaagaagugcaacuucgccaccacccccaucugcgaguacgacggcaacaucaucagcggguacaagaagguccuggccaccaucgacuccuuccagagcuucaacaccuccaacauccacuucaccgacgagcggaucgaguggcgcgacccggacggcaugcugcgggaccacaucaacaucgugaucagcaaggacaucgacuucgagaaccucgcggagucccccugcaagguggggcugcaggccgccaacaucgagggcgccuggggcagcggggucggcuucacccugacgugccaggugucccucaccgagugccccaccuuccugaccagcaucaaggccugcgacauggcgaucugcuacggggccgaguccgugacgcugagccgcggccagaacaccguccggaucaccgggaagggcggccacuccgggagcuccuucaagugcugccacggcaaggagugcagcuccaccgggcuccaggccagcgcgccccaccuggacaaggugaacggcaucagcgagcuggagaacgagaagguguacgacgacggcgccccggagugcggggucacgugcugguucaagaaguccggcgagugggugauggggaucaucaacggcaacugggugguccucaucgugcugugcgugcugcuccuguucagccugauccuccuguccauccugugccccguccgcaagcacaagaaguccuga

SEQ ID NO: 11820 - RNA, 3402 nt, Artificial Sequence
  derived and/or modified CDS sequence (opt1) from SEOV(Rn10-134)__JF693883.2__GP
auguggagccugcuccugcuggccgcccucgugggccagggguucgcccugaagaacgucuucgacaugcgcauccagugcccccacuccgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgagguggucgaguccgaggugagcuucaagggccugugcaugcucaagcaccgcaugguggaggaguccuaccggaaccgccggagcgucaucugcuacgaccuggccugcaacuccaccuucugcaagcccaccguguacaugaucgugccgauccacgcgugcaacaugaugaaguccugccugaucgggcucggccccuaccgcauccaggucguguacgagcggacguacugcaccaccggcauccugaccgaggggaagugcuucgugcccgacaaggccgucgugagcgcccugaagcgcggcauguacgccaucgcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggucagcuccaagaaccugaagcugaccgccuucgcggggaucccgagcuacuccagcaccuccauccucgccgccagcgaggacggccgcuucaucuucucccccgggcuguuccccaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucacgagccccaugugccuggucuccaagcagaaccgcuuccgggccgccgagcagcagaucagcuucgugugccagcgcguggacauggacaucaucgucuacugcaacgggcagaagaagaccauccucaccaagacccuggugaucggccagugcaucuacacgaucaccucccuguucagccuccugcccgggguggcccacagcaucgcgaucgagcugugcgucccgggcuuccacggcugggccaccgccgcccuccugaucaccuucugcuucgggugggugcugauccccgcgugcacgcucgccauccugcuggugcucaaguucuucgccaacauccugcacaccuccaaccaggagaaccgguucaaggccauccugcgcaagaucaaggaggaguucgagaagaccaagggcagcauggucugcgagaucugcaaguacgagugcgagacccucaaggagcugaaggcccacaaccuguccugcgugcagggggagugccccuacugcuucacgcacugcgagcccaccgagaccgcgauccaggcccacuacaaggugugccaggccacccaccgguuccgcgaggaccucaagaagacggucaccccgcagaacaucggccccgggugcuaccggacccugaaccuguuccgcuacaagagccggugcuacauccugaccauguggacccuccugcugaucaucgaguccauccucugggccgccagcgcgguggagaucccccuggugccccuguggacggacaacgcccacggcgucggcuccgugccgaugcacaccgaccucgagcuggacuucagccugcccuccagcucccgcuacaccuacaagcgccaccucaccaaccccgugaacgaccagcagagcgucucccugcacaucgagaucgagagccaggggaucggcgccgacgugcaccaccuggggcacugguacgacgcccggcucaaccugaagacguccuuccacugcuacggcgccugcaccaaguaccaguacccguggcacaccgcgaagugccacuucgagaaggacuacgaguacgagaacagcugggccugcaacccgcccgacugccccggcguggggaccggcugcacggccugcgggcuguaccucgaccagcugaagcccgucggcaccgccuucaagaucaucuccgugcgcuacagccggaaggugugcguccaguucggggaggaguaccugugcaagaccaucgacaugaacgacugcuucgugacccgccacgcgaagaucugcaucaucggcacggugagcaaguucucccagggcgacacccuccuguuccuggggcccauggagggcgggggcaucaucuucaagcacuggugcaccagcacgugccacuucggggaccccggcgacgucaugggccccaaggacaagccguucaucugccccgaguuccccgggcaguuccggaagaagugcaacuucgccaccacccccgugugcgaguacgacggcaacaucaucuccggguacaagaaggugcucgccaccaucgacagcuuccaguccuucaacaccagcaacauccacuucacggacgagcgcaucgaguggcgggacccggacggcaugcugcgcgaccacaucaacaucgucaucuccaaggacaucgacuucgagaaccuggccgagaaccccugcaagguggggcuccaggccgcgaacaucgagggcgccuggggcagcggggugggcuucacccugaccugccaggucucccugaccgagugccccacguuccucaccagcaucaaggccugcgacauggccaucugcuacggggccgaguccgugacccugagccggggccagaacaccgugaagaucacggggaagggcggccacuccgggagcuccuucaagugcugccacggcaaggagugcagccugaccgggcuccaggcguccgcgccccaccuggacaaggucaacggcaucagcgagcuggagaacgagaagguguacgacgacggcgccccggagugcgggaucacgugcugguucaagaaguccggcgagugggugauggggaucaucaacggcaacugggucgugcucaucgugcugugcguccugcuccuguucagccugauccuccugagcauccugugccccgugcgcaagcacaagaaguccuga

SEQ ID NO: 11821 - RNA, 3402 nt, Artificial Sequence
  derived and/or modified CDS sequence (opt1) from SEOV(Gou3-e5)__AF288650.1__GP
auguggggccugcuccugcuggccgcccucguggggcagggccuggcgcugaagaacgucuucgacaugaagauccagugcccccacagcgugaacuucggggagaccagcgugagcggcuacaccgagcucccgccccugccccugcaggaggccgagcagcucguccccgaguccagcugcaacauggacaaccaccagucccugagcaccaucaacaagcugaccaaggugaucuggcgcaagaaggccaaccaggaguccgccagccagaacuccuucgagguggucgagaacgaggugagcuucaaggggcucugcaugcugaagcaccggaugguggaggaguccuaccgcaaccggcgcagcgucaucugcuacgaccuggccugcaacaccaccuucugcaagccgacgguguacaugaucgugcccauccacgcgugcaacaugaugaaguccugccucaucggccugggccccuaccggauccaggucaucuacgagcgcaccuacugcaccaccgggauccugacggagggcaagugcuucgugcccgacaaggccguggucagcgcccucaagcgggggauguacgccaucgcguccaucgagaccaucugcuucuucgugcaccagaagggcaacaccuacaagaucgugagcgccaucaccuccgccauggggagcaagugcaacaacacggacuccaagguccagggcuacuacaucugcaucaucggcgggaacagcgccccgguguacgcccccgcgggcgaggacuuccgcgccauggagguguucagcgggaucaucaccagcccccacggcgaggaccacgaccugcccggcgaggagaucgccaccuaccagaucagcgggcagaucgaggccaagaucccgcacaccgucuccagcaagaaccugaagcucacggccuucgcgggcauccccuccuacagcuccaccagcauccuggccgccuccgaggacgggcgguucaucuucagccccggccuguuccccaaccucaaccaguccgugugcgacaacaacgcccugccgcugaucuggcgcgggcucaucgaccugaccggcuacuacgaggccauccaccccugcaacguguucugcguccugagcggccccggggcguccugcgaggccuucagcgagggcgggaucuucaacaucaccucccccaugugccucgugagcaagcagaaccgguuccgcgccgccgagcagcagaucuccuucaucugccagcgggucgacauggacaucgugguguacugcaacggccagaagaagacgauccugaccaagacccuggucaucgggcagugcaucuacaccaucacgagccucuucucccugcugccgggcguggcccacagcaucgcgaucgagcucugcgugcccggcuuccacgggugggccaccgccgcccugcuggucaccuucugcuucggcugggugcucauccccgcgugcacccuggccgugcuccuguuccugaaguucuucgccaacauccugcacacgagcaaccaggagaaccgcuucaaggccauccuccggaagaucaaggaggaguucgagaagaccaagggguccauggucugcgagaucugcaaguacgagugcgagacccugaaggagcugaaggcccacaaccucagcugcgugcagggcgagugccccuacugcuucacccacugcgagccgacggagaccgcgauccaggcccacuacaaggugugccaggccacccaccgcuuccgggaggaccugaagaagaccgucacgccccagaacaucgggcccggcugcuaccgcacccugaaccuguuccgguacaagucccgcugcuacauccucaccauguggauccugcugcucgugaucgagagcauccugugggccgccuccgcggccgagaucccccuggugccgcucuggaccgacaacgcccacggcgucgggagcgugcccaugcacaccgaccuggagcuggacuucucccuccccagcuccagcaaguacacguacaagcggcaccugaccaacccggugaacgaccagcaguccgucagccugcacaucgagaucgagucccagggcaucggggccgacgugcaccaccucggccacugguacgacgcccgccugaaccugaagaccagcuuccacugcuacggcgcgugcaccaaguaccaguaccccuggcacacggccaagugccacuucgagaaggacuacgaguacgagaacuccugggccugcaacccgcccgacugccccggggugggcaccgggugcaccggcugcgggcucuaccuggaccagcugaagcccgucggcaccgccuucaagaucaucagcgugcgcuacucccggaaggugugcguccaguucggcgaggaguaccucugcaagacgaucgacaugaacgacugcuucgugacccgccacgcgaagaucugcaucaucgggaccgugagcaaguucagccagggcgacacccugcuguuccucgggcccauggagggcgggggcaucaucuucaagcacuggugcacguccacgugccacuucggcgaccccggggacgucaugggcccgaaggacaagcccuucaucugccccgaguuccccgggcaguuccggaagaagugcaacuucgccaccaccccggugugcgaguacgacggcaacgugaucagcggguaccgcaagguccuggccaccaucgacuccuuccagagcuucaacaccuccaacgugcacuucaccgacgagcggaucgaguggaaggaccccgacggcaugcugcgcgaccacaucaacaucgugaucagcaaggacaucgacuucgagaaccucgccgagaaccccugcaaggucggccugcaggccgcgaacaucgagggggccuggggcuccggggugggcuucacccugacgugccaggugagccucaccgagugccccaccuuccugaccuccaucaaggccugcgacauggccaucugcuacggggccgagagcgucacgcugucccggggccagaacaccaucaagaucaccggccgcgggggccacagcggguccagcuucaagugcugccacggcaaggagugcuccgcgaacggccuccaggccagcgccccgcaccuggacaaggugaacgggaucuccgagcuggagaacgagaagguguacgacgacggcgcccccgagugcgggaucacgugcugguucaagaaguccggcgagugggucauggggaucaucaacggcaacuggguggugcucaucguccugugcgugcugcuccuguucucccugauccuccugagcauccugugccccgugcggaagcacaagaaguccuga

SEQ ID NO: 11822 - RNA, 3402 nt, Artificial Sequence
  derived and/or modified CDS sequence (opt1) from SEOV(China)__EU163437.1__GP
auguggagccugcuccugcuggccgcccucgugggccagggguucgcccugaagaacgucuucgacaugcgcauccagugcccccacuccgugaaguucggcgagaccagcguguccggguacaccgagcugccgccccucagccugcaggaggccgagcagcugguccccgaguccagcugcaacauggacaaccaccagucccucagcacgaucaacaagcugaccaaggugaucuggcggaagaaggccaaccaggaguccgccaaccagaacagcuucgagauccuggaguccgaggugagcuucaagggccucugcaugcugaagcaccgcauggucgaggaguccuaccggaaccgccggagcgugaucugcuacgaccuggccugcaacuccaccuucugcaagcccaccguguacaugaucgucccgauccacgcgugcaacaucaugaaguccugccucaucgggcugggccccuaccgcauccaggugguguacgagcggacguacugcaccaccggcauccugaccgaggggaagugcuucguccccgacaaggccguggugagcgcccucaagcgcggcauguacgccaucgcgagcaucgagacgaucugcuucuucauccaccagaaggggaacaaguacaagaucgucaccgccaucaccuccgccaugggcagcaagugcaacaacaccgacacgaaggugcagggguacuacaucugcaucaucggcggcaacagcgcccccguguacgccccggcgggggaggacuuccgggccauggaggucuucuccggcaucaucaccagcccccacggggaggaccacgaccugcccggcgaggagaucgccaccuaccagaucuccggccagaucgaggccaagaucccccacaccgugagcucccagaaccugaagcucacggccuucgcggggaucccgagcuacuccagcaccuccauccuggccgccagcgaggacggccgcuucaucuucucccccgggcuguuccccaaccucaaccagagcgugugcgacaacaacgcccugccccugaucuggcggggccucaucgaccugaccggguacuacgaggccguccacccgugcaacguguucugcgugcuguccggccccggcgcgagcugcgaggccuucuccgagggcgggaucuucaacaucaccagccccaugugccucgucuccaagcagaaccgcuuccgggccgccgagcagcagaucagcuucaucugccagcgcguggacauggacaucaucgucuacugcaacgggcagaagaagacgauccugaccaagacccuggugaucggccagugcaucuacaccaucacgucccucuucagccugcugcccgggguggcccacagcaucgcgaucgagcucugcgucccgggcuuccacggcugggccaccgccgcccugcugaucaccuucugcuucgggugggugcucauccccgcgugcacccuggccauccugcucgugcugaaguucuucgccaacauccugcagacguccaaccaggagaaccgguucaaggccauccuccgcaagaucaaggaggaguucgagaagaccaagggcagcauggucugcgagaucugcaaguacgagugcgagacccugaaggagcugaaggcccacaaccucuccugcgugcagggggagugccccuacugcuucacccacugcgagcccacggagaccgcgauccaggcccacuacaaggugugccaggccacccaccgguuccgcgaggaccugaagaagaccgucacgccgcagaacaucggccccgggugcuaccggacccugaaccuguuccgcuacaagagccggugcuacauccucaccauguggacccugcugcucaucaucgaguccauccugugggccgccagcgcggccgagaucccccuggugccccucuggaccgacaacgcccacggcgugggcuccgucccgaugcacacggaccuggagcuggacuucagccuccccuccagcuccaaguacaccuacaagcgccaccugaccaaccccgugaacgaccagcagagcgugucccugcacaucgagaucgagagccaggggaucggcgccgacguccaccaccucgggcacugcuacgacgcccgccugaaccugaagaccuccuuccacugcuacggcgcgugcacgaaguaccaguacccguggcacaccgccaagugccacuucgagaaggacuacgaguacgagaacagcugggccugcaacccgcccgacugccccggcguggggaccggcugcaccgccugcgggcucuaccuggaccagcugaagcccgugggcacggcguucaagaucaucuccguccgguacagccgcaaggugugcgugcaguucggggaggaguaccucugcaagaccaucgacaugaacgacugcuucgucacccggcacgccaagaucugcaucaucggcaccgugagcaaguucucccagggcgacacgcugcuguuccucgggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgucugcgaguacgacggcaacaucaucuccggguacaagaaggugcuggccaccaucgacagcuuccaguccuucaaccggagcuacauccacuucaccgacgagcgcaucgaguggcgggacccggacggcaugcugcgcgaccacaucaacaucgugaucuccaaggacaucgacuucgagaaccucgccgagaaccccugcaaggucgggcugcaggcggccaacaucgagggcgccuggggccugggggugggcuucacccucacgugccaggugagccugaccgagugccccaccuuccugaccuccaucaaggccugcgacauggccaucugcuacggggcggagagcgucacgcucucccggggccagaacaccgugaagaucaccgggaagggcggccacagcggguccagcuucaagugcugccacggcaaggagugcuccagcaccgggcugcaggccuccgcgccccaccuggacaaggugaacggcaucagcgagcucgagaacgagaaggucuacgacgacggcgccccggagugcgggaucacgugcugguucaagaaguccggcgagugggugauggggaucaucaacggcaacugggugguccugaucgugcugugcgugcuccugcuguucagccucauccugcugagcauccucugccccguccgcaagcacaagaaguccuga

SEQ ID NO: 11823 - RNA, 3402 nt, Artificial Sequence
  derived and/or modified CDS sequence (opt1) from SEOV(DPRK08)__JX853576.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcacgaucaacaagcugaccaaggugaucuggcggaagaaggccaaccaggaguccgccaaccagaacagcuucgagguggucgaguccgaggugagcuucaagggccugugcaugcucaagcaccgcaugguggaggaguccuaccggaaccgccggagcgucaucugcuacgaccuggccugcaacuccaccuucugcaagcccaccguguacaugaucgugccgauccacgcgugcaacaugaugaaguccugccugaucgggcucggccccuaccgcauccaggucguguacgagcggacguacugcaccaccggcauccugaccgaggggaagugcuucgugcccgacaaggccgucgugagcgcccugaagcgcggcauguacgccaucgcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggucagcuccaagaaccugaagcugaccgccuucgcggggaucccgagcuacuccagcaccuccauccucgccgccagcgaggacggccgcuucaucuucucccccgggcuguuccccaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucacgagccccaugugccuggucuccaagcagaaccgcuuccgggccgccgagcagcagaucagcuucgugugccagcgcguggacauggacaucaucgucuacugcaacgggcagaagaagaccauccucaccaagacccuggugaucggccagugcaucuacacgaucaccucccuguucagccuccugcccgggguggcccacagcaucgcgaucgagcugugcgucccgggcuuccacggcugggccaccgccgcccuccugaucaccuucugcuucgggugggugcugauccccgcgugcacgcucgccauccugcuggugcucaaguucuucgccaacauccugcacaccuccaaccaggagaaccgguucaaggccauccugcgcaagaucaaggaggaguucgagaagaccaagggcagcauggucugcgagaucugcaaguacgagugcgagacccucaaggagcugaaggcccacaaccuguccugcgugcagggggagugccccuacugcuucacgcacugcgagcccaccgagaccgcgauccaggcccacuacaaggugugccaggccacccaccgguuccgcgaggaccucaagaagacggucaccccgcagaacaucggccccgggugcuaccggacccugaaccuguuccgcuacaagagccggugcuacauccugaccauguggacccuccugcugaucaucgaguccauccucugggccgccagcgcggccgagaucccccuggugcccaucuggacggacaacgcccacggcgugggcuccgucccgaugcacaccgaccuggagcucgacuucagccugcccuccagcuccaaguacaccuacaagcgccaccugaccaaccccgugaacgaccagcagagcgugucccuccacaucgagaucgagagccaggggaucggcgccgacguccaccaccuggggcacugguacgacgcccgccugaaccucaagacguccuuccacugcuacggcgcgugcaccaaguaccaguacccguggcacaccgccaagugccacuucgagaaggacuacgaguacgagaacagcugggccugcaacccgcccgacugccccggcguggggaccggcugcacggccugcgggcuguaccuggaccagcucaagcccgugggcaccgcguucaagaucaucuccguccgguacagccgcaaggugugcaugcaguucggggaggaguaccugugcaagaccaucgacaugaacgacugcuucgugacccggcacgccaagaucugcaucaucggcacggucagcaaguucucccagggcgacacccuccucuuccuggggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgugugcgaguacgacggcaacaucaucuccggguacaagaagguccuggccaccaucgacagcuuccaguccuucaacaccagcaacauccacuucacggacgagcggaucgaguggcgcgacccggacggcaugcuccgggaccacaucaacaucgugaucuccaaggacaucgacuucgagaaccuggccgagaaccccugcaagguggggcugcaggcggccaacaucgagggcgccuggggcagcggggucggcuucacccugaccugccaggugucccugaccgagugccccacguuccugaccagcaucaaggccugcgacauggccaucugcuacggggcggaguccgugacccucagccgcggccagaacaccgucaagaucacggggaagggcggccacuccgggagcuccuucaagugcugccacggcaaggagugcagcuccaccgggcugcaggccagcgcgccccaccuggacaaggugaacggcaucuccgagcucgagaacgagaagguguacgacgacggcgccccggagugcggggugaccugcugguucaagaaguccggcgagugggucauggggaucaucaacggcaacugggugguccugaucgugcugugcgugcuccugcuguucagccucauccugcugagcauccucugccccguccggaagcacaagaaguccuga

SEQ ID NO: 11824 - RNA, 3402 nt, Artificial Sequence
  derived and/or modified CDS sequence (opt1) from SEOV(Fj372/2013)__KP645197.1__GP
auguggagccugcuccugcuggccgcccucgugggccccggguucgcgcugaagaacgucuucgacaugcgcauccagugcccgcacagcgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcagaagaaggccaaccaggaguccgccaaccagaacagcuucgagguggucgaguccgaggugagcuucaagggccugugcaugcucaagcaccggaugguggaggaguccuaccgcaaccggcgcagcgucaucugcuacgaccuggccugcaacuccaccuucugcaagcccaccguguacaugaucgugcccauccacgcgugcaacaugaugaaguccugccugaucgggcucggccccuaccggauccaggucguguacgagcgcacguacugcaccaccggcauccugaccgaggggaagugcuucgugcccgacaaggccgucgugagcgcccugaagcggggcauguacgccaucgcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgccccgguguacgcccccgcgggggaggacuuccgcgccauggagguguucuccggcaucaucaccagcccccacggggaggaccacgaccuccccggcgaggagaucgccaccuaccagaucuccggccagaucgaggccaagaucccgcacacggucagcuccaagaaccugaagcugaccgccuucgcggggauccccagcuacuccagcaccuccauccucgccgccagcgaggacggccgguucaucuucucccccgggcuguuccccaaccugaaccagagcgugugcgacaacaacgcccucccgcugaucuggcgcggccugaucgaccucaccggguacuacgaggccgugcaccccugcaacgucuucugcgugcuguccggccccggcgcgagcugcgaggccuucuccgagggcgggaucuucaacaucacgagccccaugugccuggucuccaagcagaaccgguuccgcgccgccgagcagcagaucagcuucgugugccagcggguggacauggacaucaucgucuacugcaacgggcagaagaagaccauccucaccaagacccuggugaucggccagugcaucuacacgaucaccucccuguucagccuccugccggggguggcccacagcaucgcgaucgagcugugcguccccggcuuccacggcugggccaccgccgcccuccugaucaccuucugcuucgggugggugcugauccccgcgugcacgcucgccauccugcuggugcucaaguucuucgccaacauccugcacaccuccaaccaggagaaccgcuucaaggccauccugcggaagaucaaggaggaguucgagaagaccaagggcagcauggucugcgagaucugcaaguacgagugcgagacccucaaggagcugaaggcccacaaccuguccugcgugcagggggagugccccuacugcuucacgcacugcgagccgaccgagaccgcgauccaggcccacuacaaggugugccaggccacccaccgcuuccgggaggaccucaagaagacggucacgccccagaacaucggccccgggugcuaccgcacccugaaccuguuccgguacaagagccgcugcuacauccugaccauguggacccuccugcugaucaucgaguccauccucugggccgccagcgcggccgagaucccccuggugccgcuguggaccgacaacgcccacggcgugggcuccguccccaugcacaccgaccucgagcuggacuucagccugcccuccagcuccaaguacaccuacaagcggcaccucaccaacccggugaacgaccagcagagcgugucccugcacaucgagaucgagagccaggggaucggcgccgacguccaccaccuggggcacugguacgacgcccgccucaaccugaagacguccuuccacugcuacggcgcgugcaccaaguaccaguaccccuggcacaccgccaagugccacuucgagaaggacuacgaguacgagaacagcugggccugcaacccgcccgacugccccggcguggggaccggcugcacggccugcgggcuguaccucgaccagcugaagcccgugggcaccgcguucaagaucaucuccguccgcuacagccggaaggugugcgugcaguucggggaggaguaccugugcaagaccaucgacaugaacgacugcuucgucacccgccacgccaagaucugcaucaucggcacggugagcaaguucucccagggcgacacccuccuguuccuggggcccauggagggcgggggcaucaucuucaagcacuggugcaccagcacgugccacuucggggaccccggcgacgugaugggcccgaaggacaagcccuucaucugccccgaguuccccgggcaguuccggaagaagugcaacuucgccaccaccccggucugcgaguacgacggcaacaucaucuccggguacaagaaggugcucgccaccaucgacagcuuccaguccuucaacaccagcaacauccacuucacggacgagcgcaucgaguggcgggaccccgacggcaugcugcgcgaccacaucaacaucgugaucuccaaggacaucgacuucgagaaccuggccgagaaccccugcaaggucgggcuccaggcggccaacaucgagggcgccuggggcagcggggugggcuucacccugaccugccaggugucccugaccgagugccccacguuccucaccagcaucaaggccugcgacauggccaucugcuacggggcggaguccgucacccugagccggggccagaacaccgugaagaucacggggaagggcggccacuccgggagcuccuucaagugcugccacggcaaggagugcagcuccaccgggcugcaggccagcgccccgcaccucgacaaggugaacggcaucuccgagcuggagaacgagaaggucuacgacgacggcgcccccgagugcgggaucacgugcugguucaagaaguccggcgagugggugauggggaucaucaacggcaacugggugguccugaucgugcucugcgugcugcuccuguucagccugauccugcucagcauccugugccccguccgcaagcacaagaaguccuga

SEQ ID NO: 11825 - RNA, 3402 nt, Artificial Sequence
  derived and/or modified CDS sequence (opt1) from SEOV(HeB38)__JN377554.1__GP
auguggagccugcuccugcuggccgcccucgugggccagggguucgcccugaagaacgucuucgacaugcgcauccagugcccccacagcgugaaguucggcgagaccagcguguccggguacaccgagcugccgccccucagccugcaggaggccgagcagcugguccccgaguccagcugcaacauggacaaccaccagucccucagcaccaucaacaagcugaccaaggugaucuggcagaagaaggccaaccaggaguccgccaaccagaacagcuucgagguggccgaguccgaggucagcuucaagggccugugcaugcucaagcaccggaugguggaggaguccuaccgcaaccggcgcagcgugaucugcuacgaccuggcgugcaacuccaccuucugcaagcccaccgucuacaugaucgugccgauccacgccugcaacaugaugaaguccugccugaucgggcucggccccuaccggauccagguggucuacgagcgcacguacugcaccaccggcauccugaccgaggggaagugcuucgugcccgacaaggccguggucuccgcccugaagcggggcauguacgcgaucgccagcaucgagacgaucugcuucuucauccaccagaaggggaacaccuacaagaucgugaccgccaucaccuccgccaugggcagcaagugcaacaacacggacaccaaggugcagggguacuacaucugcaucaucggcggcaacagcgcccccgucuacgcgccguccggggaggacuuccgcgccauggagguguucagcggcaucaucaugagcccccacggggaggaccacgaccuccccggcgaggagaucgccaccuaccagaucagcggccagaucgaggccaagaucccccacaccguguccagcaagaaccugaagcugacggccuucgcggggaucccguccuacagcuccaccagcauccucgccgccuccgaggacggccgguucaucuucagccccgggcuguuccccaaccugaaccaguccgucugcgacaacaacgcccucccccugaucuggcgcggccugaucgaccucaccggguacuacgaggccgugcacccgugcaacguguucugcguccugagcggccccggcgcguccugcgaggccuucagcgagggcgggaucuucaacaucaccucccccaugugccuggugagcaagcagaaccgguuccgcgccgccgagcagcagaucuccuucgucugccagcggguggacauggacaucaucguguacugcaacgggcagaagaagacgauccucaccaagacccuggucaucggccagugcaucuacaccaucacgagccuguucagccuccugcccgggguggcccacuccaucgcgaucgagcugugcgugccgggcuuccacggcugggccaccgccgcccuccugaucaccuucugcuucggguggguccugauccccgcgugcacccucgccauccugcuggugcucaaguucuucgccaacauccugcacacgagcaaccaggagaaccgcuucaaggccauccugcggaagaucaaggaggaguucgagaagaccaagggcuccauggugugcgagaucugcaaguacgagugcgagacccucaaggagcugaaggcccacaaccugagcugcguccagggggagugccccuacugcuucacccacugcgagcccacggagaccgcgauccaggcccacuacaaggugugccaggccacccaccgcuuccgggaggaccucaagaagaccgugacgccgcagaacaucggccccgggugcuaccgcacccugaaccuguuccgguacaagucccgcugcuacauccugaccauguggacccuccugcugaucaucgagagcauccucugggccgccuccgcggccgagaucccccuggucccccuguggaccgacaacgcccacggcgugggcagcgugccgaugcacacggaccucgagcuggacuucucccugcccagcuccagcaaguacaccuacaagcggcaccucaccaaccccgucaacgaccagcaguccgugagccugcacaucgagaucgagucccaggggaucggcgccgacgugcaccaccuggggcacugguacgacgcccgccucaaccugaagaccagcuuccacugcuacggcgcgugcacgaaguaccaguacccguggcacaccgccaagugccacuucgagaaggacuacgaguacgagaacuccugggccugcaacccgcccgacugccccggcgucgggaccggcugcaccgccugcgggcuguaccucgaccagcugaagcccgugggcacggcguucaagaucaucagcgugcgcuacagccggaaggucugcgugcaguucggggaggaguaccugugcaagaccaucgacaugaacgacugcuucgugacccgccacgccaagaucugcaucaucggcaccgucuccaaguucagccagggcgacacgcuccuguuccuggggcccauggagggcgggggcaucaucuucaagcacuggugcaccuccacgugccacuucggggaccccggcgacgugaugggccccaaggacaagccguucaucugccccgaguuccccgggcaguuccggaagaagugcaacuucgccaccacccccgugugcgaguacgacggcaacaucaucagcggguacaagaagguccucgccaccaucgacuccuuccagagcuucaacaccuccaacauccacuucaccgacgagcgcaucgaguggcgggacccggacggcaugcugcgcgaccacaucaacaucgugaucagcaaggacaucgacuucgagaaccuggccgagaaccccugcaagguggggcuccaggcggccaacaucgagggcgccuggggcuccggggucggcuucacgcugaccugccaggugagccugaccgagugccccaccuuccucacguccaucaaggccugcgacauggccaucugcuacggggcggagagcgugacccugcugcggggccagaacaccgucaagaucaccgggaagggcggccacuccgggagcuccuucaagugcugccacggcaaggagugcagcuccacggggcuccaggccagcgcgccccaccuggacaaggugaacggcaucuccgagcuggagaacgagaagguguacgacgacggcgccccggagugcgggaucacgugcugguucaagaaguccggcgagugggucauggggaucaucaacggcaacuggguggugcucaucguccugugcgugcugcuccuguucagccugauccuccugagcauccugugccccgugcgcaagcacaagaaguccuga

SEQ ID NO: 11826 - RNA, 3402 nt, Artificial Sequence
  derived and/or modified CDS sequence (opt1) from SEOV(JiangxiXinjianRn-07-2011)__KP859513.1__GP
auguggagccugcuccugcuggccgcccucgugggccagugcuucgcccugaagaacgucuucgacaugcgcauccagugcccccacagcgugaacuucggggagaccagcguguccggcuacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgagguggucgaguccgaggugagcuucaaggggcugugcaugcucaagcaccgcaugguggaggaguccuaccggaaccgccggagcgucaucugcuacgaccuggccugcaacuccaccuucugcaagcccaccguguacaugaucgugccgauccacgcgugcaacaugaugaaguccugccugaucggccucgggcccuaccgcauccaggucguguacgagcggacguacugcaccaccggcauccugaccgagggcaagugcuucgugcccgacaaggccgucgugagcgcccugaagcgcgggauguacgccaucgcgagcaucgagacgaucugcuucuucauccaccagaagggcaacaccuacaagaucgugaccgccaucaccuccgccauggggagcaagugcaacaacacggacaccaagguccagggcuacuacaucugcaucaucgggggcaacagcgcccccguguacgccccggcgggcgaggacuuccgggccauggagguguucuccgggaucaucaccagcccccacggcgaggaccacgaccuccccggggaggagaucgccaccuaccagaucuccggccagaucgaggccaagaucccccacacggucagcuccaagaaccugaagcugaccgccuucgcgggcaucccgagcuacuccagcaccuccauccucgccgccagcgaggacgggcgcuucaucuucucccccggccuguuccccaaccugaaccagagcgugugcgacaacaacgcccucccccugaucuggcgggggcugaucgaccucaccggcuacuacgaggccgugcacccgugcaacgucuucugcgugcuguccgggcccggcgcgagcugcgaggccuucuccgagggcgggaucuucaacaucacgagccccaugugccuggucuccaagcagaaccgcuuccgggccgccgagcagcagaucagcuucgugugccagcgcguggacauggacaucaucgucuacugcaacggccagaagaagaccauccucaccaagacccuggugaucgggcagugcaucuacacgaucaccucccuguucagccuccugcccggcguggcccacagcaucgcgaucgagcugugcgucccgggguuccacggcugggccaccgccgcccuccugaucaccuucugcuucggcugggugcugauccccgcgugcacgcucgccauccugcuggugcucaaguucuucgccaacauccugcacaccuccaaccaggagaaccgguucaaggccauccugcgcaagaucaaggaggaguucgagaagaccaaggggagcauggucugcgagaucugcaaguacgagugcgagacccucaaggagcugaaggcccacaaccuguccugcgugcagggcgagugccccuacugcuucacgcacugcgagcccaccgagaccgcgauccaggcccacuacaaggugugccaggccacccaccgguuccgcgaggaccucaagaagacggucaccccgcagaacaucgggcccggcugcuaccggacccugaaccuguuccgcuacaagagccggugcuacauccugaccauguggacccuccugcugaucaucgaguccauccucugggccgccagcgcggccgagaucccccuggugccccuguggacggacaacgcccacggggugggcuccgucccgaugcacaccgaccucgagcuggacuucagccugcccuccagcuccaaguacaccuacaagcgccaccucaccaaccccgugaacgaccagcagagcgugucccugcacaucgagaucgagagccagggcaucggggccgacguccaccaccugggccacugguacgacgcccgccucaaccugaagacguccuuccacugcuacggggcgugcaccaaguaccaguacccguggcacaccgccaagugccacuucgagaaggacuacgaguacgagaacagcugggccugcaacccgcccgacugccccggcgugggcaccgggugcacggccugcggccuguaccucgaccagcugaagcccguggggaccgcguucaagaucaucuccguccgguacagccgcaaggugugcgugcaguucggcgaggaguacuucugcaagaccaucgacaugaacgacugcuucgucacccggcacgccaagaucugcaucaucgggacggugagcaaguucucccagggcgacacccuccucuuccugggccccauggagggcggcgggaucaucuucaagcacuggugcaccagcacgugccacuucggggaccccggggacgugaugggccccaaggacaagccguucaucugccccgaguuccccggccaguuccgcaagaagugcaacuucgccaccacccccgucugcgaguacgacgggaacaucaucuccggcuacaagaaggugcuggccaccaucgacagcuuccaguccuucaacaccagcaacauccacuucacggacgagcggaucgaguggcgcgacccggacgggaugcuccgggaccacaucaacaucgugaucuccaaggacaucgacuucgagaaccuggccgagaaccccugcaaggucggccugcaggcggccaacaucgagggggccuggggcagcggcgugggguucacccugaccugccaggugucccugaccgagugccccacguuccugaccagcaucaaggccugcgacauggccaucugcuacggcgcggaguccgucacccucagccgcgggcagaacaccgugaagaucacgggcaagggcgggcacuccggcagcuccuucaagugcugccacgggaaggagugcagcuccaccggccugcaggccagcgcgccccaccuggacaaggugaacgggaucuccgagcucgagaacgagaaggucuacgacgacggcgccccggagugcggcaucacgugcugguucaagaaguccggggagugggugaugggcaucaucaacgggaacugggugguccugaucgugcugugcgugcuccugcuguucagccucauccugcugagcauccucugccccguccggaagcacaagaaguccuga

SEQ ID NO: 11827 - RNA, 3402 nt, Artificial Sequence
  derived and/or modified CDS sequence (opt1) from SEOV(LYON/Rn/FRA/2013/LYO852)__KF387724.1__GP
auguggagccugcuccugcuggccgcccucgccggccagggguucgcccugaagaacguguucgacaugcgcauccagugcccccacagcgucaacuucggcgagaccagcguguccggguacaccgagcugccgccccucagccugcaggaggccgagcagcuggugcccgaguccagcugcaacauggacaaccaccagucccucagcaccaucaacaagcugaccaaggucaucuggcggaagaaggccaaccaggaguccgccagccagaacuccuucgaggugguggagagcgaggucuccuucaagggccugugcaugcuccgccaccggaugguggaggagagcuacaagaaccgccgguccgugaucugcuacgaccuggcgugcaacagcaccuucugcaagcccaccgucuacaugaucgugccgauccacgccugcaacaugaugaaguccugccugaucgggcucggccccuaccgcauccagguggucuacgagcggacguacugcaccaccggcauccugaccgaggggaagugcuucgugcccgacaaggccguggucagcgcccugaagcgcggcauguacgcgaucgccuccaucgagacgaucugcuucuucauccaccagaaggggaacaccuacaagaucgugaccgccaucaccagcgccaugggcagcaagugcaacaacacggacaccaaggugcagggguacuacaucugcaucaucggcggcaacuccgcccccgucuacgcgccggccggggaggacuuccgggccauggagguguucagcggcaucaucaccagcccccacggggaggaccacgaccuccccggcgaggagaucgccaccuaccagaucagcggccagaucgaggccaagaucccccacacgguguccagcaagaaccugaagcugaccgcguucgccgggaucccguccuacagcuccaccagcauccucgccgccuccgaggacggccgcuucaucuucagccccgggcuguuccccaaccugaaccaguccgucugcgacaacaacgcccucccccugaucuggcggggccugaucgaccucaccggguacuacgaggcggugcacccgugcaacguguucugcguccugagcggccccggcgccuccugcgaggccuucagcgagggcgggaucuucaacaucacgucccccaugugccuggugagcaagcagaaccgcuuccgggccgccgagcagcagaucuccuucgucugccagcgcguggacauggacaucaucguguacugcaacgggcagaagaagaccauccucaccaagacccuggucaucggccagugcaucuacacgaucaccagccuguucagccuccugcccgggguggcgcacuccaucgccaucgagcugugcgugccgggcuuccacggcugggccaccgccgcgcuccugaucaccuucugcuucggguggguccugauccccgccugcacgcucgccauccugcuggugcucaaguucuucgccaacauccugcacaccagcaaccaggagaaccgguucaaggccauccugcgcaagaucaaggaggaguucgagaagaccaagggcuccauggugugcgagaucugcaaguacgagugcgagacccucaaggagcugaaggcgcacaaccugagcugcguccagggggagugccccuacugcuucacgcacugcgagcccaccgagaccgccauccaggcccacuacaaggugugccaggccacccaccgguuccgcgaggaccucaagaagacggugaccccgcagaacaucggccccgggugcuaccggacccugaaccuguuccgcuacaagucccggugcuacauccugaccauguggacccuccugcugaucaucgagagcauccucugggccgcguccgccgccgagaucccccuggucccccuguggacggacaacgcccacggcgugggcagcgugccgaugcacaccgaccucgagcuggacuucucccugcccagcuccagcaaguacaccuacaagcgccaccucaccaaccccgucaacgaccagcaguccgugagccugcacaucgagaucgagucccaggggaucggcgccgacgugcaccaccuggggcacugguacgacgcgcgccucaaccugaagacgagcuuccacugcuacggcgccugcaccaaguaccaguacccguggcacaccgccaagugccacuucgagaaggacuacgaguacgagaacuccugggccugcaacccgcccgacugccccggcgucgggaccggcugcacggcgugcgggcuguaccucgaccagcugaagcccgugggcaccgccuucaagaucaucagcgugcgguacagccgcaaggucugcgugcaguucggggaggaguaccugugcaagaccaucgacaugaacgacugcuucgugacccggcacgccaagaucugcaucaucggcacggucuccaaguucagccagggcgacacccuccuguuccuggggcccauggagggcgggggcaucaucuucaagcacuggugcaccuccacgugccacuucggggaccccggcgacgugaugggccccaaggacaagccguucaucugccccgaguuccccgggcaguuccgcaagaagugcaacuucgccaccacccccgugugcgaguacgacggcaacaucaucagcggguacaagaagguccucgccaccaucgacuccuuccagagcuucaacaccuccaacauccacuucacggacgagcggaucgaguggcgcgacccggacggcaugcugcgggaccacaucaacaucaucaucagcaaggacaucgacuucgagaaccuggcggagaaccccugcaagguggggcuccaggccgccaacaucgagggcgccuggggcuccggggugggcuucacccugaccugccaggucagccugaccgagugccccacguuccucaccuccaucaaggccugcgacauggcgaucugcuacggggccgagagcgugacccugucccgcggccagaacaccgugaagaucacggggaagggcggccacagcggguccagcuucaagugcugccacggcaaggagugcucccugaccgggcuccaggccagcgcgccccaccuggacaaggucaacggcaucuccgagcuggagaacgagaagguguacgacgacggcgccccggagugcgggaucacgugcugguucaagaaguccggcgagugggugauggggaucaucaacggcaacugggucgugcucaucgugcugugcgucuuccuccuguucagccugauccugcucuccauccugugccccgugcggaagcacaagaaguccuga

SEQ ID NO: 11828 - RNA, 3402 nt, Artificial Sequence
  derived and/or modified CDS sequence (opt1) from SEOV(Seoul-Baxter/NYC-D1_M)__KJ950863.1__GP
auguggagccugcuccugcuggccgcccucgugggccagggguucgcccugaagaacgucuucgacaugaagauccagugcccccacagcgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcgcaagaaggccaaccaggaguccgccaaccagaacagcuucgagguggccgaguccgaggucagcuucaagggccugugcaugcucaagcaccggaugguggaggaguccuaccgcaaccggcgcagcgugaucugcuacgaccuggcgugcaacuccaccuucugcaagcccaccgucuacaugaucgugccgauccacgccugcaacaugaugaaguccugccugaucgggcucggccccuaccggauccagguggucuacgagcgcacguacugcaccaccggcauccugaccgaggggaagugcuucgugcccgacaaggccguggucagcgcccugaagcggggcauguacgcgaucgccagcaucgagacgaucugcuucuucauccaccagaaggggaacaccuacaagaucgugaccgccaucaccuccgccaugggcagcaagugcaacgacacggacaccaaggugcagggguacuacaucugcaucaucggcggcaacagcgcccccgucuacgcgccggccggggaggacuuccgcgccauggagguguucuccggcaucaucaccagcccccacggggaggaccacgaccuccccggcgaggagaucgccaccuaccagaucuccggccagaucgaggccaagaucccccacacggugagcuccaagaaccugaagcugaccgcguucgccgggaucccgagcuacuccagcaccuccauccucgccgccagcgaggacggccgguucaucuucucccccgggcuguuccccaaccugaaccagagcgucugcgacaacaacgcccucccccugguguggcgcggccugaucgaccucaccggguacuacgaggcggugcacccgugcaacgucuucugcgugcuguccggccccggcgccagcugcgaggccuucuccgagggcgggaucuucaacaucacgagccccaugugccuggucuccaagcagaaccgguuccgcgccgccgagcagcagaucagcuucgugugccagcggguggacauggacaucaucgucuacugcaacgggcagaagaagaccauccucaccaagacccuggugaucggccagugcaucuacacgaucaccucccuguucagccuccugcccgggguggcgcacagcaucgccaucgagcugugcgucccgggcuuccacggcugggccaccgccgcgcuccugaucaccuucugcuucgggugggugcugauccccgccugcacgcucgccauccugcuggugcucaaguucuucgccaacauccugcacaccuccaaccaggagaaccgcuucaaggccauccugcggaagaucaaggaggaguucgagaagaccaagggcagcauggucugcgagaucugcaaguacgagugcgagacccucaaggagcugaaggcgcacaaccuguccugcgugcagggggagugccccuacugcuucacgcacugcgagcccaccgagaccgccauccaggcccacuacaaggugugccaggccacccaccgcuuccgggaggaccucaagaagacggucaccccgcagaacaucggccccgggugcuaccgcacccugaaccuguuccgguacaagagccgcugcuacauccugaccauguggacccuccugcugaucaucgaguccauccucugggccgcgagcgccgccgagaucccccuggugccccuguggacggacaacgcccacggcgugggcuccgucccgaugcacaccgaccucgagcuggacuucagccugcccuccagcuccaaguacaccuacaagcggcaccucaccaaccccgugaacgaccagcagagcgugucccugcacaucgagaucgagagccaggggaucggcgccgacguccaccaccuggggcacugguacgacgcgcgccucaaccugaagacguccuuccacugcuacggcgccugcaccaaguaccaguacccguggcacaccgccaagugccacuucgagaaggacuacgaguacgagaacagcugggccugcaacccgcccgacugccccggcguggggaccggcugcacggcgugcgggcuguaccucgaccagcugaagcccgugggcaccgccuucaagaucaucuccguccgcuacagccggaaggugugccugcaguucggggaggaguaccucugcaagaccaucgacaugaacgacugcuucgugacccgccacgucaagaucugcaucaucggcacggugagcaaguucucccagggcgacacccugcuguuccucgggcccauggagggcgggggcaucaucuucaagcacuggugcaccagcacgugccacuucggggaccccggcgacgugaugggccccaaggacaagccguucaucugccccgaguuccccgggcaguuccggaagaagugcaacuucgccaccacccccgucugcgaguacgacggcaacaucaucuccggguacaagaaggugcuggccaccaucgacagcuuccaguccuucaacaccagcaacauccacuucacggacgagcgcaucgaguggcgggacccggacggcaugcugcgcgaccacaucaacaucgugaucuccaaggacaucgacuucgagaaccucgccgagaaccccugcaaggucgggcugcaggcggccaacaucgagggcgccuggggcagcggggugggcuucacccugaccugccaggugucccucaccgagugccccacguuccugaccagcaucaaggccugcgacauggccaucugcuacggggcggaguccgucacccugagccggggccagaacaccgugaagaucacggggaagggcggccacuccgggagcuccuucaagugcugccacggcaaggagugcagcuccaccgggcuccaggccagcgcgccccaccuggacaaggugaacggcaucuccgagcuggagaacgagaaggucuacgacgacggcgccccggagugcgggaucacgugcugguucaagaaguccggcgagugggugauggggaucaucaacggcaacugggugguccucaucgugcugugcgugcugcuccuguucagccugauccuccugagcauccugugccccguccgcaagcacaagaaguccuga

SEQ ID NO: 11829 - RNA, 3402 nt, Artificial Sequence
  derived and/or modified CDS sequence (opt1) from SEOV(Singapore/06(RN41))__GQ274942.1__GP
auguggagccugcuccugcuggccgcccucgccggccagggguucgcccugaagaacguguucgacaugcgcauccagugcccccacuccgucaacuucggcgagaccagcguguccggguacaccgagcugccgccccucagccugcaggaggccgagcagcuggugcccgaguccagcugcaacauggacaaccaccagucccucagcaccaucaacaagcugaccaaggucaucuggcggaagaaggccaaccaggaguccgccagccagaacuccuucgaggugguggagagcgagaucuccuucaagggccugugcaugcucaagcaccgcauggucgaggagagcuaccggaaccgccgguccgugaucugcuacgaccuggcgugcaacagcaccuucugcaagcccaccguguacaugaucgucccgauccacgccugcaacaugaugaaguccugccugaucgggcucggccccuaccgcauccaggugguguacgagcggacguacugcaccaccggcauccugaccgaggggaagugcuucguccccgacaaggccguggugagcgcccugaagcgcggcauguacgcgaucgccuccaucgagacgaucugcuucuucauccaccagaaggggaacaccuacaagaucgucaccgccaucaccagcgccaugggcagcaagugcaacaacacggacaccaaggugcagggguacuacaucugcaucaucggcggcaacuccgcccccguguacgcgccggccggggaggacuuccgggccauggaggucuucagcggcaucaucaccagcccccacggggaggaccacgaccuccccggcgaggagaucgccaccuaccagaucagcggccagaucgaggccaagaucccccacacgguguccagcaagaaccugaagcugaccgcguucgccgggaucccguccuacagcuccaccagcauccucgccgccuccgaggacggccgcuucaucuucagccccgggcuguuccccaaccugaaccaguccgugugcgacaacaacgcccucccccugaucuggcggggccugaucgaccucaccggguacuacgaggcgguccacccgugcaacguguucugcgugcugagcggccccggcgccuccugcgaggccuucagcgagggcgggaucuucaacaucacgucccccaugugccuggucagcaagcagaaccgcuuccgggccgccgagcagcagaucuccuucgugugccagcgcgucgacauggacaucaucguguacugcaacgggcagaagaagaccauccucaccaagacccuggugaucggccagugcaucuacacgaucaccagccuguucagccuccugcccggggucgcgcacuccaucgccaucgagcugugcgugccgggcuuccacggcugggccaccgccgcgcuccugaucaccuucugcuucgggugggugcugauccccgccugcacgcucgccauccugcugguccucaaguucuucgccaacauccugcacaccagcaaccaggagaaccgguucaaggccauccugcgcaagaucaaggaggaguucgagaagaccaagggcuccauggugugcgagaucugcaaguacgagugcgagacccucaaggagcugaaggcgcacaaccugagcugcgugcagggggagugccccuacugcuucacgcacugcgagcccaccgagaccgccauccaggcccacuacaaggucugccaggccacccaccgguuccgcgaggaccucaagaagacggugaccccgcagaacaucggccccgggugcuaccggacccugaaccuguuccgcuacaagucccggugcuacauccugaccauguggacccuccugcugaucaucgagagcauccucugggccgcguccgccgccgagaucccccuggugccccuguggacggacaacgcccacggcgucggcagcgugccgaugcacaccgaccucgagcuggacuucucccugcccagcuccagcaaguacaccuacaagcgccaccucaccaaccccgugaacgaccagcaguccgucagccugcacaucgagaucgagucccaggggaucggcgccgacgugcaccaccuggggcacugguacgacgcgcgccucaaccugaagacgagcuuccacugcuacggcgccugcaccaaguaccaguacccguggcacaccgccaagugccacuucgagaaggacuacgaguacgagaacuccugggccugcaacccgcccgacugccccggcguggggaccggcugcacggcgugcgggcuguaccucgaccagcugaagcccgucggcaccgccuucaagaucaucagcgugcgguacagccgcaaggugugcguccaguucggggaggaguaccugugcaagaccaucgacaugaacgacugcuucgugacccggcacgccaagaucugcaucaucggcacgguguccaaguucagccagggcgacacccuccuguuccuggggcccauggagggcgggggcaucaucuucaagcacuggugcaccuccacgugccacuucggggaccccggcgacgucaugggccccaaggacaagccguucaucugccccgaguuccccgggcaguuccgcaagaagugcaacuucgccaccacccccgugugcgaguacgacggcaacaucaucagcggguacaagaaggugcucgccaccaucgacuccuuccagagcuucaacaccuccaacauccacuucacggacgagcggaucgaguggcgcgacccggacggcaugcugcgggaccacaucaacaucgucaucagcaaggacaucgacuucgagaaccuggcggagaaccccugcaagguggggcuccaggccgccaacaucgagggcgccuggggcuccggggugggcuucacccugaccugccaggucagccugaccgagugccccacguuccucaccuccaucaaggccugcgacauggcgaucugcuacggggccgagagcgugacccugucccgcggccagaacaccgugaagaucacggggaagggcggccacagcggguccagcuucaagugcugccacggcaaggagugcuccagcaccgggcugcaggccuccgcgccccaccucgacaaggucaacggcaucagcgagcuggagaacgagaagguguacgacgacggcgccccggagugcgggaucacgugcugguucaagaaguccggcgagugggugauggggaucaucaacggcaacugggucgugcugaucgugcucugcguccugcuccuguucucccugauccugcucagcauccugugccccgugcggaagcacaagaaguccuga

SEQ ID NO: 11830 - RNA, 3402 nt, Artificial Sequence
  derived and/or modified CDS sequence (opt1) from SEOV(11CSG)__AB618131.1__GP
auguggagccugcuccugcuggccgcccucgccggccagggguucgcccugaagaacguguucgacaugcgcauccagugcccccacuccgucaacuucggcgagaccagcguguccggguacaccgagcugccgccccucagccugcaggaggccgagcagcuggugcccgaguccagcugcaacauggacaaccaccagucccucagcaccaucaacaagcugaccaaggucaucuggcggaagaaggccaaccaggaguccgccagccagaacuccuucgaggugguggagagcgaggucuccuucaagggccugugcaugcucaagcaccgcaugguggaggagagcuaccggaaccgccgguccgugaucugcuacgaccuggcgugcaacagcaccuucugcaagcccaccgucuacaugaucgugccgauccacgccugcaacaugaugaaguccugccugaucgggcucggccccuaccgcauccagguggucuacgagcggacguacugcaccaccggcauccugaccgaggggaagugcuucgugcccgacaaggccguggucagcgcccugaagcgcggcauguacgcgaucgccuccaucgagacgaucugcuucuucgugcaccagaaggggaacaccuacaagaucgugaccgccaucaccagcgccaugggcagcaagugcaacaacacggacaccaagguccagggguacuacaucugcaucaucggcggcaacuccgcccccguguacgcgccggccggggaggacuuccgggccauggagguguucagcggcaucaucaccagcccccacggggaggaccacgaccuccccggcgaggagaucgccaccuaccagaucagcggccagaucgaggccaaguucccccacacggucuccagcaagaaccugaagcugaccgcguucgccgggaucccguccuacagcuccaccagcauccucgccgccuccgaggacggccgcuucaucuucagccccgggcuguuccccaaccugaaccaguccgugugcgacaacaacgcccucccccugaucuggcggggccugaucgaccucaccggguacuacgaggcggugcacccgugcaacgucuucugcgugcugagcggccccggcgccuccugcgaggccuucagcgagggcgggaucuucaacaucacgucccccaugugccuggucagcaagcagaaccgcuuccgggccgccgagcagcagaucuccuucgugugccagcgcguggacauggacaucaucgucuacugcaacgggcagaagaagaccauccucaccaagacccuggugaucggccagugcaucuacacgaucaccagccuguucagccuccugcccgggguggcgcacuccaucgccaucgagcugugcgucccgggcuuccacggcugggccaccgccgcgcuccugaucaccuucugcuucgggugggugcugauccccgccugcacgcucgccauccugcuggugcucaaguucuucgccaacauccugcacaccagcaaccaggagaaccgguucaaggccauccugcgcaagaucaaggaggaguucgagaagaccaagggcuccauggucugcgagaucugcaaguacgagugcgagacccucaaggagcugaaggcgcacaaccugagcugcgugcagggggagugccccuacugcuucacgcacugcgagcccaccgagaccgccauccaggcccacuacaaggugugccaggccacccaccgguuccgcgaggaccucaagaagacggucaccccgcagaacaucggccccgggugcuaccggacccugaaccuguuccgcuacaagucccggugcuacauccugaccauguggacccuccugcugaucaucgagagcauccucugggccgcguccgccgccgagaucccccuggugccccuguggacggacaacgcccacggcgugggcagcgucccgaugcacaccgaccucgagcuggacuucucccugcccagcuccagcaaguacaccuacaagcgccaccucaccaaccccgugaacgaccagcaguccgugagccugcacaucgagaucgagucccaggggaucggcgccgacguccaccaccuggggcacugguacgacgcgcgccucaaccugaagacgagcuuccacugcuacggcgccugcaccaaguaccaguacccguggcacaccgccaagugccacuucgagaaggacuacgaguacgagaacuccugggccugcaacccgcccgacugccccggcguggggaccggcugcacggcgugcgggcuguaccucgaccagcugaagcccgugggcaccgccuucaagaucaucagcguccgguacagccgcaaggugugcgugcaguucggggaggaguaccugugcaagaccaucgacaugaacgacugcuucgucacccggcacgccaagaucugcaucaucggcacgguguccaaguucagccagggcgacacccuccuguuccuggggcccauggagggcgggggcaucaucuucaagcacuggugcaccuccacgugccacuucggggaccccggcgacgugaugggccccaaggacaagccguucaucugccccgaguuccccgggcaguuccgcaagaagugcaacuucgccaccacccccgucugcgaguacgacggcaacaccaucagcggguacaagaaggugcucgccaccaucgacuccuuccagagcuucaacacguccaacauccacuucaccgacgagcggaucgaguggcgcgacccggacggcaugcugcgggaccacaucaacaucgugaucagcaaggacaucgacuucgagaaccuggcggagaaccccugcaaggucgggcuccaggccgccaacaucgagggcgccuggggcuccggggugggcuucacccugaccugccaggugagccugacggagugccccaccuuccucaccuccaucaaggccugcgacauggcgaucugcuacggggccgagagcgucacccugucccgcggccagaacacggugaagaucaccgggaagggcggccacagcggguccagcuucaagugcugccacggcaaggagugcuccagcaccgggcugcaggccuccgcgccccaccucgacaaggugaacggcaucagcgagcuggagaacgagaaggucuacgacgacggcgccccggagugcgggaucacgugcugguucaagaaguccggcgagugggugauggggaucaucaacggcaacuggaucgugcugaucguccucugcgugcugcuccuguucucccugauccugcucagcauccugugccccgugcggaagcacaagaaguccuga

SEQ ID NO: 11831 - RNA, 3402 nt, Artificial Sequence
  derived and/or modified CDS sequence (opt1) from SEOV(5CSG)__AB618130.1__GP
auguggagccugcuccugcuggccgcccucgccggccagggguucgcccugaagaacguguucgacaugcgcauccagugcccccacuccgucaacuucggcgagaccagcguguccggguacaccgagcugccgccccucagccugcaggaggccgagcagcuggugcccgaguccagcugcaacauggacaaccaccagucccucagcaccaucaacaagcugaccaaggucaucuggcggaagaaggccaaccaggaguccgccagccagaacuccuucgaggugguggagagcgaggucuccuucaagggccugugcaugcucaagcaccgcaugguggaggagagcuaccggaaccgccgguccgugaucugcuacgaccuggcgugcaacagcaccuucugcaagcccaccgucuacaugaucgugccgauccacgccugcaacaugaugaaguccugccugaucgggcucggccccuaccgcauccagguggucuacgagcggacguacugcaccaccggcauccugaccgaggggaagugcuucgugcccgacaaggccguggucagcgcccugaagcgcggcauguacgcgaucgccuccaucgagacgaucugcuucuucauccaccagaaggggaacaccuacaagaucgugaccgccaucaccagcgccaugggcagcaagugcaacaacacggacaccaaggugcagggguacuacaucugcaucaucggcggcaacuccgcccccgucuacgcgccggccggggaggacuuccgggccauggagguguucagcggcaucaucaccagcccccacggggaggaccacgaccuccccggcgaggagaucgccaccuaccagaucagcggccagaucgaggccaagaucccccacacgguguccagcaagaaccugaagcugaccgcguucgccgggaucccguccuacagcuccaccagcauccucgccgccuccgaggacggccgcuucaucuucagccccgggcuguuccccaaccugaaccaguccgucugcgacaacaacgcccucccccugaucuggcggggccugaucgaccucaccggguacuacgaggcgauccacccgugcaacguguucugcgugcugagcggccccggcgccuccugcgaggccuucagcgagggcgggaucuucaacaucacgucccccaugugccuggucagcaagcagaaccgcuuccgggccgccgagcagcagaucuccuucgugugccagcgcgucgacauggacaucaucguguacugcaacgggcagaagaagaccauccucaccaagacccuggugaucggccagugcaucuacacgaucaccagccuguucagccuccugcccggggucgcgcacuccaucgccaucgagcugugcgugccgggcuuccacggcugggccaccgccgcgcuccugaucaccuucugcuucgggugggugcugauccccgccugcacgcucgccauccugcugguccucaaguucuucgccaacauccugcacaccagcaaccaggagaaccgguucaaggccauccugcgcaagaucaaggaggaguucgagaagaccaagggcuccauggugugcgagaucugcaaguacgagugcgagacccucaaggagcugaaggcgcacaaccugagcugcgugcagggggagugccccuacugcuucacgcacugcgagcccaccgagaccgccauccaggcccacuacaaggucugccaggccacccaccgguuccgcgaggaccucaagaagacggugaccccgcagaacaucggccccgggugcuaccggacccugaaccuguuccgcuacaagucccggugcuacauccugaccauguggacccuccugcugaucaucgagagcauccucugggccgcguccgccgccgagaucccccuggugccccuguggacggacaacgcccacggcgucggcagcgugccgaugcacaccgaccucgagcuggacuucucccugcccagcuccagcaaguacaccuacaagcgccaccucaccaaccccgugaacgaccagcaguccgucagcgugcacaucgagaucgagucccaggggaucggcgccgacgugcaccaccuggggcacugguacgacgcgcgccugaaccucaagacgagcuuccacugcuacggcgccugcaccaaguaccaguacccguggcacaccgccaagugccacuucgagaaggacuacgaguacgagaacuccugggccugcaacccgcccgacugccccggcgucgggaccggcugcacggcgugcgggcuguaccuggaccagcucaagcccgugggcaccgccuucaagaucaucagcgugcgguacagccgcaaggucugcgugcaguucggggaggaguaccugugcaagaccaucgacaugaacgacugcuucgugacccggcacgccaagaucugcaucaucggcacggucuccaaguucagccagggcgacacccuccucuuccuggggcccauggagggcgggggcaucaucuucaagcacuggugcaccuccacgugccacuucggggaccccggcgacgugaugggccccaaggacaagccguucaucugccccgaguuccccgggcaguuccgcaagaagugcaacuucgccaccacccccgugugcgaguacgacggcaacaccaucagcggguacaagaagguccuggccaccaucgacuccuuccagagcuucaacacguccaacauccacuucaccgacgagcggaucgaguggcgcgacccggacggcaugcuccgggaccacaucaacaucgugaucagcaaggacaucgacuucgagaaccuggcggagaaccccugcaagguggggcugcaggccgccaacaucgagggcgccuggggcuccggggucggcuucacccugaccugccaggugagccugacggagugccccaccuuccugaccuccaucaaggccugcgacauggcgaucugcuacggggccgagagcgugacccucucccgcggccagaacacggucaagaucaccgggaagggcggccacagcggguccagcuucaagugcugccacggcaaggagugcuccagcaccgggcugcaggccuccgcgccccaccuggacaaggugaacggcaucagcgagcucgagaacgagaagguguacgacgacggcgccccggagugcgggaucacgugcugguucaagaaguccggcgagugggucauggggaucaucaacggcaacuggguggugcugaucguccugugcgugcuccugcuguucucccucauccugcugagcauccucugccccgugcggaagcacaagaaguccuga

SEQ ID NO: 11832 - RNA, 3402 nt, Artificial Sequence
  derived and/or modified CDS sequence (opt1) from SEOV(80-39)__S47716.1__GP
auguggagccugcuccugcuggccgcccucgugggccagggguucgcccugaagaacgucuucgacaugcgcauccagugcccccacuccgugaaguucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgagcugauggaguccgaggugagcuucaagggccucugcaugcugaagcaccgcauggucgaggaguccuaccggaaccgccggagcgugaucugcuacgaccuggccugcaacuccaccuucugcaagcccaccguguacaugaucgucccgauccacgcgugcaacaugaugaaguccugccucaucgggcugggccccuaccgcguccaggugguguacgagcggacguacugcaccaccggcauccugaccgaggggaagugcuucgugcccgacaaggccguggucagcgcccucaagcgcggcauguacgccaucgcgagcaucgagacgaucugcuucuucauccaccagaaggggaacaccuacaagaucgugaccgccaucaccuccgccaugggcagcaagugcaacaacacggacaccaaggugcagggguacuacaucugcaucaucggcggcaacagcgcccccgucuacgccccggcgggggaggacuuccgggccauggagguguucuccggcaucaucaccagcccccacggggaggaccacgaccugcccggcgaggagaucgccaccuaccagaucuccggccagaucgaggccaagaucccccacacggugagcuccaagaaccugaagcucaccgccuucgcggggaucccgagcuacuccagcaccuccauccugaccgccagcgaggacggccgcuucaucuucucccccgggcuguuccccaaccucaaccagagcgucugcgacaacaacgcccugccccugaucuggcggggccucaucgaccugacgggguacuacgaggccgugcacccgugcaacguguucugcguccuguccggccccggcgccagcugcgaggcguucuccgagggcgggaucuucaacaucaccagccccaugugccucguguccaagcagaaccgcuuccgggccgccgagcagcagaucagcuucgucugccagcgcguggacauggacaucaucguguacugcaacgggcagaagaagaccauccugaccaagacgcuggucaucggccagugcaucuacaccaucaccucccucuucagccugcugcccgggguggcccacagcaucgccaucgagcucugcgugccgggcuuccacggcugggcgaccgccgcccugcugaucacguucugcuucggguggguccucauccccgccugcacccuggcgauccugcucgugcugaaguucuucgccaacauccugcacaccuccaaccaggagaaccgguucaaggccauccuccgcaagaucaaggaggaguucgagaagaccaagggcagcauggugugcgagaucugcaaguacgagugcgagacgcugaaggagcugaaggcccacaaccucuccugcguccagggggagugccccuacugcuucacccacugcgagcccaccgagaccgccauccaggcgcacuacaaggugugccaggccacgcaccgguuccgcgaggaccugaagaagaccgugaccccgcagaacaucggccccgggugcuaccggacccugaaccuguuccgcuacaagagccggugcuacauccucaccauguggacgcugcugcucaucaucgaguccauccugugggccgccagcgccgcggagaucccccuggucccccucuggaccgacaacgcccacggcgugggcuccgugccgaugcacaccgaccuggagcuggacuucagccuccccuccagcucccgcuacaccuacaagcgccaccugacgaaccccgucaacgaccagcagagcgugucccugcacaucgagaucgagagccaggggaucggcgccgacgugcaccaccucgggcacugguacgacgcccggcugaaccugaagaccuccuuccacugcuacggcgccugcaccaaguaccaguacccguggcacaccgcgaagugccacuucgagaaggacuacgaguacgagaacagcugggccugcaacccgcccgacugccccggcgucgggacgggcugcaccgccugcgggcucuaccuggaccagcugaagcccgugggcaccgccuucaagaucaucuccgugcgcuacagccggaaggucugcgugcaguucggggaggaguaccucugcaagaccaucgacaugaacgacugcuucgugacgcgccacgcgaagaucugcaucaucggcaccgucagcaaguucucccagggcgacacccugcuguuccucgggcccauggagggcgggggcaucaucuucaagcacuggugcaccagcacgugccacuucggggaccccggcgacgugaugggccccaaggacaagccguucaucugccccgaguuccccgggcaguuccggaagaagugcaacuucgccaccacccccgugugcgaguacgacggcaacaucaucuccggguacaagaagguccuggccaccaucgacagcuuccaguccuucaacacgagcaacauccacuucaccgacgagcgcaucgaguggcgggacccggacggcaugcugcgcgaccacaucaacaucgugaucuccaaggacaucgacuucgagaaccucgccgagaaccccugcaagguggggcugcaggccgcgaacaucgagggcgccuggggcagcggggucggcuucacccugaccugccaggugucccucacggagugccccaccuuccugaccagcauccgggccugcgacauggccaucugcuacggggccgaguccgugacccugagccgcggccagaacacggucaagaucaccgggaagggcggccacuccgggagcuccuucaagugcugccacggcaaggagugcagccucaccgggcugcaggcguccgcgccccaccuggacaaggugaacggcaucagcgagcucgagaacgagaagguguacgacgacggcgccccggagugcgggaucacgugcugguucaagaaguccggcgagugggucauggggaucaucaacggcaacuggguggugcugaucguccugugcgugcuccugcuguucagccucauccugcugagcauccucugccccgugcggaagcacaagaaguccuga

SEQ ID NO: 11833 - RNA, 3402 nt, Artificial Sequence
  derived and/or modified CDS sequence (opt1) from SEOV(93HBQ3)__KM115585.1__GP
auguggagccugcuccugcuggccgcccucgugggccagggguucgcccugaagaacgucuucgacaugcgcauccagugcccccacagcgugaaguucggcgagaccagcguguccggguacaccgagcugccgccccucagccugcaggaggccgagcagcugguccccgaguccagcugcaacauggacaaccaccagucccucagcaccaucaacaagcugaccaaggugaucuggcagaagaaggccaaccaggaguccgccaaccagaacagcuucgagguggccgaguccgaggucagcuucaagggccugugcaugcucaagcaccggaugguggaggaguccuaccgcaaccggcgcagcgugaucugcuacgaccuggcgugcaacuccaccuucugcaagcccaccgucuacaugaucgugccgauccacgccugcaacaugaugaaguccugccugaucgggcucggccccuaccggauccagguggucuacgagcgcacguacugcaccaccggcauccugaccgaggggaagugcuucgugcccgacaaggccguggucuccgcccugaagcggggcauguacgcgaucgccagcaucgagacgaucugcuucuucauccaccagaaggggaacaccuacaagaucgugaccgccaucaccuccgccaugggcagcaagugcaacaacacggacaccaaggugcagggguacuacaucugcaucaucggcggcaacagcgcccccgucuacgcgccguccggggaggacuuccgcgccauggagguguucagcggcaucaucaugagcccccacggggaggaccacgaccuccccggcgaggagaucgccaccuaccagaucagcggccagaucgaggccaagaucccccacaccguguccagcaagaaccugaagcugacggccuucgcggggaucccguccuacagcuccaccagcauccucgccgccuccgaggacggccgguucaucuucagccccgggcuguuccccaaccugaaccaguccgucugcgacaacaacgcccucccccugaucuggcgcggccugaucgaccucaccggguacuacgaggccgugcacccgugcaacguguucugcguccugagcggccccggcgcguccugcgaggccuucagcgagggcgggaucuucaacaucaccucccccaugugccuggugagcaagcagaaccgguuccgcgccgccgagcagcagaucuccuucgucugccagcggguggacauggacaucaucguguacugcaacgggcagaagaagacgauccucaccaagacccuggucaucggccagugcaucuacaccaucacgagccuguucagccuccugcccgggguggcccacuccaucgcgaucgagcugugcgugccgggcuuccacggcugggccaccgccgcccuccugaucaccuucugcuucggguggguccugauccccgcgugcacccucgccauccugcuggugcucaaguucuucgccaacauccugcacacgagcaaccaggagaaccgcuucaaggccauccugcggaagaucaaggaggaguucgagaagaccaagggcuccauggugugcgagaucugcaaguacgagugcgagacccucaaggagcugaaggcccacaaccugagcugcguccagggggagugccccuacugcuucacccacugcgagcccacggagaccgcgauccaggcccacuacaaggugugccaggccacccaccgcuuccgggaggaccucaagaagaccgugacgccgcagaacaucggccccgggugcuaccgcacccugaaccuguuccgguacaagucccgcugcuacauccugaccauguggacccuccugcugaucaucgagagcauccucugggccgccuccgcggccgagaucccccuggucccccuguggaccgacaacgcccacggcgugggcagcgugccgaugcacacggaccucgagcuggacuucucccugcccagcuccagcaaguacaccuacaagcggcaccucaccaaccccgucaacgaccagcaguccgugagccugcacaucgagaucgagucccaggggaucggcgccgacgugcaccaccuggggcacugguacgacgcccgccucaaccugaagaccagcuuccacugcuacggcgcgugcacgaaguaccaguacccguggcacaccgccaagugccacuucgagaaggacuacgaguacgagaacuccugggccugcaacccgcccgacugccccggcgucgggaccggcugcaccgccugcgggcuguaccucgaccagcugaagcccgugggcacggcgcugaagaucaucagcgugcgcuacagccggaaggucugcgugcaguucggggaggaguaccucugcaagaccaucgacaugaacgacugcuucgugacccgccacgccaagaucugcaucaucggcaccgucuccaaguucagccagggcgacacgcugcuguuccucgggcccauggagggcgggggcaucaucuucaagcacuggugcaccuccacgugccacuucggggaccccggcgacgugaugggccccaaggacaagccguucaucugccccgaguuccccgggcaguuccggaagaagugcaacuucgccaccacccccgugugcgaguacgacggcaacaucaucagcggguacaagaagguccuggccaccaucgacuccuuccagagcuucaacaccuccaacauccacuucaccgacgagcgcaucgaguggcgggacccggacggcaugcugcgcgaccacaucaacaucgugaucagcaaggacaucgacuucgagaaccucgccgagaaccccugcaagguggggcugcaggcggccaacaucgagggcgccuggggcuccggggucggcuucacgcugaccugccaggugagccucaccgagugccccaccuuccugacguccaucaaggccugcgacauggccaucugcuacggggcggagagcgugacccugcuccggggccagaacaccgucaagaucaccgggaagggcggccacuccgggagcuccuucaagugcugccacggcaaggagugcagcuccacggggcugcaggccagcgcgccccaccuggacaaggugaacggcaucuccgagcucgagaacgagaagguguacgacgacggcgccccggagugcgggaucacgugcugguucaagaaguccggcgagugggucauggggaucaucaacggcaacuggguggugcugaucguccugugcgugcuccugcuguucagccucauccugcugagcauccucugccccgugcgcaagcacaagaaguccuga

SEQ ID NO: 11834 - RNA, 3402 nt, Artificial Sequence
  derived and/or modified CDS sequence (opt1) from SEOV(93HBQ4)__KM115586.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgagguggccgaguccgaggucagcuucaagggccugugcaugcucaagcaccgcaugguggaggaguccuaccggaaccgccggagcgugaucugcuacgaccuggcgugcaacuccaccuucugcaagcccaccgucuacaugaucgugccgauccacgccugcaacaugaugaaguccugccugaucgggcucggccccuaccgcauccagguggucuacgagcggacguacugcaccaccggcauccugaccgaggggaagugcuucgugcccgacaaggccguggucuccgcccugaagcgcggcauguacgcgaucgccagcaucgagacgaucugcuucuucauccaccagaaggggaacaccuacaagaucgugaccgccaucaccuccgccaugggcagcaagugcaacaacacggacaccaaggugcagggguacuacaucugcaucaucggcggcaacagcgcccccgucuacgcgccguccggggaggacuuccgggccauggagguguucagcggcaucaucaugagcccccacggggaggaccacgaccuccccggcgaggagaucgccaccuaccagaucagcggccagaucgaggccaagaucccccacaccguguccagcaagaaccugaagcugacggccuucgcggggaucccguccuacagcuccaccagcauccucgccgccuccggcgacagccgcuucaucuucucccccgggcuguuccccaaccugaaccagagcgucugcgacaacaacgcccucccccugaucuggcggggccugaucgaccucaccggguacuacgaggccgugcacccgugcaacguguucugcguccuguccggccccggcgcgagcugcgaggccuucuccgagggcgggaucuucaacaucaccagccccaugugccugguguccaagcagaaccgcuuccgggccgccgagcagcagaucagcuucgucugccagcgcguggacauggacaucaucguguacugcaacgggcagaagaagacgauccucaccaagacccuggucaucggccagugcaucuacaccaucacgagccuguucucccuccugcccgggguggcccacagcaucgcgaucgagcugugcgugccgggcuuccacggcugggccaccgccgcccuccugaucaccuucugcuucggguggguccugauccccgcgugcacccucgccauccugcuggugcucaaguucuucgccaacauccugcacacguccaaccaggagaaccgguucaaggccauccugcgcaagaucaaggaggaguucgagaagaccaagggcagcauggugugcgagaucugcaaguacgagugcgagacccucaaggagcugaaggcccacaaccuguccugcguccagggggagugccccuacugcuucacccacugcgagcccacggagaccgcgauccaggcccacuacaaggugugccaggccacccaccgguuccgcgaggaccucaagaagaccgugacgccgcagaacaucggccccgggugcuaccggacccugaaccuguuccgcuacaagagccggugcuacauccugaccauguggacccuccugcugaucaucgaguccauccucugggccgccagcgcggccgagaucccccuggucccccuguggaccgacaacgcccacggcgugggcuccgugccgaugcacacggaccucgagcuggacuucagccugcccuccagcuccaaguacaccuacaagcgccaccucaccaaccccgucaacgaccagcagagcgugucccugcacaucgagaucgagagccaggggaucggcgccgacgugcaccaccuggggcacugguacgacgcccgccucaaccugaagaccuccuuccacugcuacggcgcgugcacgaaguaccaguacccguggcacaccgccaagugccacuucgagaaggacuacgaguacgagaacagcugggccugcaacccgcccgacugccccggcgucgggaccggcugcaccgccugcgggcuguaccucgaccagcugaagcccgugggcacggcguucaagaucaucagcgugcgguacucccgcaaggucugcgugcaguucggggaggaguaccugugcaagaccaucgacaugaacgacugcuucgugacccggcacgccaagaucugcaucaucggcaccgucagcaaguucucccagggcgacacgcuccuguuccuggggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgugugcgaguacgacggcaacaucaucuccggguacaagaagguccucgccaccaucgacagcuuccaguccuucaacaccagcaacauccacuucaccgacgagacgaucgaguggcgggacccggacggcaugcugcgcgaccacaucaacaucgugaucuccaaggacaucgacuucgagaaccuggccgagaaccccugcaagguggggcuccaggcggccaacaucgagggcgccuggggcagcggggucggcuucacccugaccugccaggugucccugaccgagugccccacguuccucaccagcaucaaggccugcgacauggccaucugcuacggggcggaguccgugacccugagccggggccagaacaccgucaagaucacggggaagggcggccacuccgggagcuccuucaagugcugccacggcaaggagugcagcuccaccgggcugcaggccagcgcgccccaccucgacaaggugaacggcaucagcgagcuggagaacgagcgcguguacgacgacggcgccccggagugcgggaucacgugcugguucaagaaguccggcgagugggucauggggaucaucaacggcaacuggguggugcugaucguccucugcgugcugcuccuguucagccugauccugcucuccauccugugccccgugcggaagcacaagaaguccuga

SEQ ID NO: 11835 - RNA, 3402 nt, Artificial Sequence
  derived and/or modified CDS sequence (opt1) from SEOV(B1)__AB457790.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcacgaucaacaagcugaccaaggugaucuggcggaagaaggccaaccaggaguccgccaaccagaacagcuucgagguggucgaguccgaggugagcuucaagggccugugcaugcucaagcaccgcaugguggaggaguccuaccggaaccgccggagcgucaucugcuacgaccuggccugcaacuccaccuucugcaagcccaccguguacaugaucgugccgauccacgcgugcaacaugaugaaguccugccugaucgggcucggccccuaccgcauccaggucguguacgagcggacguacugcaccaccggcauccugaccgaggggaagugcuucgugcccgacaaggccgucgugagcgcccugaagcgcggcauguacgccaucgcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggucagcuccaagaaccugcgccugaccgccuucgcggggaucccgagcuacuccagcaccuccauccucgccgccagcgaggacggccgguucaucuucucccccgggcuguuccccaaccugaaccagagcgugugcgacaacaacgcccucccccugaucuggcgcggccugaucgaccucaccggguacuacgaggccgugcacccgugcaacgucuucugcgugcuguccggccccggcgcgagcugcgaggccuucuccgagggcgggaucuucaacaucacgagccccaugugccuggucuccaagcagaaccgguuccgcgccgccgagcagcagaucagcuucgugugccagcggguggacauggacaucaucgucuacugcaacgggcagaagaagaccauccucaccaagacccuggugaucggccagugcaucuacacgaucaccucccuguucagccuccugcccgggguggcccacagcaucgcgaucgagcugugcgucccgggcuuccacggcugggccaccgccgcccuccugaucaccuucugcuucggguggauccugauccccgcguggacgcucgccauccugcuggugcucaaguucuucgccaacauccugcacaccuccaaccaggagaaccgcuucaaggccauccugcggaagaucaaggaggaguucgagaagaccaagggcagcauggugugcgagaucugcaaguacgagugcgagacccucaaggagcugaaggcccacaaccuguccugcguccagggggagugccccuacugcuucacgcacugcgagcccaccgagaccgcgauccaggcccacuacaagaucugccaggccacccaccgcuuccgggaggaccucaagaagacggugaccccgcagaacaucggccccgggugcuaccgcacccugaaccuguuccgguacaagagccgcugcuacauccugaccauguggacccuccugcugaucaucgaguccauccucugggccgccagcgcggccgagaucccccuggugccccuguggacggacaacgcccacggcgucggcuccgugccgaugcacaccgaccucgagcuggacuucagccugcccuccagcuccaaguacaccuacaagcgccaccucaccaaccccgugaacgaccagcagagcgucucccugcacaucgagaucgagagccaggggaucggcgccgacgugcaccaccuggggcacugguacgacgcccggcucaaccugaagacguccuuccacugcuacggcgcgugcaccaaguaccaguacccguggcacaccgccaagugccacuucgagaaggacuacgaguacgagaacagcugggccugcaacccgcccgacugccccggcguggggaccggcugcacggccugcgggcuguaccucgaccagcugaagcccgucggcaccgcguucaagaucaucuccgugcgcuacagccggaaggugugcguccaguucggggaggaguaccugugcaagaccaucgacaugaacgacugcuucgugacccgccacgccaagaucugcaucaucggcacggugagcaaguucucccagggcgacacccuccuguuccuggggcccauggagggcgggggcaucaucuucaagcacuggugcaccagcacgugccacuucggggaccccggcgacgucaugggccccaaggacaagccguucaucugccccgaguuccccgggcaguuccggaagaagugcaacuucgccaccacccccgugugcgaguacgacggcaacaucaucuccggguacaagaaggugcucgccaccaucgacagcuuccaguccuucaacaccagcaacauccacuucacggacgagcgcaucgaguggcgggacccggacggcaugcugcgcgaccacaucaacaucgucaucuccaaggacaucgacuucgagaaccuggccgagaaccccugcaagguggggcuccaggcggccaacaucgagggcgccuggggcagcggggugggcuucacccugaccugccaggucucccugaccgagugccccacguuccucaccagcaucaaggccugcgacauggccaucugcuacggggcggaguccgugaagcugagccggggccagaacaccgugaagaucaccgggaagggcggccacuccgggagcuccuucaagugcugccacggcaaggagugcagcuccacggggcugcaggccagcgcgccccaccucgacaaggucaacggcaucuccgagcuggagaacgagaagguguacgacgacggcgccccggagugcggggugaccugcugguucaagaaguccggcgagugggucauggggaucaucaacggcaacuggguggugcugaucguccucugccugcugcuccuguucagccugauccuccugagcauccugugccccgugcgcaagcacaagaaguccuga

SEQ ID NO: 11836 - RNA, 3402 nt, Artificial Sequence
  derived and/or modified CDS sequence (opt1) from SEOV(B1)__AB457791.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcacgaucaacaagcugaccaaggugaucuggcagaagaaggccaaccaggaguccgccaaccagaacagcuucgagguggucgaguccgaggugagcuucaagggccugugcaugcucaagcaccggaugguggaggaguccuaccgcaaccggcgcagcgucaucugcuacgaccuggccugcaacuccaccuucugcaagcccaccguguacaugaucgugccgauccacgcgugcaacaugaugaaguccugccugaucgggcucggccccuaccggauccaggucgccuacgagcgcacguacugcaccaccggcauccugaccgaggggaagugcuucgugcccgacaaggccguggucagcgcccugaagcggggcauguacgcgaucgccagcaucgagacgaucugcuucuucauccaccagaaggggaacaccuacaagaucgugaccgccaucaccuccgccaugggcagcaagugcaacaacacggacaccaaggugcagggguacuacaucugcaucaucggcggcaacagcgcccccgucuacgcgccggccggggaggacuuccgcgccauggagguguucuccggcaucaucaccagcccccacggggaggaccacgaccuccccggcgaggagaucgccaccuaccagaucuccggccagaucgaggccaagaucccccacacggugagcuccaagaaccugcggcugaccgcguucgccgggaucccgagcuacuccagcaccuccauccucgccgccagcaaggacggccgcuucaucuucucccccgggcuguuccccaaccugaaccagagcgucugcgacaacaacgcccucccccugaucuggcggggccugaucgaccucaccggguacuacgaggcggugcacccgugcaacguguucugcguccuguccggccccggcgccagcugcgaggccuucuccgagggcgggaucuucaacaucacgagccccaugugccugguguccaagcagaaccgcuuccgggccgccgagcagcagaucagcuucgucugccagcgcguggacauggacaucaucguguacugcaacgggcagaagaagaccauccucaccaagacccuggucaucggccagugcaucuacacgaucaccucccuguucagccuccugcccgggguggcgcacagcaucgccaucgagcugugcgugccgggcuuccacggcugggccaccgccgcgcuccugaucaccuucugcuucggguggauccugauccccgccugcacgcucgccauccugcugguccucaaguucuucgccaacauccugcacaccuccaaccaggagaaccgguucaaggccauccugcgcaagaucaaggaggaguucgagaagaccaagggcagcauggugugcgagaucugcaaguacgagugcgagacccucaaggagcugaaggcgcacaaccuguccugcgugcagggggagugccccuacugcuucacgcacugcgagcccaccgagaccgccauccaggcccacuacaagaucugccaggccacccaccgguuccgcgaggaccucaagaagacggucaccccgcagaacaucggccccgggugcuaccggacccugaaccuguuccgcuacaagagccggugcuacauccugaccauguggacccuccugcugaucaucgaguccauccucugggccgcgagcgccgccgagaucccccuggugccccuguggacggacaacgcccacggcgugggcuccgucccgaugcacaccgaccucgagcuggacuucagccugcccuccagcuccaaguacaccuacaagcgccaccucaccaaccccgugaacgaccagcagagcgugucccugcacaucgagaucgagagccaggggaucggcgccgacguccaccaccuggggcacugguacgacgcgcgccucaaccugaagacguccuuccacugcuacggcgccugcaccaaguaccaguacccguggcacaccgccaagugccacuucgagaaggacuacgaguacgagaacagcugggccugcaacccgcccgacugccccggcguggggaccggcugcacggcgugcgggcuguaccucgaccagcugaagcccgugggcaccgccuucaagaucaucuccguccgguacagccgcaaggugugcgugcaguucggggaggaguaccugugcaagaccaucgacaugaacgacugcuucgucacccggcacgccaagaucugcaucaucggcacggugagcaaguucucccagggcgacacccuccuguuccuggggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgucugcgaguacgacggcaacaucaucuccggguacaagaaggugcucgccaccaucgacagcuuccaguccuucaacaccagcaacauccacuucacggacgagcggaucgaguggcgcgacccggacggcaugcugcgggaccacaucaacaucgugaucuccaaggacaucgacuucgagaaccuggcggagaaccccugcaaggucgggcuccaggccgccaacaucgagggcgccuggggcagcggggugggcuucacccugaccugccaggugucccugaccgagugccccacguuccucaccagcaucaaggccugcgacauggcgaucugcuacggggccgaguccgucacccugagccgcggccagaacaccgugaagaucacggggaagggcggccacuccgggagcuccuucaagugcugccacggcaaggagugcagcuccaccgggcugcaggccagcgcgccccaccucgacaaggugaacggcaucuccgagcuggagaacgagaaggucuacgacgacggcgccccggagugcggggugaccugcugguucaagaaguccggcgagugggugauggggaucaucaacggcaacugggucgugcugaucgugcucugccugcugcuccuguucagccugauccuccugagcauccugugccccauccggaagcacaagaaguccuga

SEQ ID NO: 11837 - RNA, 3402 nt, Artificial Sequence
  derived and/or modified CDS sequence (opt1) from SEOV(B1)__AB457792.1__GP
auguggagccugcuccugauggccgcccuggugggccagggguucgcccucaagaacgucuucgacaugcgcauccagugcccccacagcgugaacuucggcgagaccagcguguccggguacaccgagcugccgccccugagccuccaggaggccgagcagcugguccccgaguccagcugcaacauggacaaccaccagucccugagcacgaucaacaagcucaccaaggugaucuggcagaagaaggccaaccaggaguccgccaaccagaacagcuucgagguggucgaguccgaggugagcuucaagggccugugcaugcugaagcaccggaugguggaggaguccuaccgcaaccggcgcagcgucaucugcuacgaccucgccugcaacuccaccuucugcaagcccaccguguacaugaucgugccgauccacgcgugcaacaugaugaaguccugccugaucgggcugggccccuaccggauccaggucgccuacgagcgcacguacugcaccaccggcauccucaccgaggggaagugcuucgugcccgacaaggccguggucagcgcccugaagcggggcauguacgcgaucgccagcaucgagacgaucugcuucuucauccaccagaaggggaacaccuacaagaucgugaccgccaucaccuccgccaugggcagcaagugcaacaacacggacaccaaggugcagggguacuacaucugcaucaucggcggcaacagcgcccccgucuacgcgccggccggggaggacuuccgcgccauggagguguucuccggcaucaucaccagcccccacggggaggaccacgaccugcccggcgaggagaucgccaccuaccagaucuccggccagaucgaggccaagaucccccacacggugagcuccaagaaccuccggcugaccgcguucgccgggaucccgagcuacuccagcaccuccauccuggccgccagcaaggacggccgcuucaucuucucccccgggcuguuccccaaccugaaccagagcgucugcgacaacaacgcccugccccucaucuggcggggccugaucgaccugaccggguacuacgaggcggugcacccgugcaacguguucugcguccucuccggccccggcgccagcugcgaggccuucuccgagggcgggaucuucaacaucacgagccccaugugccugguguccaagcagaaccgcuuccgggccgccgagcagcagaucagcuucgucugccagcgcguggacauggacaucaucguguacugcaacgggcagaagaagaccauccugaccaagacccucgucaucggccagugcaucuacacgaucaccucccuguucagccugcuccccgggguggcgcacagcaucgccaucgagcugugcgugccgggcuuccacggcugggccaccgccgcgcugcucaucaccuucugcuucggguggauccugauccccgccugcacgcuggccauccuccugguccugaaguucuucgccaacauccuccacaccuccaaccaggagaaccgguucaaggccauccugcgcaagaucaaggaggaguucgagaagaccaagggcagcauggugugcgagaucugcaaguacgagugcgagacccugaaggagcucaaggcgcacaaccuguccugcgugcagggggagugccccuacugcuucacgcacugcgagcccaccgagaccgccauccaggcccacuacaagaucugccaggccacccaccgguuccgcgaggaccugaagaagacggucaccccgcagaacaucggccccgggugcuaccggacccucaaccuguuccgcuacaagagccggugcuacauccugaccauguggacccugcuccugaucaucgaguccauccugugggccgcgagcgccgccgagaucccccucgugccccuguggacggacaacgcccacggcgugggcuccgucccgaugcacaccgaccuggagcucgacuucagccugcccuccagcuccaaguacaccuacaagcgccaccugaccaaccccgugaacgaccagcagagcgugucccuccacaucgagaucgagagccaggggaucggcgccgacguccaccaccuggggcacugguacgacgcgcgccugaaccucaagacguccuuccacugcuacggcgccugcaccaaguaccaguacccguggcacaccgccaagugccacuucgagaaggacuacgaguacgagaacagcugggccugcaacccgcccgacugccccggcguggggaccggcugcacggcgugcgggcuguaccuggaccagcucaagcccgugggcaccgccuucaagaucaucuccguccgguacagccgcaaggugugcgugcaguucggggaggaguaccugugcaagaccaucgacaugaacgacugcuucgucacccggcacgccaagaucugcaucaucggcacggugagcaaguucucccagggcgacacccuccucuuccuggggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgucugcgaguacgacggcaacaucaucuccggguacaagaaggugcuggccaccaucgacagcuuccaguccuucaacaccagcaacauccacuucacggacgagcggaucgaguggcgcgacccggacggcaugcuccgggaccacaucaacaucgugaucuccaaggacaucgacuucgagaaccuggcggagaaccccugcaaggucgggcugcaggccgccaacaucgagggcgccuggggcagcggggugggcuucacccugaccugccaggugucccugaccgagugccccacguuccugaccagcaucaaggccugcgacauggcgaucugcuacggggccgaguccgucacccucagccgcggccagaacaccgugaagaucacggggaagggcggccacuccgggagcuccuucaagugcugccacggcaaggagugcagcuccaccgggcugcaggccagcgcgccccaccuggacaaggugaacggcaucuccgagcucgagaacgagaaggucuacgacgacggcgccccggagugcggggugaccugcugguucaagaaguccggcgagugggugauggggaucaucaacggcaacugggucgugcugaucgugcugugccuccugcuccucuucagccugauccugcucagcauccugugccccauccggaagcacaagaaguccuga

SEQ ID NO: 11838 - RNA, 3402 nt, Artificial Sequence
  derived and/or modified CDS sequence (opt1) from SEOV(B1)__AB457793.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcacgaucaacaagcugaccaaggugaucuggcagaagaaggccaaccaggaguccgccaaccagaacagcuucgagguggucgaguccgaggugagcuucaagggccugugcaugcucaagcaccggaugguggaggaguccuaccgcaaccggcgcagcgucaucugcuacgaccuggccugcaacuccaccuucugcaagcccaccguguacaugaucgugccgauccacgcgugcaacaugaugaaguccugccugaucgggcucggccccuaccggauccaggucgccuacgagcgcacguacugcaccaccggcauccugaccgaggggaagugcuucgugcccgacaaggccguggucagcgcccugaagcggggcauguacgcgaucgccagcaucgagacgaucugcuucuucauccaccagaaggggaacaccuacaagaucgugaccgccaucaccuccgccaugggcagcaagugcaacaacacggacaccaaggugcagggguacuacaucugcaucaucggcggcaacagcgcccccgucuacgcgccggccggggaggacuuccgcgccauggagguguucuccggcaucaucaccagcccccacggggaggaccacgaccuccccggcgaggagaucgccaccuaccagaucuccggccagaucgaggccaagaucccccacacggugagcuccaagaaccugcggcugaccgcguucgccgggaucccgagcuacuccagcaccuccauccucgccgccagcaaggacggccacuucaucuucucccccgggcuguuccccaaccugaaccagagcgucugcgacaacaacgcccucccccugaucuggcgcggccugaucgaccucaccggguacuacgaggcggugcacccgugcaacguguucugcguccuguccggccccggcgccagcugcgaggccuucuccgagggcgggaucuucaacaucacgagccccaugugccugguguccaagcagaaccgguuccgcgccgccgagcagcagaucagcuucgucugccagcggguggacauggacaucaucguguacugcaacgggcagaagaagaccauccucaccaagacccuggucaucggccagugcaucuacacgaucaccucccuguucagccuccugcccgggguggcgcacagcaucgccaucgagcugugcgugccgggcuuccacggcugggccaccgccgcgcuccugaucaccuucugcuucggguggauccugauccccgccugcacgcucgccauccugcugguccucaaguucuucgccaacauccugcacaccuccaaccaggagaaccgcuucaaggccauccugcggaagaucaaggaggaguucgagaagaccaagggcagcauggugugcgagaucugcaaguacgagugcgagacccucaaggagcugaaggcgcacaaccuguccugcgugcagggggagugccccuacugcuucacgcacugcgagcccaccgagaccgccauccaggcccacuacaagaucugccaggccacccaccgcuuccgggaggaccucaagaagacggucaccccgcagaacaucggccccgggugcuaccgcacccugaaccuguuccgguacaagagccgcugcuacauccugaccauguggacccuccugcugaucaucgaguccauccucugggccgcgagcgccgccgagaucccccuggugccccuguggacggacaacgcccacggcgugggcuccgucccgaugcacaccgaccucgagcuggacuucagccugcccuccagcuccaaguacaccuacaagcggcaccucaccaaccccgugaacgaccagcagagcgugucccugcacaucgagaucgagagccaggggaucggcgccgacguccaccaccuggggcacugguacgacgcgcgccucaaccugaagacguccuuccacugcuacggcgccugcaccaaguaccaguacccguggcacaccgccaagugccacuucgagaaggacuacgaguacgagaacagcugggccugcaacccgcccgacugccccggcguggggaccggcugcacggcgugcgggcuguaccucgaccagcugaagcccgugggcaccgccuucaagaucaucuccguccgcuacagccggaaggugugcgugcaguucggggaggaguaccugugcaagaccaucgacaugaacgacugcuucgucacccgccacgccaagaucugcaucaucggcacggugagcaaguucucccagggcgacacccuccuguuccuggggcccauggagggcgggggcaucaucuucaagcacuggugcaccagcacgugccacuucggggaccccggcgacgugaugggccccaaggacaagccguucaucugccccgaguuccccgggcaguuccggaagaagugcaacuucgccaccacccccgucugcgaguacgacggcaacaucaucuccggguacaagaaggugcucgccaccaucgacagcuuccaguccuucaacaccagcaacauccacuucacggacgagcgcaucgaguggcgggacccggacggcaugcugcgcgaccacaucaacaucgugaucuccaaggacaucgacuucgagaaccuggcggagaaccccugcaaggucgggcuccaggccgccaacaucgagggcgccuggggcagcggggugggcuucacccugaccugccaggugucccugaccgagugccccacguuccucaccagcaucaaggccugcgacauggcgaucugcuacggggccgaguccgucacccugagccggggccagaacaccgugaagaucacggggaagggcggccacuccgggagcuccuucaagugcugccacggcaaggagugcagcuccaccgggcugcaggccagcgcgccccaccucgacaaggugaacggcaucuccgagcuggagaacgagaaggucuacgacgacggcgccccggagugcggggugaccugcugguucaagaaguccggcgagugggugauggggaucaucaacggcaacugggucgugcugaucgugcucugccugcugcuccuguucagccugauccuccugagcauccugugccccauccgcaagcacaagaaguccuga

SEQ ID NO: 11839 - RNA, 3402 nt, Artificial Sequence
  derived and/or modified CDS sequence (opt1) from SEOV(B1)__AB457794.1__GP
auguggagccugcuccugauggccgcccuggugggccagggguucgcccucaagaacgucuucgacaugcgcauccagugcccccacagcgugaacuucggcgagaccagcguguccggguacaccgagcugccgccccugagccuccaggaggccgagcagcugguccccgaguccagcugcaacauggacaaccaccagucccugagcacgaucaacaagcucaccaaggugaucuggcagaagaaggccaaccaggaguccgccaaccagaacagcuucgagguggucgaguccgaggugagcuucaagggccugugcaugcugaagcaccggaugguggaggaguccuaccgcaaccggcgcagcgucaucugcuacgaccucgccugcaacuccaccuucugcaagcccaccguguacaugaucgugccgauccacgcgugcaacaugaugaaguccugccugaucgggcugggccccuaccggauccaggucgccuacgagcgcacguacugcaccaccggcauccucaccgaggggaagugcuucgugcccgacaaggccguggucagcgcccugaagcggggcauguacgcgaucgccagcaucgagacgaucugcuucuucauccaccagaaggggaacaccuacaagaucgugaccgccaucaccuccgccaugggcagcaagugcaacaacacggacaccaaggugcagggguacuacaucugcaucaucggcggcaacagcgcccccgucuacgcgccggccggggaggacuuccgcgccauggagguguucuccggcaucaucaccagcccccacggggaggaccacgaccugcccggcgaggagaucgccaccuaccagaucuccggccagaucgaggccaagaucccccacacggugagcuccaagaaccuccggcugaccgcguucgccgggaucccgagcuacuccagcaccuccauccuggccgccagcaaggacggccacuucaucuucucccccgggcuguuccccaaccugaaccagagcgucugcgacaacaacgcccugccccucaucuggcgcggccugaucgaccugaccggguacuacgaggcggugcacccgugcaacguguucugcguccucuccggccccggcgccagcugcgaggccuucuccgagggcgggaucuucaacaucacgagccccaugugccugguguccaagcagaaccgguuccgcgccgccgagcagcagaucagcuucgucugccagcggguggacauggacaucaucguguacugcaacgggcagaagaagaccauccugaccaagacccucgucaucggccagugcaucuacacgaucaccucccuguucagccugcuccccgggguggcgcacagcaucgccaucgagcugugcgugccgggcuuccacggcugggccaccgccgcgcugcucaucaccuucugcuucggguggauccugauccccgccugcacgcuggccauccuccugguccugaaguucuucgccaacauccuccacaccuccaaccaggagaaccgcuucaaggccauccugcggaagaucaaggaggaguucgagaagaccaagggcagcauggugugcgagaucugcaaguacgagugcgagacccugaaggagcucaaggcgcacaaccuguccugcgugcagggggagugccccuacugcuucacgcacugcgagcccaccgagaccgccauccaggcccacuacaagaucugccaggccacccaccgcuuccgggaggaccugaagaagacggucaccccgcagaacaucggccccgggugcuaccgcacccucaaccuguuccgguacaagagccgcugcuacauccugaccauguggacccugcuccugaucaucgaguccauccugugggccgcgagcgccgccgagaucccccucgugccccuguggacggacaacgcccacggcgugggcuccgucccgaugcacaccgaccuggagcucgacuucagccugcccuccagcuccaaguacaccuacaagcggcaccugaccaaccccgugaacgaccagcagagcgugucccuccacaucgagaucgagagccaggggaucggcgccgacguccaccaccuggggcacugguacgacgcgcgccugaaccucaagacguccuuccacugcuacggcgccugcaccaaguaccaguacccguggcacaccgccaagugccacuucgagaaggacuacgaguacgagaacagcugggccugcaacccgcccgacugccccggcguggggaccggcugcacggcgugcgggcuguaccuggaccagcucaagcccgugggcaccgccuucaagaucaucuccguccgcuacagccggaaggugugcgugcaguucggggaggaguaccugugcaagaccaucgacaugaacgacugcuucgucacccgccacgccaagaucugcaucaucggcacggugagcaaguucucccagggcgacacccuccucuuccuggggcccauggagggcgggggcaucaucuucaagcacuggugcaccagcacgugccacuucggggaccccggcgacgugaugggccccaaggacaagccguucaucugccccgaguuccccgggcaguuccggaagaagugcaacuucgccaccacccccgucugcgaguacgacggcaacaucaucuccggguacaagaaggugcuggccaccaucgacagcuuccaguccuucaacaccagcaacauccacuucacggacgagcgcaucgaguggcgggacccggacggcaugcuccgcgaccacaucaacaucgugaucuccaaggacaucgacuucgagaaccuggcggagaaccccugcaaggucgggcugcaggccgccaacaucgagggcgccuggggcagcggggugggcuucacccugaccugccaggugucccugaccgagugccccacguuccugaccagcaucaaggccugcgacauggcgaucugcuacggggccgaguccgucacccucagccggggccagaacaccgugaagaucacggggaagggcggccacuccgggagcuccuucaagugcugccacggcaaggagugcagcuccaccgggcugcaggccagcgcgccccaccuggacaaggugaacggcaucuccgagcucgagaacgagaaggucuacgacgacggcgccccggagugcggggugaccugcugguucaagaaguccggcgagugggugauggggaucaucaacggcaacugggucgugcugaucgugcugugccuccugcuccucuucagccugauccugcucagcauccugugccccauccgcaagcacaagaaguccuga

SEQ ID NO: 11840 - RNA, 3402 nt, Artificial Sequence
  derived and/or modified CDS sequence (opt1) from SEOV(B-1)__X53861.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcacgaucaacaagcugaccaaggugaucuggcggaagaaggccaaccaggaguccgccaaccagaacagcuucgagguggucgaguccgaggugagcuucaagggccugugcaugcucaagcaccgcaugguggaggaguccuaccggaaccgccggagcgucaucuacuacgaccuggccgggaacuccaccuucugcaagcccaccguguacaugaucgugccgauccacgcgugcaacaugaugaaguccugccugaucggccucggccccuaccgcauccaggucguguacgagcggacguacugcaccaccgggauccugaccgagggcaagugcuucgugcccgacaaggccgucgugagcgcccugaagcgcgggauguacgccaucgcgagcaucgagacgaucugcuucuucauccaccagaaguggaacaaguacaagaucgugaccgccaucaccuccgccaugggcagcaagugcaacaacaccgacacgaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccacaucuccggccagaucgaggccaagaucccccacaccgucagcuccaagaaccugcgccuggccgcguucgccgggaucccgagcuacuccagcacguccauccucgccgccagcgaggacggccgguucaucuucucccccgggcuguuccccaaccugaaccagagcgugugcgacaacaacgcccucccccugaucuggcgcggccugaucgaccucaccggguacuacgaggcggugcacccgugcaacgucuucugcgugcuguccggccccggcgccagcugcgaggccuucuccgagggcgggaucuucaacaucaccagccccaugugccuggucuccaagcagaaccgguuccgcgccgccgagcagcagaucagcuucgugugccagcggguggacauggacaucaucgucuacugcaacgggcagaagaagaccauccucacgaagacccuggugaucggccagugcaucuacaccaucaccucccuguucagccuccugcccgggguggcgcacagcaucgccaucgagcugugcgucccgggcuuccacggcugggccacggccgcgcuccugaucaccuucugcuucgggugggugcugauccccgccugcacccucgccauccugcuggugcucaaguucuucgccaacauccugcacaccuccaaccaggagaaccgcuucaaggccauccugcggaagaucaaggaggaguucgagaagcgcaagggcagcauggucugcgagaucugcaaguacgagugcgagacgcucaaggagcugaaggcgcacaaccuguccugcgugcagggggagugccccuacugcuucacccacugcgagcccaccgagaccgccauccaggcccacuacaaggugugccaggccacgcaccgguuccgcgaggaccucaagaagaccgucaccccgcagaacaucggccccgggugcuaccggacccugaaccuguuccgcuacaagagccgcugcuacauccugacgauguggacccuccugcugaucaucgaguccauccucugggccgcgagcgccgccgagaucccccuggugccccuguggaccgacaacgcccacggcgugggcuccgucccgaugcacaccgaccucgagcuggacuucagccugcccuccagcuccaaguacaccuacaagcggcaccucacgaaccccgugaacgaccagcagagcgugucccugcacaucgagaucgagagccaggggaucggcgccgacguccaccaccuggggcacugguacgacgcgcgccucaaccugaagaccuccuuccacugcuacggcgccugcaccaaguaccaguacccguggcacaccgccaagugccacuucgagaaggacuacgaguacgagaacagcugggccugcaacccgcccgacugccccggcguggggacgggcugcaccgcgugcgggcuguaccucgaccagcugaagcccgugggcaccgccuucaagaucaucuccguccgguacagccgcaaggugugcgugcaguucggggaggagcaccugugcaagaccaucgacaugaacgacugcuucgucacgcggcacgccaagaucugcaucaucggcaccgugagcaaguucucccagggcgacacccuccuguuccuggggcccauggagggcgggggcaucaucuucaagcacuggugcaccagcacgugccacuucggggacccccgcgacgugaugggccccaaggacaagccguucaucugccccgaguuccccggccaguuccggaagaagugcaacuucgccaccacccccgucugcgaguacgacgggaacaucaucuccggcuacaagaaggugcucgccaccaucgacagcuuccaguccuucaacacgagcaacauccacuucaccgacgagcgcaucgaguggcgggacccggacgggaugcugcgcgaccacaucaacaucgugaucuccaaggacaucgacuucgagaaccuggcggagaaccccugcaaggucggccuccaggccgccaacaucgagggggccuggggcagcggcgugggguucacccugaccugccaggugucccugacggagugccccaccuuccucaccagcaucaaggccugcgacauggcgaucugcuacggcgccgaguccgucacccugagccgggggcagaacacggugaagaucaccggcaagggcgggcacuccggcagcuccuucaagugcugccacgggaaggagugcagcuccaccggccugcaggccagcgcgccccaccucgacaaggugaacgggaucuccgagcuggagaacgagaaggucuacgacgacggcgccccggagugcggcgugaccugcugguucaagaaguccggggagugggugaugggcaucaucaacgggaacugggucgugcugaucgugcucugcguccugcuccuguucagccugauccugcucagcauccugugccccgugcgcaagcacaagaaguccuga

SEQ ID NO: 11841 - RNA, 3402 nt, Artificial Sequence
  derived and/or modified CDS sequence (opt1) from SEOV(BjHD01)__DQ133505.1__GP
auguggagccuccucuuccuggccgcccuggugggccagggguucgcccucaagaacgucuucgacaugcgcauccagugcccccacagcgugaacuucggcgagaccagcguguccggguacaccgagcugccgccccugagccuccaggaggccgagcagcugguccccgaguccagcugcaacauggacaaccaccagucccugagcacgaucaacaagcucaccaaggugaucuggcggaagaaggccaaccaggaguccgccaaccagaacagcuucgagguggucgaguccgaggugagcuucaagggccugugcaugcugaagcaccgcaugguggaggaguccuaccggaaccgccggagcgucaucugcuacgaccucgccugcaacuccaccuucugcaagcccaccguguacaugaucgugccgauccacgcgugcaacaugaugaaguccugccugaucgggcugggccccuaccgcauccaggucguguacgagcggacguacugcaccaccggcauccucaccgaggggaagugcuucgugcccgacaaggccgucgugagcgcccugaagcgcggcauguacgccaucgcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccugcccggcgaggaggucgccaccuaccagaucuccggccagaucgaggccaagaucccccacacggugagcuccaagaaccucaagcugaccgccuucgcggggaucccgagcuacuccagcaccuccauccuggccgccagcgaggacggccgcuucaucuucucccccgggcuguuccccaaccugaaccagagcgugugcgacaacaacgcccugccccucaucuggcggggccugaucgaccugaccggguacuacgaggccguccacccgugcaacguguucugcguccucuccggccccggcgcgagcugcgaggccuucuccgagggcgggaucuucaacaucacgagccccaugugccugguguccaagcagaaccgcuuccgggccgccgagcagcagaucagcuucgugugccagcgcgucgacauggacaucaucguguacugcaacgggcagaagaagaccauccugaccaagacccucgugaucggccagugcaucuacacgaucaccucccuguucagccugcuccccggggucgcccacagcaucgcgaucgagcugugcgugccgggcuuccacggcugggccaccgccgcccugcucaucaccuucugcuucgggugggugcugauccccgcgugcacgcuggccauccuccugguccugaaguucuucgccaacauccuccacaccuccaaccaggagaaccgguucaaggccauccugcgcaagaucaaggaggaguucgagaagaccaagggcagcauggugugcgagaucugcaaguacgagugcgagacccugaaggagcucaaggcccacaaccuguccugcgugcagggggagugccccuacugcuucacgcacugcgagcccaccgagaccgcgauccaggcccacuacaaggucugccaggccacccaccgguuccgcgaggaccugaagaagacggugaccccgcagaacaucggccccgggugcuaccggacccucaaccuguuccgcuacaagagccggugcuacauccugaccauguggacccugcuccugaucaucgaguccauccugugggccgccagcgcggccgagaucccccucgugccccuguggacggacaacgcccacggcgucggcuccgugccgaugcacaccgaccuggagcucgacuucagccugcccuccagcuccaaguacaccuacaagcgccaccugaccaaccccgugaacgaccagcagagcgucucccuccacaucgagaucgagagccaggggaucggcgccgacgugcaccaccuggggcacugguacgacgcccgccugaaccucaagacguccuuccacugcuacggcgcgugcaccaaguaccaguacccguggcacaccgccaagugccacuucgagaaggacuacgaguacgagaacagcugggccugcaacccgcccgacugccccggcguggggaccggcugcacggccugcgggcuguaccuggaccagcucaagcccgucggcaccgcguucaagaucaucuccgugcgguacagccgcaaggugugcguccaguucggggaggaguaccugugcaagaccaucgacaugaacgacugcuucgugacccggcacgccaagaucugcaucaucggcacggugagcaaguucucccagggcgacacccuccucuuccuggggcccauggagggcgggggcaucaucuucaagcacuggugcaccagcacgugccacuucggggaccccggcgacgucaugggccccaaggacaagccguucaucugccccgaguuccccgggcaguuccgcaagaagugcaacuucgccaccacccccgugugcgaguacgacggcaacaucaucuccggguacaagaaggugcuggccaccaucgacagcuuccaguccuucaacaccagcaacauccacuucacggacgagcggaucgaguggcgcgacccggacggcaugcuccgggaccacaucaacaucgucaucuccaaggacaucgacuucgagaaccuggccgagaaccccugcaagguggggcugcaggcggccaacaucgagggcgccuggggcagcggggugggcuucacccugaccugccaggucucccugaccgagugccccacguuccugaccagcaucaaggccugcgacauggccaucugcuacggggcggaguccgugacccucagccgcggccagaacaccgugaagaucacggggaagggcggccacuccgggagcuccuucaagugcugccacggcgaggagugcagcuccaccgggcugcaggccagcgcgccccaccuggacaaggucaacggcaucuccgagcucgagaacgagaagguguacgacgacggcgccccggagugcggggugaccugcugguucaagaaguccggcgagugggucauggggaucaucaacggcaacuggguggugcugaucguccugugcgugcuccugcuguucagccucauccugcugagcauccucugccccgugcggaagcacaagaaguccuga

SEQ ID NO: 11842 - RNA, 3402 nt, Artificial Sequence
  derived and/or modified CDS sequence (opt1) from SEOV(Cherwell)__KM948593.1__GP
auguggagccugcuccugcuggccgcccucgugggccaggggagcgcgcugaagaacgucuucgacaugcgcauccagugcccccacagcgugaacuucggcgagaccuccgugagcggguacaccgagcugccgccccucucccugcaggaggccgagcagcugguccccgagagcuccugcaacauggacaaccaccagagccucuccacgaucaacaagcugaccaaggugaucuggcggaagaaggccaaccaggagagcgccaaccagaacuccuucgagguggucgagagcgagguguccuucaagggccugugcaugcucaagcaccgcaugguggaggagagcuaccggaaccgccgguccgucaucugcuacgaccuggccugcaacagcaccuucugcaagcccaccguguacaugaucgugccgauccacgcgugcaacaugaugaaguccugccugaucgggcucggccccuaccgcauccaggucguguacgagcggacguacugcaccaccggcauccugaccgaggggaagugcuucgugcccgacaaggccgucgugagcgcccugaagcgcggcauguacgccaucgcguccaucgagacgaucugcuucuucauccaccagaaggggaacaccuacaagaucgugaccgccaucaccagcgccaugggcagcaagugcaacaacacggacaccaagguccagggguacuacaucugcaucaucggcggcaacuccgcccccguguacgccccggcgggggaggacuuccgggccauggagguguucagcggcaucaucaccagcccccacggggaggaccacgaccuccccggcgaggagaucgccaccuaccagaucagcggccagaucgaggccaagaucccccacacggucuccagcaagaaccugaagcugaccgccuucgcggggaucccguccuacagcuccaccagcauccucgccgccuccgaggacggccgcuucaucuucagccccgggcuguuccccaaccugaaccaguccgugugcgacaacaacgcccucccccugaucuggcggggccugaucgaccucaccggguacuacgaggccgugcacccgugcaacgucuucugcgugcugagcggccccggcgcguccugcgaggccuucagcgagggcgggaucuucaacaucacgucccccaugugccuggucagcaagcagaaccgcuuccgggccgccgagcagcagaucuccuucgugugccagcgcguggacauggacaucaucgucuacugcaacgggcagaagaagaccauccucaccaagacccuggugaucggccagugcaucuacacgaucaccagccuguucagccuccugcccgggguggcccacuccaucgcgaucgagcugugcgucccgggcuuccacggcugggccaccgccgcccuccugaucaccuucugcuucgggugggugcugauccccgcgugcacgcucgccauccugcuggugcucaaguucuucgccaacauccugcacaccagcaaccaggagaaccgguucaaggccauccugcgcaagaucaaggaggaguucgagaagaccaagggcuccauggucugcgagaucugcaaguacgagugcgagacccucaaggagcugaaggcccacaaccugagcugcgugcagggggagugccccuacugcuucacgcacugcgagcccaccgagaccgcgauccaggcccacuacaaggugugccaggccacccaccgguuccgcgaggaccucaagaagacggucaccccgcccaacaucggccccgggugcuaccggacccugaaccuguuccgcuacaagucccggugcuacauccugaccauguggacccuccugcugaucaucgagagcauccucugggccgccuccgcggccgagaucccccuggugccgcuguggacggacaacgcccacggcgugggcagcguccccaugcacaccgaccucgagcuggacuucucccugcccagcuccagcaaguacaccuacaagcgccaccucaccaacccggugaacgaccagcaguccgugagccugcacaucgagaucgagucccaggggaucggcgccgacguccaccaccuggggcacugguacgacgcccgccucaaccugaagacgagcuuccacugcuacggcgcgugcaccaaguaccaguaccccuggcacaccgccaagugccacuucgagaaggacuacgaguacgagaacuccugggccugcaacccgcccgacugccccggcguggggaccggcugcacggccugcgggguguaccuggaccagcucaagcccgucggcaccgcguucaagaucgugagcgugcgguacagccgcaaggucugcgugcaguucggggaggaguaccugugcaagaccaucgacaugaacgacugcuucgugacccggcacgccaagaucugcaucaucggcacggucuccaaguucagccagggcgacacccuccucuuccuggggcccauggagggcgggggcaucaucuucaagcacuggugcaccuccacgugccacuucggggaccccggcgacgugaugggcccgaaggacaagcccuucaucugccccgaguuccccgggcaguuccgcaagaagugcaacuucgccaccaccccggugugcgaguacgacggcaacaucaucagcggguacaagaagguccuggccaccaucgacuccuuccagagcuucaacaccuccaacauccacuucacggacgagcggaucgaguggcgcgaccccgacggcaugcuccgggaccacaucaacaucgugaucagcaaggacaucgacuucgagaaccuggccgagaaccccugcaagguggggcugcaggcggccaacaucgagggcgccuggggcuccggggucggcuucacccugaccugccaggugagccugaccgagugccccacguuccugaccuccaucaaggccugcgacauggccaucugcuacggggcggagagcgugacccucucccgcggccagaacaccgucaagaucacggggaagggcggccacagcggguccagcuucaagugcugccacggcaaggagugcuccagcaccgggcugcaggccuccgccccgcaccuggacaaggugaacggcaucagcgagcucgagaacgagaagguguacgacgacggcgcccccgagugcggggugaccugcugguucaagaaguccuccgagugggucaugggcaucaucaacgggaacugggugguccugaucgugcugugcgugcuccugcuguucagccucauccugcuguccauccucugccccguccggaagcacaagaaguccuga

SEQ ID NO: 11843 - RNA, 3402 nt, Artificial Sequence
  derived and/or modified CDS sequence (opt1) from SEOV(HaixingRn40)__GU592924.1__GP
auguggagccuccucuuccuggccgcccuggugggccagggguucgcccucaagaacgucuucgacaugcgcauccagugcccccacagcgugaacuucggcgagaccagcguguccggguacaccgagcugccgccccugagccuccaggaggccgagcagcugguccccgaguccagcugcaacauggacaaccaccagucccugagcacgaucaacaagcucaccaaggugaucuggcggaagaaggccaaccaggaguccgccaaccagaacagcuucgagguggucgaguccgaggugagcuucaagggccugugcaugcugaagcaccgcaugguggaggaguccuaccggaaccgccggagcgucaucugcuacgaccucgccugcaacuccaccuucugcaagcccaccguguacaugaucgugccgauccacgcgugcaacaugaugaaguccugccugaucgggcugggccccuaccgcauccaggucguguacgagcggacguacugcaccaccggcauccucaccgaggggaagugcuucgugcccgacaaggccgucgugagcgcccugaagcgcggcauguacgccaucgcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccugcccggcgaggagaucgccaccuaccagaucuccggccagaucgaggccaagaucccccacacggucagcuccaagaaccucaagcugaccgccuucgcggggaucccgagcuacuccagcaccuccauccuggccgccagcgaggacggccgcuucaucuucucccccgggcuguuccccaaccugaaccagagcgugugcgacaacaacgcccugccccucaucuggcggggccugaucgaccugaccggguacuacgaggccgugcacccgugcaacgucuucugcgugcucuccggccccggcgcgagcugcgaggccuucuccgagggcgggaucuucaacaucacgagccccaugugccuggucuccaagcagaaccgcuuccgggccgccgagcagcagaucagcuucgugugccagcgcguggacauggacaucaucgucuacugcaacgggcagaagaagaccauccugacccggacccucgugaucggccagugcaucuacacgaucaccucccuguucagccugcuccccgggguggcccacagcaucgcgaucgagcugugcgucccgggcuuccacggcugggccaccgccgcccugcucaucaccuucugcuucgggugggugcugauccccgcgugcacgcuggccauccuccuggugcugaaguucuucgccaacauccuccacaccuccaaccaggagaaccgcuucaaggccauccugcggaagaucaaggaggaguucgagaagaccaagggcagcauggucugcgagaucugcaaguacgagugcgagacccugaaggagcucaaggcccacaaccuguccugcgugcagggggagugccccuacugcuucacgcacugcgagcccaccgagaccgcgauccaggcccacuacaaggugugccaggccacccaccgcuuccgggaggaccugaagaagacggucaccccgcagaacaucggccccgggugcuaccgcacccucaaccuguuccgguacaagagccgcugcuacauccugaccauguggacccugcuccugaucaucgaguccauccugugggccgccagcgcggccgagaucccccucgugccccuguggacggacaacgcccacggcgugggcuccgucccgaugcacaccgaccuggagcucgacuucagccugcccuccagcuccaaguacaccuacaagcgccaccugaccaaccccgugaacgaccagcagagcgugucccuccacaucgagaucgagagccaggggaucggcgccgacguccaccaccuggggcacugguacgacgcccggcugaaccucaagacguccuuccacugcuacggcgcgugcaccaaguaccaguacccguggcacaccgccaagugccacuucgagaaggacuacgaguacgagaacagcugggccugcaacccgcccgacugccccggcguggggaccggcugcacggccugcgggcuguaccuggaccagcucaagcccgugggcaccgcguucaagaucaucuccguccgcuacagccggaaggugugcgugcaguucggggaggaguaccugugcaagaccaucgacaugaacgacugcuucgucacccgccacgccaagaucugcaucaucggcacggugagcaaguucucccagggcgacacccuccucuuccuggggcccauggagggcgggggcaucaucuucaagcacuggugcaccagcacgugccacuucggggaccccggcgacgugaugggccccaaggacaagccguucaucugccccgaguuccccgggcaguuccggaagaagugcaacuucgccaccacccccgucugcgaguacgacggcaacaucaucuccggguacaagaaggugcuggccaccaucgacagcuuccaguccuucaacaccagcaacauccacuucacggacgagcgcaucgaguggcgggacccggacggcaugcuccgcgaccacaucaacaucgugaucuccaaggacaucgacuucgagaaccuggggcagaaccccugcaaggucggccugcaggccgcgaacaucgagggcgccugggggagcggcgugggguucacccugaccugccaggugucccugaccgagugccccacguuccugaccagcaucaaggccugcgacauggccaucugcuacggcgccgaguccgucacccucagccgggggcagaacaccgugaagaucacgggcaagggcgggcacuccggcagcuccuucaagugcugccacgggaaggagugcagcuccaccggccugcaggcgagcgcgccccaccuggacaaggugaacggcaucuccgaccucgagaacgagaaggucuacgacgacggggccccggagugcggcgugaccugcugguucaagaaguccggggagugggugaugggcaucaucaacgggaacugggucgugcugaucgugcugugcguccuccugcuguucagccucauccugcugagcauccucugccccgugcgcaagcacaagaaguccuga

SEQ ID NO: 11844 - RNA, 3402 nt, Artificial Sequence
  derived and/or modified CDS sequence (opt1) from SEOV(HBQ17)__KM233655.1__GP
auguggagccuccucuucguggccgcccugaucggccagggguucgcgcuggagaacgccuucgacaugcgcauccggugcccccacuccguccacuucggcgagaccagcguguccggguacaccgagcucccgccccugagccugcaggaggccgagcagcucgugcccgaguccagcugcaacauggacaaccaccagucccugagcacgaucaacaagcugaccaaggucaucuggcgcaagaaggccaaccaggaguccgccaaccagaacagcuucgaggugguggaguccgcgcucaagaucaagggccugugcaugcugaagcaccggauggucgaggagagcuaccgcaaccggcgcuccgugaucugcuacgaccucgccugcaacagcaccuucugcaagcccaccguguacaugaucgucccgauccacgccugcaacaugaugaaguccugccugaucgggcugggccccuaccggauccaggugguguacgagcgcacguacugcaccaccggcauccucaccgaggggaagugcuucguccccgacaaggccguggugagcgcgcugaagcggggcauguacgccaucgccuccaucgagacgaucugcuucuucauccaccagaaggggaacaccuacaagaucgucaccgccaucaccagcgccaugggcuccaagugcaacaacacggacaccaaggugcagggguacuacaucugcaucaucggcggcaacagcgcgcccguguacgccccggccggggaggacuuccgcgccauggaggucuucagcggcaucaucaccagcccccacggggaggaccacgaccugcccggcgaggagaucgccaccuaccagaucuccggccagaucgaggcgaagaucccccacacgguguccagcaagaaccucaagcugaccgccuucgccgggaucccguccuacagcuccaccagcauccuggccgccuccgaggacggccgguucaucuucagccccgggcuguuccccaaccugaaccaguccgugugcgacaacaacgcgcugccccucaucuggcgcggccugaucgaccugaccggguacuacgaggccguccacccgugcaacguguucugcgugcucagcggccccggcgccuccugcgaggccuucagcgagggcgggaucuucaacaucacgucccccaugugccuggucagcaagcagaaccgguuccgcgccgcggagcagcagaucuccuucgugugccagcgggucgacauggacaucaucguguacugcaacgggcagaagaagaccauccugaccaagacccucgugaucggccagugcaucuacacgaucaccagccuguucucccugcuccccggggucgcccacagcaucgccaucgagcugugcgugccgggcuuccacggcugggccaccgcggcccugcucaucaccuucugcuucgggugggugcugauccccgccugcacgcuggccauccuccugguccugaaguucuucgccaacauccuccacaccagcaaccaggagaaccgcuucaaggcgauccugcggaagaucaaggaggaguucgagaagaccaagggcuccauggugugcgagaucugcaaguacgagugcgagacccugaaggagcucaaggcccacaaccugagcugcgugcagggggagugccccuacugcuucacgcacugcgagcccaccgagaccgccauccaggcccacuacaaggucugccaggccacccaccgcuuccgggaggaccugaagaagacggugaccccgcagaacaucggccccgggugcuaccgcacccucaaccuguuccgguacaagucccgcugcuacauccugaccauguggacccugcuccugaucaucgagagcauccugugggcggccuccgccgccgagaucccccucgugccccuguggacggacaacgcccacggcgucggcagcgugccgaugcacaccgaccuggagcucgacuucucccugcccagcuccagcaaguacaccuacaagcgccaccugaccaaccccgugaacgaccagcaguccgucagccuccacaucgagaucgagucccaggggaucggcgcggacgugcaccaccuggggcacugguacgacgcccggcugaaccucaagacgagcuuccacugcuacggcgccugcaccaaguaccaguacccguggcacaccgccaagugccacuucgagaaggacuacgaguacgagaacuccugggcgugcaacccgcccgacugccccggcguggggaccggcugcacggccugcgggcuguaccuggaccagcucaagcccgucggcaccgccuucaagaucaucagcgugcgcuacucccggaaggugugcguccaguucggggaggaguaccugugcaagaccaucgacaugaacgacugcuucgugacccgccacgccaagaucugcaucaucggcacggugagcaaguucagccagggcgacacccuccucuuccuggggcccauggagggcgggggcaucaucuucaagcacuggugcaccuccacgugccacuucggggaccccggcgacgucaugggccccaaggacaagccguucaucugccccgaguuccccgggcaguuccggaagaagugcaacuucgccaccacccccgugugcgaguacgacggcaacaucaucagcggguacaagaaggugcuggcgaccaucgacuccuuccagagcuucaacaccuccaacauccacuucacggacgagcgcaucgaguggcgggacccggacggcaugcuccgcgaccacaucaacaucgucaucagcaaggacaucgacuucgagaaccuggccgagaaccccugcaagguggggcugcaggccgccaacaucgagggcgccuggggcuccggggugggcuucacccugaccugccaggucagccugaccgagugccccacguuccugaccuccaucaaggcgugcgacauggccaucugcuacggggccgagagcgugacccucucccggggccagaacaccgugaagaucacggggaagggcggccacagcggguccagcuucaagugcugccacggcaaggagugcuccagcaccgggcugcaggccuccgcgccccaccuggacaaggucaacggcaucagcgagcucgagaacgagaagguguacgacgacggcgccccggagugcggggugaccugcugguucaagaaguccggcgagugggucauggggaucaucaacggcaacuggguggugcugaucguccugugcgugcuccugcuguucagccucauccugcugagcauccucugccccgugcgcaagcacaagaaguccuga

SEQ ID NO: 11845 - RNA, 3402 nt, Artificial Sequence
  derived and/or modified CDS sequence (opt1) from SEOV(HBQ20)__KM233656.1__GP
auguggagccuccucuuccuggccgcccuggugggccagggguucgcccucaagaacgucuucgacaugcgcauccagugcccccacagcgugaacuucggcgagaccagcguguccggguacaccgagcugccgccccugagccuccaggaggccgagcagcugguccccgaguccagcugcaacauggacaaccaccagucccugagcacgaucaacaagcucaccaaggugaucuggcggaagaaggccaaccaggaguccgccaaccagaacagcuucgagguggucgaguccgaggugagcuucaagggccugugcaugcugaagcaccgcaugguggaggaguccuaccggaaccgccggagcgucaucugcuacgaccucgccugcaacuccaccuucugcaagcccaccguguacaugaucgugccgauccacgcgugcaacaugaugaaguccugccugaucgggcugggccccuaccgcauccaggucguguacgagcggacguacugcaccaccggcauccucaccgaggggaagugcuucgugcccgacaaggccgucgugagcgcccugaagcgcggcauguacgccaucgcgagcaucgagacgaucugcuucuucauccaccagaaggggaacaccuacaagaucgugaccgucaucaccuccgccaugggcagcaagugcaacaacacggacaccaaggugcagggguacuacaucugcaucaucggcggcaacagcgcccccguguacgccccggccggggaggacuuccgggcgauggaggucuucuccggcaucaucaccagcccccacggggaggaccacgaccugcccggcgaggagaucgccaccuaccagaucuccggccagaucgaggccaagaucccccacacggugagcuccaagaaccucaagcugaccgccuucgccgggaucccgagcuacuccagcaccuccauccuggcggccagcgaggacggccgcuucaucuucucccccgggcuguuccccaaccugaaccagagcgugugcgacaacaacgcccugccccucaucuggcggggccugaucgaccugaccggguacuacgaggccguccacccgugcaacguguucugcguccucuccggccccggcgccagcugcgaggcguucuccgagggcgggaucuucaacaucacgagccccaugugccugguguccaagcagaaccgcuuccgggccgccgagcagcagaucagcuucgugugccagcgcgucgacauggacaucaucguguacugcaacgggcagaagaagaccauccugaccaagacccucgugaucggccagugcaucuacacgaucaccucccuguucagccugcuccccggggucgcccacagcaucgccaucgagcugugcgugccgggcuuccacggcugggcgaccgccgcccugcucaucaccuucugcuucgggugggugcugauccccgccugcacgcuggcgauccuccugguccugaaguucuucgccaacauccuccacaccuccaaccaggagaaccgguucaaggccauccugcgcaagaucaaggaggaguucgagaagaccaagggcagcauggugugcgagaucugcaaguacgagugcgagacccugaaggagcucaaggcccacaaccuguccugcgugcagggggagugccccuacugcuucacgcacugcgagcccaccgagaccgccauccaggcgcacuacaaggucugccaggccacccaccgguuccgcgaggaccugaagaagacggugaccccgcagaacaucggccccgggugcuaccggacccucaaccuguuccgcuacaagagccggugcuacauccugaccauguggacccugcuccugaucaucgaguccauccugugggccgccagcgccgcggagaucccccucgugccccuguggacggacaacgcccacggcgucggcuccgugccgaugcacaccgaccuggagcucgacuucagccugcccuccagcuccaaguacaccuacaagcgccaccugaccaaccccgugaacgaccagcagagcgucucccuccacaucgagaucgagagccaggggaucggcgccgacgugcaccaccuggggcacugguacgacgcccgccugaaccucaagacguccuuccacugcuacggcgccugcaccaaguaccaguacccguggcacaccgcgaagugccacuucgagaaggacuacgaguacgagaacagcugggccugcaacccgcccgacugccccggcguggggaccggcugcacggccugcgggcuguaccuggaccagcucaagcccgucggcaccgccuucaagaucaucuccgugcgguacagccgcaaggugugcguccaguucggggaggaguaccugugcaagaccaucgacaugaacgacugcuucgugacccggcacgcgaagaucugcaucaucggcacggugagcaaguucucccagggcgacacccuccucuuccuggggcccauggagggcgggggcaucaucuucaagcacuggugcaccagcacgugccacuucggggaccccggcgacgucaugggccccaaggacaagccguucaucugccccgaguuccccgggcaguuccgcaagaagugcaacuucgccaccacccccgugugcgaguacgacggcaacaucaucuccggguacaagaaggugcuggccaccaucgacagcuuccaguccuucaacaccagcaacauccacuucacggacgagcggaucgaguggcgcgacccggacggcaugcuccgggaccacaucaacaucgucaucuccaaggacaccgacuucgagaaccuggccgagaaccccugcaagguggggcugcaggccgcgaacaucgagggcgccuggggcagcggggugggcuucacccugaccugccaggucucccugacggagugccccaccuuccugaccagcaucaaggccugcgacauggccaucugcuacggggccgaguccgugacccucagccgcggccagaacacggugaagaucaccgggaagggcggccacuccgggagcuccuucaagugcugccacggcaaggagugcagcuccaccgggcugcaggcgagcgcgccccaccuggacaaggucaacggcaucuccgagcucgagaacgagaagguguacgacgacggcgccccggagugcggggugaccugcugguucaagaaguccggcgagugggucauggggaucaucaacggcaacuggguggugcugaucguccugugcgugcuccugcuguucagccucauccugcugagcauccucugccccgugcggaagcacaagaaguccuga

SEQ ID NO: 11846 - RNA, 3402 nt, Artificial Sequence
  derived and/or modified CDS sequence (opt1) from SEOV(HBQ43)__KM233657.1__GP
auguggagccuccucuuccuggccgcccuggugggccagggggucgcccucaagaacguguucgacaugcgcauccagugcccccacagcgugaacuucggcgagaccagcgucuccggguacaccgagcugccgccccugagccuccaggaggccgagcagcuggugcccgaguccagcugcaacauggacaaccaccagucccugagcacgaucaacaagcucaccaaggugaucuggcggaagaaggccaaccaggaguccgccaaccagaacagcuucgaggucguggaguccgaggugagcuucaagggccugugcaugcugaagcaccgcauggucgaggaguccuaccggaaccgccggagcgugaucugcuacgaccucgccugcaacuccaccuucugcaagcccaccguguacaugaucgucccgauccacgcgugcaacaugaugaaguccugccugaucgggcugggccccuaccgcauccaggugguguacgagcggacguacugcaccaccggcauccucaccgaggggaagugcuucguccccgacaaggccguggugagcgcccugaagcgcggcauguacgccaucgcgagcaucgagacgaucugcuucuucauccaccagaaggggaacaccuacaagaucgucaccgccaucaccuccgccaugggcagcaagugcaacaacacggacaccaaggugcagggguacuacaucugcaucaucggcggcaacagcgcccccguguacgccccggcgggggaggacuuccgggccauggaggucuucuccggcaucaucaccagcccccacggggaggaccacgaccugcccggcgaggagaucgccaccuaccagaucuccggccagaucgaggccaagaucccccacacggugagcuccaagaaccucaagcugaccgccuucgcggggaucccgagcuacuccagcaccuccauccuggccgccagcgaggacggccgcuucaucuucucccccgggcuguuccccaaccugaaccagagcgugugcgacaacaacgcccugccccucaucuggcggggccugaucgaccugaccggguacuacgaggccguccacccgugcaacguguucugcguccucuccggccccggcgcgagcugcgaggccuucuccgagggcgggaucuucaacaucacgagccccaugugccugguguccaagcagaaccgcuuccgggccgccgagcagcagaucagcuucgugugccagcgcgucgacauggacaucaucguguacugcaacgggcagaagaagaccauccugaccaagacccucgugaucggccagugcaucuacacgaucaccucccuguucagccugcuccccggggucgcccacagcaucgcgaucgagcugugcgugccgggcuuccacggcugggccaccgccgcccugcucaucaccuucugcuucgggugggugcugauccccgcgugcacgcuggccauccuccugguccugaaguucuucgccaacauccuccacaccuccaaccaggagaaccgguucaaggccauccugcgcaagaucaaggaggaguucgagaagaccaagggcagcauggugugcgagaucugcaaguacgagugcgagacccugaaggagcucaaggcccacaaccuguccugcgugcagggggagugccccuacugcuucacgcacugcgagcccaccgagaccgcgauccaggcccacuacaaggucugccaggccacccaccgguuccgcgaggaccugaagaagacggugaccccgcagaacaucggccccgggugcuaccggacccucaaccuguuccgcuacaagagccggugcuacauccugaccauguggacccugcuccugaucaucgaguccauccugugggccgccagcgcggccgagaucccccucgugccccuguggacggacaacgcccacggcgucggcuccgugccgaugcacaccgaccuggagcucgacuucagccugcccuccagcuccaaguacaccuacaagcgccaccugaccaaccccgugaacgaccagcagagcgucucccuccacaucgagaucgagagccaggggaucggcgccgacgugcaccaccuggggcacugguacgacgcccgccugaaccucaagacguccuuccacugcuacggcgcgugcaccaaguaccaguacccguggcacaccgccaagugccacuucgagaaggacuacgaguacgagaacagcugggccugcaacccgcccgacugccccggcguggggaccggcugcacggccugcgggcuguaccuggaccagcucaagcccgucggcaccgcguucaagaucaucuccgugcgguacagccgcaaggugugcguccaguucggggaggaguaccugugcaagaccaucgacaugaacgacugcuucgugacccggcacgccaagaucugcaucaucggcacggugagcaaguucucccagggcgacacccuccucuuccuggggcccauggagggcgggggcaucaucuucaagcacuggugcaccagcacgugccacuucggggaccccggcgacgucaugggccccaaggacaagccguucaucugccccgaguuccccgggcaguuccgcaagaagugcaacuucgccaccacccccgugugcgaguacgacggcaacaucaucuccggguacaagaaggugcuggccaccaucgacagcuuccaguccuucaacaccagcaacauccacuucacggacgagcggaucgaguggcgcgacccggacggcaugcuccgggaccacaucaacaucgucaucuccaaggacaucgacuucgagaaccuggccgagaaccccugcaagguggggcugcaggcggccaacaucgagggcgccuggggcagcggggugggcuucacccugaccugccaggucucccugaccgagugccccacguuccugaccagcaucaaggccugcgacauggccaucugcuacggggcggaguccgugacccucagccgcggccagaacaccgugaagaucacggggaagggcggccacuccgggagcuccuucaagugcugccacggcaaggagugcagcuccaccgggcugcaggccagcgcgccccaccuggacaaggucaacggcuucuccgagcucgagaacgagaagguguacgacgacggcgccccggagugcggggugaccugcugguucaagaaguccggcgagugggucauggggaucaucaacggcaacuggguggugcugaucguccugugcauccuccugcuguucagccucauccugcugagcauccucugccccgugcggaagcacaagaaguccuga

SEQ ID NO: 11847 - RNA, 3402 nt, Artificial Sequence
  derived and/or modified CDS sequence (opt1) from SEOV(HBQ5)__KM233653.1__GP
auguggagccuccucuuccuggccgcccuggugggccagggguucgcccucaagaacgucuucgacaugcgcauccagugcccccacagcgugaacuucggcgagaccagcguguccggguacaccgagcugccgccccugagccuccaggaggccgagcagcugguccccgaguccagcugcaacauggacaaccaccagucccugagcacgaucaacaagcucaccaaggugaucuggcggaagaaggccaaccaggaguccgccaaccagaacagcuucgagguggucgaguccgaggugagcuucaagggccugugcaugcugaagcaccgcaugguggaggaguccuaccggaaccgccggagcgucaucugcuacgaccucgccugcaacuccaccuucugcaagcccaccguguacaugaucgugccgauccacgcgugcaacaugaugaaguccugccugaucgggcugggccccuaccgcauccaggucguguacgagcggacguacugcaccaccggcauccucaccgaggggaagugcuucgugcccgacaaggccgucgugagcgcccugaagcgcggcauguacgccaucgcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccugcccggcgaggagaucgccaccuaccagaucuccggccagaucgaggccaagaucccccacacggucagcuccaagaaccucaagcugaccgccuucgcggggaucccgagcuacuccagcaccuccauccuggccgccagcgaggacggccgcuucaucuucucccccgggcuguuccccaaccugaaccagagcgugugcgacaacaacgcccugccccucaucuggcggggccugaucgaccugaccggguacuacgaggccgugcacccgugcaacgucuucugcgugcucuccggccccggcgcgagcugcgaggccuucuccgagggcgggaucuucaacaucacgagccccaugugccuggucuccaagcagaaccgcuuccgggccgccgagcagcagaucagcuucgugugccagcgcguggacauggacaucaucgucuacugcaacgggcagaagaagaccauccugaccaagacccucgugaucggccagugcaucuacacgaucaccucccuguucagccugcuccccgggguggcccacagcaucgcgaucgagcugugcgucccgggcuuccacggcugggccaccgccgcccugcucaucaccuucugcuucgggugggugcugauccccgcgugcacgcuggccauccuccuggugcugaaguucuucgccaacauccuccacaccuccaaccaggagaaccgguucaaggccauccugcgcaagaucaaggaggaguucgagaagaccaagggcagcauggucugcgagaucugcaaguacgagugcgagacccugaaggagcucaaggcccacaaccuguccugcgugcagggggagugccccuacugcuucacgcacugcgagcccaccgagaccgcgauccaggcccacuacaaggugugccaggccacccaccgguuccgcgaggaccugaagaagacggucaccccgcagaacaucggccccgggugcuaccggacccucaaccuguuccgcuacaagagccggugcuacauccugaccauguggacccugcuccugaucaucgaguccauccugugggccgccagcgcggccgagaucccccucgugccccuguggacggacaacgcccacggcgugggcuccgucccgaugcacaccgaccuggagcucgacuucagccugcccuccagcuccaaguacaccuacaagcgccaccugaccaaccccgugaacgaccagcagagcgugucccuccacaucgagaucgagagccaggggaucggcgccgacguccaccaccuggggcacugguacgacgcccgccugaaccucaagacguccuuccacugcuacggcgcgugcaccaaguaccaguacccguggcacaccgccaagugccacuucgagaaggacuacgaguacgagaacagcugggccugcaacccgcccgacugccccggcguggggaccggcugcacggccugcgggcuguaccuggaccagcucaagcccgugggcaccgcguucaagaucaucuccguccgguacagccgcaaggugugcgugcaguucggggaggaguaccugugcaagaccaucgacaugaacgacugcuucgucacccggcacgccaagaucugcaucaucggcacggugagcaaguucucccagggcgacacccuccucuuccuggggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgucugcgaguacgacggcaacaucaucuccggguacaagaaggugcuggccaccaucgacagcuuccaguccuucaacaccagcaacauccacuucacggacgagcggaucgaguggcgcgacccggacggcaugcuccgggaccacaucaacaucgugaucuccaaggacaucgacuucgagaaccuggccgagaaccccugcaaggucgggcugcaggcggccaacaucgagggcgccuggggcagcggggugggcuucacccugaccugccaggugucccugaccgagugccccacguuccugaccagcaucaaggccugcgacauggccaucugcuacggggcggaguccgucacccucagccgcggccagaacaccgugaagaucacggggaagggcggccacuccgggagcuccuucaagugcugccacggcaaggagugcagcuccaccgggcugcaggccagcgcgccccaccuggacaaggugaacggcaucuccgagcucgagaacgagaaggucuacgacgacggcgccccggagugcggggugaccugcugguucaagaaguccggcgagugggugauggggaucaucaacggcaacugggucgugcugaucgugcugugcguccuccugcuguucagccucauccugcugagcauccucugccccgugcggaagcacaagaaguccuga

SEQ ID NO: 11848 - RNA, 3402 nt, Artificial Sequence
  derived and/or modified CDS sequence (opt1) from SEOV(HBT14)__KM233658.1__GP
auguggagccuccucuuccuggccgcccuggugggccagggguucgcccucaagaacgucuucgacaugcgcauccagugcccccacagcgugaacuucggcgagaccagcguguccggguacaccggccugccgccccugagccuccaggaggccgagcagcugguccccgaguccagcugcaacauggacaaccaccagucccugagcaucaucaacaagcucacgaaggugaucuggcggaagaaggccaaccaggaguccgccaaccagaacagcuucgagguggucgaguccgaggugagcuucaaggggcugugcaugcugaagcaccgcaugguggaggaguccuaccggaaccgccggagcgucaucugcuacgaccucgccugcaacuccaccuucugcaagcccaccguguacaugaucgugccgauccacgcgugcaacaugaugaaguccugccugaucggccugggccccuaccgcauccaggucguguacgagcggaccuacugcacgaccgggauccucaccgagggcaagugcuucgugcccgacaaggccgucgugagcgcccugaagcgcgggauguacgccaucgcgagcaucgagaccaucugcuucuucauccaccagaagggcaacacguacaagaucgugaccgccaucaccuccgccauggggagcaagugcaacaacaccgacacgaagguccagggcuacuacaucugcaucaucggcgggaacagcgcccccguguacgccccggcgggcgaggacuuccgggccauggagguguucuccgggaucaucaccagcccccacggcgaggaccacgaccugcccggcgaggagaucgccaccuaccagaucuccgggcagaucgaggccaagaucccccacaccgucagcuccaagaaccucaagcugacggccuucgcgggcaucccgagcuacuccagcaccuccauccuggccgccagcgaggacgggcgcuucaucuucucccccggccucuuccccaaccugaaccagagcgugugcgacaacaacgcccugccccucaucuggcgggggcugaucgaccugaccggcuacuacgaggccgugcacccgugcaacgucuucugcgugcucuccggccccggggcgagcugcgaggccuucuccgagggcgggaucuucaacaucaccagccccaugugccuggucuccaagcagaaccgcuuccgggccgccgagcagcagaucagcuucgugugccagcgcguggacauggacaucaucgucuacugcaacggccagaagaagacgauccugaccaagacccucgugaucgggcagugcaucuacaccaucacgucccuguucagccugcuccccggcguggcccacagcaucgcgaucgagcugugcgucccgggcuuccacgggugggccaccgccgcccugcucaucaccuucugcuucggcugggugcugauccccgcgugcacccuggccauccuccuggugcugaaguucuucgccaacauccuccacacguccaaccaggagaaccgguucaaggccauccugcgcaagaucaaggaggaguucgagaagaccaaggggagcauggucugcgagaucugcaaguacgagugcgagacccugaaggagcucaaggcccacaaccuguccugcgugcagggcgagugccccuacugcuucacccacugcgagcccacggagaccgcgauccaggcccacuacaaggugugccaggccacccaccgguuccgcgaggaccugaagaagaccgucacgccgcagaacaucgggcccggcugcuaccggacccucaaccuguuccgcuacaagagccggugcuacauccugaccauguggacccugcuccugaucaucgaguccauccugugggccgccagcgcggccgagaucccccucgugccccuguggaccgacaacgcccacggcgugggguccgucccgaugcacacggaccuggagcucgacuucagccugcccuccagcuccaaguacaccuacaagcgccaccugaccaaccccgugaacgaccagcagagcgugucccuccacaucgagaucgagagccagggcaucggggccgacguccaccaccugggccacugguacgacgcccgccugaaccucaagaccuccuuccacugcuacggcgcgugcacgaaguaccaguacccguggcacaccgccaagugccacuucgagaaggacuacgaguacgagaacagcugggccugcaacccgcccgacugccccggggugggcaccgggugcaccgccugcggccuguaccuggaccagcucaagcccguggggacggcguucaagaucaucuccguccgguacagccgcaaggugugcgugcaguucggcgaggaguaccugugcaagaccaucgacaugaacgacugcuucgucacccggcacgccaagaucugcaucaucggcaccgugagcaaguucucccagggggacacgcuccuguuccugggccccauggagggcggcgggaucaucuucaagcacuggugcaccagcacgugccacuucggggaccccggcgacgugauggggcccaaggacaagccguucaucugccccgaguuccccggccaguuccgcaagaagugcaacuucgccaccacccccgucugcgaguacgacgggaacaucaucuccggcuacaagaaggugcuggccaccaucgacagcuuccaguccuucaacaccagcaacauccacuucaccgacgagcggaucgaguggcgcgacccggacgggaugcuccgggaccacaucaacaucgugaucuccaaggacaucgacuucgagaaccuggccgagaaccccugcaaggucggccugcaggcggccaacaucgagggcgccugggggagcggcgugggguucacgcugaccugccaggugucccugaccgagugccccaccuuccugacgagcaucaaggccugcgacauggccaucugcuacggcgcggaguccgucacccucagccgcgggcagaacaccgugaagaucaccggcaagggcgggcacuccggcagcuccuucaagugcugccacgggaaggagugcagcuccacgggccugcaggccagcgcgccccaccuggacaaggugaacggcaucuccgagcucgagaacgagaaggucuacgacgacggggccccggagugcggcgugaccugcugguucaagaaguccggggagugggugaugggcaucaucaacgggaacugggucgugcugaucgugcugugcguccuccugcuguucagccucauccugcugagcauccucugccccgugcggaagcacaagaaguccuga

SEQ ID NO: 11849 - RNA, 3402 nt, Artificial Sequence
  derived and/or modified CDS sequence (opt1) from SEOV(HBT-3)__KM233661.1__GP
auguggagccuccucuuccuggccgcccuggugggccagggguucgcgcucaagaacgucuucgacaugcgcauccagugcccccacagcgugaacuucggcgagaccagcguguccggguacaccgagcugccgccccugagccuccaggaggccgagcagcugguccccgaguccagcugcaacauggacaaccaccagucccugagcacgaucaacaagcucaccaaggugaucuggcggaagaaggccaaccaggaguccgccaaccagaacagcuucgagguggucgaguccgaggugagcuucaagggccugugcaugcugaagcaccgcaugguggaggaguccuaccggaaccgccggagcgucaucugcuacgaccuccccugcaacuccaccuucugcaagccgaccguguacaugaucgugcccauccacgccugcaacaugaugaaguccugccugaucgggcugggccccuaccgcauccaggucguguacgagcggacguacugcaccaccggcauccucaccgaggggaagugcuucgugcccgacaaggcggucgugagcgcccugaagcgcggcauguacgccaucgccagcaucgagacgaucugcuucuucauccaccagaaggggaacaccuacaagaucgugaccgcgaucaccuccgccaugggcagcaagugcaacaacacggacaccaagguccagggguacuacaucugcaucaucggcggcaacagcgccccgguguacgcccccgccggggaggacuuccgggcgauggagguguucuccggcaucaucaccagcccccacggggaggaccacgaccugcccggcgaggagaucgccaccuaccagaucuccggccagaucgaggccaagaucccgcacacggucagcuccaagaaccucaagcugaccgccuucgccgggauccccagcuacuccagcaccuccauccuggcggccagcgaggacggccgcuucaucuucucccccgggcuguuccccaaccugaaccagagcgugugcgacaacaacgcccugccgcucaucuggcggggccugaucgaccugaccggguacuacgaggccgugcaccccugcaacgucuucugcgugcucuccggccccggcgccagcugcgaggcguucuccgagggcgggaucuucaacaucacgagccccaugugccuggucuccaagcagaaccgcuuccgggccgccgagcagcagaucagcuucgugugccagcgcguggacauggacaucaucgucuacugcaacgggcagaagaagaccauccugaccaagacccucgugaucggccagugcaucuacacgaucaccucccuguucagccugcucccggggguggcccacagcaucgccaucgagcugugcguccccggcuuccacggcugggcgaccgccgcccugcucaucaccuucugcuucgggugggugcugauccccgccugcacgcuggcgauccuccuggugcugaaguucuucgccaacauccuccacaccuccaaccaggagaaccgguucaaggccauccugcgcaagaucaaggaggaguucgagaagaccaagggcagcauggucugcgagaucugcaaguacgagugcgagaccuucaaggagcugaaggcccacaaccucuccugcgugcagggggagugccccuacugcuucacgcacugcgagccgaccgagaccgccauccaggcgcacuacaaggugugccaggccacccaccgguuccgcgaggaccugaagaagacggucacgccccagaacaucggccccgggugcuaccggacccugaaccucuuccgcuacaagagccggugcuacauccugaccauguggacccugcugcucaucaucgaguccauccugugggccgccagcgccgcggagaucccccuggugccgcucuggaccgacaacgcccacggcgugggcuccguccccaugcacaccgaccuggagcuggacuucagccuccccuccagcuccaaguacaccuacaagcgccaccugaccaacccggugaacgaccagcagagcgugucccugcacaucgagaucgagagccaggggaucggcgccgacguccaccaccucgggcacugguacgacgcccgccugaaccugaagacguccuuccacugcuacggcgccugcaccaaguaccaguaccccuggcacaccgcgaagugccacuucgagaaggacuacgaguacgagaacagcugggccugcaacccgcccgacugccccggcguggggaccggcugcacggccugcgggcucuaccuggaccagcugaagcccgugggcaccgccuucaagaucaucuccguccgguacagccgcaaggugugcgugcaguucggggaggaguaccucugcaagaccaucgacaugaacgacugcuucgucacccggcacgcgaagaucugcaucaucggcacggugagcaaguucucccagggcgacacccugcuguuccucgggcccauggagggcgggggcaucaucuucaagcacuggugcaccagcacgugccacuucggggaccccggcgacgugaugggcccgaaggacaagcccuucaucugccccgaguuccccgggcaguuccgcaagaagugcaacuucgccaccaccccggucugcgaguacgacggcaacaucaucuccggguacaagaaggugcuggccaccaucgacagcuuccaguccuucaacaccagcaacauccacuucacggacgagcggaucgaguggcgcgaccccgacggcaugcugcgggaccacaucaacaucgugaucuccaaggacaucgacuucgagaaccucgccgagaaccccugcaaggucgggcugcaggccgcgaacaucgagggcgccuggggcagcggggugggcuucacccugaccugccaggugucccucaccgagugccccacguuccugaccagcaucaaggccugcgacauggccaucugcuacggggccgaguccgucacccugagccgcggccagaacaccgugaagaucacggggaagggcggccacuccgggagcuccuucaagugcugccacggcaaggagugcagcuccaccgggcuccaggcgagcgccccgcaccuggacaaggugaacggcaucuccgagcuggagaacgagaaggucuacgacgacggcgcccccgagugcggggugaccugcugguucaagaaguccggcgagugggugauggggaucaucaacggcaacugggucgugcucaucgugcugugcguccugcuccuguucagccugauccuccugagcauccugugccccgugcggaagcacaagaaguccuga

SEQ ID NO: 11850 - RNA, 3402 nt, Artificial Sequence
  derived and/or modified CDS sequence (opt1) from SEOV(HBT49)__KM233659.1__GP
auguggagccuccucuuccuggccgcccuggugggccagggguucgcccucaagaacgucuucgacaugcgcauccagugcccccacagcgugaacuucggcgagaccagcguguccggguacaccgagcugccgccccugagccuccaggaggccgagcagcugguccccgaguccagcugcaacauggacaaccaccagucccugagcacgaucaacaagcucaccaaggugaucuggcggaagaaggccaaccaggaguccgccaaccagaacagcuucgagguggucgaguccgaggugagcuucaagggccugugcaugcugaagcaccgcaugguggaggaguccuaccggaaccgccggagcgucaucugcuacgaccucgccugcaacuccaccuucugcaagcccaccguguacaugaucgugccgauccacgcgugcaacaugaugaaguccugccugaucgggcugggccccuaccgcauccaggucguguacgagcggacguacugcaccaccggcauccucaccgaggggaagugcuucgugcccgacaaggccgucgugagcgcccugaagcgcggcauguacgccaucgcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccugcccggcgaggagaucgccaccuaccagaucuccggccagaucgaggccaagaucccccacacggucagcuccaagaaccucaagcugaccgccuucgcggggaucccgagcuacuccagcaccuccauccuggccgccagcgaggacggccgcuucaucuucucccccgggcuguuccccaaccugaaccagagcgugugcgacaacaacgcccugccccucaucuggcggggccugaucgaccugaccggguacuacgaggccgugcacccgugcaacgucuucugcgugcucuccggccccggcgcgagcugcgaggccuucuccgagggcgggaucuucaacaucacgagccccaugugccuggucuccaagcagaaccgcuuccgggccgccgagcagcagaucagcuucgugugccagcgcguggacauggacaucaucgucuacugcaacgggcagaagaagaccauccugaccaagacccucgugaucggccagugcaucuacacgaucaccucccuguucagccugcuccccgggguggcccacagcaucgcgaucgagcugugcgucccgggcuuccacggcugggccaccgccgcccugcucaucaccuucugcuucgggugggugcugauccccgcgugcacgcuggccauccuccuggugcugaaguucuucgccaacauccuccacaccuccaaccaggagaaccgguucaaggccauccugcgcaagaucaaggaggaguucgagaagaccaagggcagcauggucugcgagaucugcaaguacgagugcgagacccugaaggagcucaaggcccacaaccuguccugcgugcagggggagugccccuacugcuucacgcacugcgagcccaccgagaccgcgauccaggcccacuacaaggugugccaggccacccaccgguuccgcgaggaccugaagaagacggucaccccgcagaacaucggccccgggugcuaccggacccucaaccuguuccgcuacaagagccggugcuacauccugaccauguggacccugcuccugaucaucgaguccauccugugggccgccagcgcggccgagaucccccucgugccccuguggacggacaacgcccacggcgugggcuccgucccgaugcacaccgaccuggagcucgacuucagccugcccuccagcuccaaguacaccuacaagcgccaccugaccaaccccgugaacgaccagcagagcgugucccuccacaucgagaucgagagccaggggaucggcgccgacgucuaccaccuggggcacugguacgacgcccgccugaaccucaagacguccuuccacugcuacggcgcgugcaccaaguaccaguacccguggcacaccgccaagugccacuucgagaaggacuacgaguacgagaacagcugggccugcaacccgcccgacugccccggcguggggaccggcugcacggccugcgggcuguaccuggaccagcucaagcccgugggcaccgcguucaagaucaucuccguccgguacagccgcaaggugugcgugcaguucggggaggaguaccugugcaagaccaucgacaugaacgacugcuucgucacccggcacgccaagaucugcaucaucggcacggugagcaaguucucccagggcgacacccuccucuuccuggggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgucugcgaguacgacggcaacaucaucuccggguacaagaaggugcuggccaccaucgacagcuuccaguccuucaacaccagcaacauccacuucacggacgagcggaucgaguggcgcgacccggacggcaugcuccgggaccacaucaacaucgugaucuccaaggacaucgacuucgagaaccuggccgagaaccccugcaaggucgggcugcaggcggccaacaucgagggcgccuggggcagcggggugggcuucacccugaccugccaggugucccugaccgagugccccacguuccugaccagcaucaaggccugcgacauggccaucugcuacggggcggaguccgucacccucagccgcggccagaacaccgugaagaucacggggaagggcggccacuccgggagcuccuucaagugcugccacggcaaggagugcagcuccaccgggcugcaggccagcgcgccccaccuggacaaggugaacggcaucuccgagcucgagaacgagaaggucuacgacgacggcgccccggagugcggggugaccugcugguucaagaaguccggcgagugggugauggggaucaucaacggcaacugggucgugcugaucgugcugugcguccuccugcuguucagccucauccugcugagcauccucugccccgugcggaagcacaagaaguccuga

SEQ ID NO: 11851 - RNA, 3402 nt, Artificial Sequence
  derived and/or modified CDS sequence (opt1) from SEOV(HBT50)__KM233660.1__GP
auguggagccuccucuuccuggccgcccuggugggccagggguucgcccucaagaacgucuucgacaugcgcauccagugcccccacagcgugaacuucggcgagaccagcguguccggguacaccgagcugccgccccugagccuccaggaggccgagcagcugguccccgaguccagcugcaacauggacaaccaccagucccugagcacgaucaacaagcucaccaaggugaucuggcggaagaaggccaaccaggaguccgccaaccagaacagcuucgagguggucgaguccgaggugagcuucaagggccugugcaugcugaagcaccgcaugguggaggaguccuaccggaaccgccggagcgucaucugcuacgaccucgccugcaacuccaccuucugcaagcccaccguguacaugaucgugccgauccacgcgugcaacaugaugaaguccugccugaucgggcugggccccuaccgcauccaggucguguacgagcggacguacugcaccaccggcauccucaccgaggggaagugcuucgugcccgacaaggccgucgugagcgcccugaagcgcggcauguacgccaucgcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccugcccggcgaggagaucgccaccuaccagaucuccggccagaucgaggccaagaucccccacacggucagcuccaagaaccucaagcugaccgccuucgcggggaucccgagcuacuccagcaccuccauccuggccgccagcgaggacggccgcuucaucuucucccccgggcuguuccccaaccugaaccagagcgugugcgacaacaacgcccugccccucaucuggcggggccugaucgaccugaccggguacuacgaggccgugcacccgugcaacgucuucugcgugcucuccggccccggcgcgagcugcgaggccuucuccgagggcgggaucuucaacaucacgagccccaugugccuggucuccaagcagaaccgcuuccgggccgccgagcagcagaucagcuucgugugccagcgcguggacauggacaucaucgucuacugcaacgggcagaagaagaccauccugaccaagacccucgugaucggccagugcaucuacacgaucaccucccuguucagccugcuccccgggguggcccacagcaucgcgaucgagcugugcgucccgggcuuccacggcugggccaccgccgcccugcucaucaccuucugcuucgggugggugcugauccccgcgugcacgcuggccauccuccuggugcugaaguucuucgccaacauccuccacaccuccaaccaggagaaccgguucaaggccauccugcgcaagaucaaggaggaguucgagaagaccaagggcagcauggucugcgagaucugcaaguacgagugcgagacccugaaggagcucaaggcccacaaccuguccugcgugcagggggagugccccuacugcuucacgcacugcgagcccaccgagaccgcgauccaggcccacuacaaggugugccaggccacccaccgguuccgcgaggaccugaagaagacggucaccccgcagaacaucggccccgggugcuaccggacccucaaccuguuccgcuacaagagccggugcuacauccugaccauguggacccugcuccugaucaucgaguccauccugugggccgccagcgcggccgagaucccccucgugccccuguggacggacaacgcccacggcgugggcuccgucccgaugcacaccgaccuggagcucgacuucagccugcccuccagcuccaaguacaccuacaagcgccaccugaccaaccccgugaacgaccagcagagcgugucccuccacaucgagaucgagagccaggggaucggcgccgacguccaccaccuggggcacugguacgacgcccgccugaaccucaagacguccuuccacugcuacggcgcgugcaccaaguaccaguacccguggcacaccgccaagugccacuucgagaaggacuacgaguacgagaacagcugggccugcaacccgcccgacugccccggcguggggaccggcugcacggccugcgggcuguaccuggaccagcucaagcccgugggcaccgcguucaagaucaucuccguccgguacagccgcaaggugugcgugcaguucggggaggaguaccugugcaagaccaucgacaugaacgacugcuucgucacccggcacgccaagaucugcaucaucggcacggugagcaaguucucccagggcgacacccuccucuuccuggggcccauggagggcgggggcaucaucuuccgccacuggugcaccagcacgugccacuucggggaccccggcgacgugaugggccccaaggacaagccguucaucugccccgaguuccccgggcaguuccggaagaagugcaacuucgccaccacccccgucugcgaguacgacggcaacaucaucuccggguacaagaaggugcuggccaccaucgacagcuuccaguccuucaacaccagcaacauccacuucacggacgagcgcaucgaguggcgggacccggacggcaugcuccgcgaccacaucaacaucgugaucuccaaggacaucgacuucgagaaccuggccgagaaccccugcaaggucgggcugcaggcggccaacaucgagggcgccuggggcagcggggugggcuucacccugaccugccaggugucccugaccgagugccccacguuccugaccagcaucaaggccugcgacauggccaucugcuacggggcggaguccgucacccucagccggggccagaacaccgugaagaucacggggaagggcggccacuccgggagcuccuucaagugcugccacggcaaggagugcagcuccaccgggcugcaggccagcgcgccccaccuggacaaggugaacggcaucuccgagcucgagaacgagaaggucuacgacgacggcgccccggagugcggggugaccugcugguucaagaaguccggcgagugggugauggggaucaucaacggcaacugggucgugcugaucgugcugugcguccuccugcuguucagccucauccugcugagcauccucugccccgugcgcaagcacaagaaguccuga

SEQ ID NO: 11852 - RNA, 3402 nt, Artificial Sequence
  derived and/or modified CDS sequence (opt1) from SEOV(HuludaoRn101)__GU592923.1__GP
auguggagccugcuccugcuggccgcccucgugggccagggguucgcccugaagaacgucuucgacaugcgcauccagugcccccacuccgugaacuucggcgagaccagcguguccggguacaccgagcugccgccccucagccugcaggaggccgagcagcugguccccgaguccagcugcaacauggacaaccaccagucccucagcacgaucaacaagcugaccaaggugguguggcggaagaaggccaaccaggaguccgccaaccagaacagcuucgaggucguggaguccgaggugagcuucaagggccugugcaugcucaagcaccgcauggucgaggaguccuaccggaaccgccggagcgugaucugcuacgaccuggccugcaacuccaccuucugcaagcccaccguguacaugaucgucccgauccacgcgugcaacaugaugaaguccugccugaucgggcucggccccuaccgcauccaggugguguacgagcggacguacugcaccaccggcauccugaccgaggggaagugcuucguccccgacaaggccguggugagcgcccugaagcgcggcauguacgccaucgcgagcaucgagacgaucugcuucuucauccaccagaaggggaacaccuacaagaucgucaccgccaucaccuccgccaugggcagcaagugcaacaacacggacaccaaggugcagggguacuacaucugcaucaucggcggcaacagcgcccccguguacgccccggcgggggaggacuuccgggccauggaggucuucuccggcaucaucaccagcccccacggggaggaccacgaccuccccggcgaggagaucgccaccuaccagaucuccggccagaucgaggccaagaucccccacacggugagcuccaagaaccugaagcugaucgccuucgcggggaucccgagcuacuccagcaccuccauccucgccgccagcgaggacucccgcuucaucuucagccccggccuguuccccaaccugaaccaguccgugugcgacaacaacgcccucccccugaucuggcgggggcugaucgaccucaccggcuacuacgagaccguccacccgugcaacguguucugcguccugagcgggcccggcgccuccugcgaggcguucagcgagggcgggaucuucaacaucacgucccccaugugccuggugagcaagcagaaccgcuuccgggccgccgagcagcagaucuccuucaucugccagcgcguggacauggacaucaucgucuacugcaacggccagaagaagaccauccucaccaagacccuggugaucgggcagugcaucuacacgaucaccagccuguucagccuccugcccggcguggcccacuccaucgccaucgagcugugcgucccgggguuccacggcugggcgaccgccgcccuccugaucaccuucugcuucggcugggugcugauccccgccugcacgcucgcgauccugcuggugcucaaguucuucgccaacauccugcacaccagcaaccaggagaaccgguucaaggccauccugcgcaagaucaaggaggaguucgagaagaccaagggguccauggucugcgagaucugcaaguacgagugcgagacccucaaggagcugaaggcccacaaccugagcugcgugcagggcgagugccccuacugcuucacgcacugcgagcccaccgagaccgccauccaggcgcacuacaaggugugccaggccacccaccgguuccgcgaggaccucaagaagacggucaccccgcagaacaucgggcccggcugcuaccggacccugaaccuguuccgcuacaagucccggugcuacauccugaccauguggacccuccugcugaucaucgagagcauccucugggccgccuccgccgcggagaucccccuggugccccuguggacggacaacgcccacggggugggcagcaucccgaugcacaccgaccucgagcuggacuucucccugcccagcuccagcaaguacaccuacaagcgccaccucaccaaccccgucaacgaccagcaguccgugagccugcacaucgagaucgagucccagggcaucggggccgacgugcaccaccugggccacugguacgacgcccgccucaaccugaagacgagcuuccacugcuacggggccugcaccaaguaccaguacccguggcacaccgcgaagugccacuucgagaaggacuacgaguacgagaacuccugggccugcaacccgcccgacugccccggcgucggcaccgggugcacggccugcggccuguaccucgaccagcugaagcccguggggaccgccuucaagaucaucagcgugcgguacagccgcaaggucugcgugcaguucggcgaggaguaccugugcaagaccaucgacaugaacgacugcuucgugacccggcacgcgaagaucugcaucaucgggacggucuccaaguucagccagggcgacacccuccuguuccugggccccauggagggcggcgggaucaucuucaagcacuggugcaccuccacgugccacuucggggaccccggggacgugaugggccccaaggacaagccguucaucugccccgaguuccccggccaguuccgcaagaagugcaacuucgccaccacccccaucugcgaguacgacgggaacaucaucagcggcuacaagaaggugcucgccaccaucgacuccuuccagagcuucaacaccuccaacauccacuucacggacgagcggaucgaguggcgcgacccggacgggaugcugcgggaccacaucaacgucgugaucagcaaggacaucgacuucgagaaccuggccgagaaccccugcaaggugggccuccaggccgcgaacaucgagggggccuggggcuccggcgucggguucacccugaccugccaggugagccugaccgagugccccacguuccucaccuccaucaaggccugcgacauggccaucugcuacggcgccgagagcgugacccugucccgcgggcagaacaccguccggaucacgggcaagggcgggcacagcggcuccagcuucaagugcugccacgggaaggagugcuccagcaccggccugcaggcguccgcgccccaccucgacaaggugaacgggaucagcgagcuggagaacgagaagguguacgacgacggcgccccggagugcggcgugaccugcugguucaagaaguccggggagugggucaugggcaucaucaacgggaacugggugguccugaucgugcucugcgugcugcuccuguucagccugauccugcucagcauccugugccccguccgcaagcacaagaaguccuga

SEQ ID NO: 11853 - RNA, 3402 nt, Artificial Sequence
  derived and/or modified CDS sequence (opt1) from SEOV(Humber)__JX879768.1__GP
auguggagccugcuccugcuggccgcccucgugggccagggguucgcgcugaagaacgucuucgacaugcgcauccagugcccccacuccgugaacuucggcgagaccagcguguccggguacaccgagcugccgccccucagccugcaggaggccgagcagcugguccccgaguccagcugcaacauggacaaccaccagucccucagcacgaucaacaagcugaccaaggugaucuggcggaagaaggccaaccaggaguccgccaaccagaacagcuucgagguggucgaguccgaggugagcuucaagggccugugcaugcucaagcaccgcaugguggaggaguccuaccggaaccgccggagcgucaucugcuacgaccuggccugcaacuccaccuucugcaagcccaccguguacaugaucgugccgauccacgcgugcaacaugaugaaguccugccugaucgggcucggccccuaccgcauccaggucguguacgagcggacguacugcaccaccggcauccugaccgaggggaagugcuucgugcccgacaaggccgucguguccgcccugaagcgcggcauguacgccaucgcgagcaucgagacgaucugcuucuucgugcaccagaaggggaacaccuacaagaucgucaccgccaucaccuccgccaugggcagcaagugcaacaacacggacaccaaggugcagggguacuacaucugcaucaucggcggcaacagcgcccccguguacuccccggccggggaggacuuccgggcgauggaggucuucagcggcaucaucaccagcccccacggggaggaccacgaccuccccggcgaggagaucgccaccuaccagaucagcggccagaucgaggccaagaucccccacacgguguccagcaagaaccugaagcugaccgccuucgccgggaucccguccuacagcuccaccagcauccucgcggccuccgaggacggccgcuucaucuucagccccgggcuguuccccaaccugaaccaguccgugugcgacaacaacgcccucccccugaucuggcggggccugaucgaccucaccggguacuacgaggccguccacccgugcaacguguucugcguccugagcggccccggcgccuccugcgaggcguucagcgagggcgggaucuucaacaucacgucccccaugugccuggugagcaagcagaaccgcuuccgggccgccgagcagcagaucuccuucaucugccagcgcguggacauggacaucaucgucuacugcaacgggcagaagaagaccauccucaccaagacccuggugaucggccagugcaucuacacgaucaccagccuguucagccuccugcccgggguggcccacuccaucgccaucgagcugugcgucccgggcuuccacggcugggcgaccgccgcccuccugaucaccuucugcuucgggugggugcugauccccgccugcacgcucgcggugcugcugguccucaaguucuucgccaacauccugcacaccagcaaccaggagaaccgguucaaggccauccugcgcaagaucaaggaggaguucgagaagaccaagggcuccauggugugcgagaucugcaaguacgagugcgagacccucaaggagcugaaggcccacaaccugagcugcauccagggggagugccccuacugcuucacgcacugcgagcccaccgagaccgccauccaggcgcacuacaaggugugccaggccacccaccgguuccgcgaggaccucaagaagacggucaccccgcccaacaucggccccgggugcuaccggacccugaaccuguuccgcuacaagucccggugcuacauccugaccauguggacccuccugcugaucaucgagagcauccucugggccgccuccgccgcggagaucccccuggugccgcuguggacggacaacgcccacggcgugggcagcguccccaugcacaccgaccucgagcuggacuucucccugcccagcuccagcaaguacaccuacaagcgccaccucaccaacccggugaacgaccagcaguccgugagccugcacaucgagaucgagucccaggggaucggcgccgacguccaccaccuggggcacugguacgacgcccgccucaaccugaagacgagcuuccacugcuacggcgccugcaccaaguaccaguaccccuggcacaccgcgaagugccacuucgagaaggacuacgaguacgagaacuccugggccugcaacccgcccgacugccccggcguggggaccggcugcacggccugcgggcuguaccucgaccagcugaagcccgugggcaccgccuucaagaucaucagcguccgguacagccgcaaggugugcgugcaguucggggaggaguaccugugcaagaccaucgacaugaacgacugcuucgucacccggcacgcgaagaucugcaucaucggcacgguguccaaguucagccagggcgacacccuccuguuccuggggcccauggagggcgggggcaucaucuucaagcacuggugcaccuccacgugccacuucggggaccccggcgacgugaugggcccgaaggacaagcccuucaucugccccgaguuccccgggcaguuccgcaagaagugcaacuucgccaccaccccggucugcgaguacgacggcaacaucaucagcggguacaagaaggugcucgccaccaucgacuccuuccagagcuucaacaccuccaacauccacuucacggacgagcggaucgaguggcgcgaccccgacggcaugcugcgggaccacaucaacaucaucaucagcaaggacaucgacuucgagaaccuggccgagaaccccugcaagguggggcuccaggccgcgaacaucgagggcgccuggggcuccggggucggcuucacccugaccugccaggugagccugaccgagugccccacguuccucaccuccaucaaggccugcgacauggccaucugcuacggggccgagagcgugacccugucccgcggccagaacaccgucaagaucacggggaagggcggccacagcggguccagcuucaagugcugccacggcaaggagugcuccagcaacgggcugcaggcguccgccccgcaccucgacaaggugaacggcaucagcgagcuggagaacgagaagguguacgacgacggcgcccccgagugcggggugaccugcugguucaagaaguccggcgagugggucauggggaucaucaacggcaacugggugguccugaucgugcucugcgugcugcuccuguucagccugauccugcucagcauccugugccccguccggaagcacaagaaguccuga

SEQ ID NO: 11854 - RNA, 3402 nt, Artificial Sequence
  derived and/or modified CDS sequence (opt1) from SEOV(Humber)__KM948597.1__GP
auguggagccugcuccugcuggccgcccucgugggccagggguucgcgcugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcacgaucaacaagcugaccaaggugaucuggcggaagaaggccaaccaggaguccgccaaccagaacagcuucgagguggucgaguccgaggugagcuucaagggccugugcaugcucaagcaccgcaugguggaggaguccuaccggaaccgccggagcgucaucugcuacgaccuggccugcaacuccaccuucugcaagcccaccguguacaugaucgugccgauccacgcgugcaacaugaugaaguccugccugaucgggcucggccccuaccgcauccaggucguguacgagcggacguacugcaccaccggcauccugaccgaggggaagugcuucgugcccgacaaggccgucguguccgcccugaagcgcggcauguacgccaucgcgagcaucgagacgaucugcuucuucgugcaccagaaggggaacaccuacaagaucgucaccgccaucaccuccgccaugggcagcaagugcaacaacacggacaccaaggugcagggguacuacaucugcaucaucggcggcaacagcgcccccguguacuccccggccggggaggacuuccgggcgauggaggucuucagcggcaucaucaccagcccccacggggaggaccacgaccuccccggcgaggagaucgccaccuaccagaucagcggccagaucgaggccaagaucccccacacgguguccagcaagaaccugaagcugaccgccuucgccgggaucccguccuacagcuccaccagcauccucgcggccuccgaggacggccgcuucaucuucagccccgggcuguuccccaaccugaaccaguccgugugcgacaacaacgcccucccccugaucuggcggggccugaucgaccucaccggguacuacgaggccguccacccgugcaacguguucugcguccugagcggccccggcgccuccugcgaggcguucagcgagggcgggaucuucaacaucacgucccccaugugccuggugagcaagcagaaccgcuuccgggccgccgagcagcagaucuccuucaucugccagcgcguggacauggacaucaucgucuacugcaacgggcagaagaagaccauccucaccaagacccuggugaucggccagugcaucuacacgaucaccagccuguucagccuccugcccgggguggcccacuccaucgccaucgagcugugcgucccgggcuuccacggcugggcgaccgccgcccuccugaucaccuucugcuucgggugggugcugauccccgccugcacgcucgcggugcugcugguccucaaguucuucgccaacauccugcacaccagcaaccaggagaaccgguucaaggccauccugcgcaagaucaaggaggaguucgagaagaccaagggcuccauggugugcgagaucugcaaguacgagugcgagacccucaaggagcugaaggcccacaaccugagcugcauccagggggagugccccuacugcuucacgcacugcgagcccaccgagaccgccauccaggcgcacuacaaggugugccaggccacccaccgguuccgcgaggaccucaagaagacggucaccccgcccaacaucggccccgggugcuaccggacccugaaccuguuccgcuacaagucccggugcuacauccugaccauguggacccuccugcugaucaucgagagcauccucugggccgccuccgccgcggagaucccccuggugccgcuguggacggacaacgcccacggcgugggcagcguccccaugcacaccgaccucgagcuggacuucucccugcccagcuccagcaaguacaccuacaagcgccaccucaccaacccggugaacgaccagcaguccgugagccugcacaucgagaucgagucccaggggaucggcgccgacguccaccaccuggggcacugguacgacgcccgccucaaccugaagacgagcuuccacugcuacggcgccugcaccaaguaccaguaccccuggcacaccgcgaagugccacuucgagaaggacuacgaguacgagaacuccugggccugcaacccgcccgacugccccggcguggggaccggcugcacggccugcgggcuguaccucgaccagcugaagcccgugggcaccgccuucaagaucaucagcguccgguacagccgcaaggugugcgugcaguucggggaggaguaccugugcaagaccaucgacaugaacgacugcuucgucacccggcacgcgaagaucugcaucaucggcacgguguccaaguucagccagggcgacacccuccuguuccuggggcccauggagggcgggggcaucaucuucaagcacuggugcaccuccacgugccacuucggggaccccggcgacgugaugggcccgaaggacaagcccuucaucugccccgaguuccccgggcaguuccgcaagaagugcaacuucgccaccaccccggucugcgaguacgacggcaacaucaucagcggguacaagaaggugcucgccaccaucgacuccuuccagagcuucaacaccuccaacauccacuucacggacgagcggaucgaguggcgcgaccccgacggcaugcugcgggaccacaucaacaucaucaucagcaaggacaucgacuucgagaaccuggccgagaaccccugcaagguggggcuccaggccgcgaacaucgagggcgccuggggcuccggggucggcuucacccugaccugccaggugagccugaccgagugccccacguuccucaccuccaucaaggccugcgacauggccaucugcuacggggccgagagcgugacccugcugcgcggccagaacaccgucaagaucacggggaagggcggccacuccgggagcuccuucaagugcugccacggcaaggagugcagcuccaacgggcuccaggcgagcgccccgcaccuggacaaggugaacggcaucuccgagcuggagaacgagaagguguacgacgacggcgcccccgagugcggggugaccugcugguucaagaaguccggcgagugggucauggggaucaucaacggcaacugggugguccucaucgugcugugcgugcugcuccuguucagccugauccuccugagcauccugugccccguccggaagcacaagaaguccuga

SEQ ID NO: 11855 - RNA, 3402 nt, Artificial Sequence
  derived and/or modified CDS sequence (opt1) from SEOV(K24-e7)__AF288652.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcacgaucaacaagcugaccaaggugguguggcggaagaaggccaaccaggaguccgccaaccagaacagcuucgaggucguggaguccgaggugagcuucaagggccugugcaugcucaagcaccgcauggucgaggaguccuaccggaaccgccggagcgugaucugcuacgaccuggccugcaacuccaccuucugcaagcccaccguguacaugaucgucccgauccacgcgugcaacaugaugaaguccugccugaucgggcucggccccuaccgcauccaggugguguacgagcggacguacugcaccaccggcauccugaccgaggggaagugcuucguccccggcaaggccguggugagcgcccugaagcgcgggauguacgccaucgcgagcaucgagacgaucugcuucuucauccaccagaagggcaacaccuacaagaucgucaccgccaucaccuccgccauggggagcaagugcaacaacacggacaccaaggugcagggcuacuacaucugcaucaucggcgggaacagcgcccccguguacgccccggcgggcgaggacuuccgggccauggaggucuucuccgggaucaucaccagcccccacggcgaggaccacgaccuccccggcgaggagaucgccaccuaccagaucuccgggcagaucgaggccaagaucccccacacggugagcuccaagaaccugaagcugaucgccuucgcgggcaucccgagcuacuccagcaccuccauccucgccgccagcgaggacgggcgcuucaucuucucccccggccuguuccccaaccugaaccagagcgugugcgacaacaacgcccucccccugaucuggcgggggcugaucgaccucaccggcuacuacgaggccguccacccgugcaacguguuccgcguccuguccggccccggggcgagcugcgaggccuucuccgagggcgggaucuucaacaucaccagccccaugugccugguguccaagcagaaccgguuccgcgccgccgagcagcagaucagcuucaucugccagcggguggacauggacaucaucgucuacugcaacggccagaagaagacgauccucaccaagacccuggugaucgggcagugcaucuacaccaucacgucccuguucagccuccugcccggcguggcccacagcaucgcgaucgagcugugcgucccgggcuuccacgggugggccaccgccgcccuccugaucaccuucugcuucggcugggugcugauccccgcgugcacccucgccauccugcuggugcucaaguucuucgccaacauccugcacacguccaaccaggagaaccgcuucaaggccauccugcggaagaucaaggaggaguucgagaagaccaaggggagcauggucugcgagaucugcaaguacgagugcgagacccucaaggagcugaaggcccacaaccuguccugcgugcagggcgagugccccuacugcuucacccacugcgagcccacggagaccgcgauccaggcccacuacaaggugugccaggccacccaccgcuuccgggaggaccucaagaagaccgucacgccgcagaacaucgggcccggcugcuaccgcacccugaaccuguuccgguacaagagccgcugcuacauccugaccauguggacccuccugcugaucaucgaguccauccucugggccgccagcgcggccgagaucccccuggugccccuguggaccgacaacgcccacggcgugggguccgucccgaugcacacggaccucgagcuggacuucagccugcccuccagcuccaaguacaccuacaagcgccaccucaccaaccccgugaacgaccagcagagcgugucccugcacaucgagaucgagagccagggcaucggggccgacguccaccaccugggccacugguacgacgcccggcucaaccugaagaccuccuuccacugcuacggcgcgugcacgaaguaccaguacccguggcacaccgccaagugccacuucgagaaggacuacgaguacgagaacagcugggccugcaacccgcccgacugccccggggugggcaccgggugcaccgccugcggccuguaccucgaccagcugaagcccguggggacggcguucaagaucaucuccguccgcuacagccggaaggugugcaugcaguucggcgaggaguaccugugcaagaccaucgacaugaacgacugcuucgugacccgccacgccaagaucugcaucaucggcaccgucagcaaguucucccagggggacacgcuccuguuccugggccccauggagggcggcgggaucaucuucaagcacuggugcaccagcacgugccacuucggggaccccggcgacgugauggggcccaaggacaagccguucaucugccccgaguuccccggccaguuccggaagaagugcaacuucgccaccacccccaucugcgaguacgacgggaacaucaucuccggcuacaagaaggugcucgccaccaucgacagcuuccaguccuucaacaccagcaacauccacuucaccgacgagcgcaucgaguggcgggacccggacgggaugcugcgcgaccacaucaacaucgucaucuccaaggacaucgacuucgagaaccuggccgagaaccccugcaaggugggccuccaggcggccaacaucgagggcgccugggggagcggcgugggguucacgcugaccugccaggucucccugaccgagugccccaccuuccucacgagcaucaaggccugcgacauggccaucugcuacggcgcggaguccgugacccugagccgggggcagaacaccgugcgcaucaccggccggggcgggcacuccggcagcuccuucaagugcugccacgggaaggagugcagcuccacgggccugcaggccagcgcgccccaccucgacaaggucaacggcaucuccgagcuggagaacgagaagguguacgacgacggggccccggagugcggcgugaccugcugguucaagaaguccggggagugggucaugggcaucaucaacgggaacuggguggugcugaucguccucugcgugcugcuccuguucagccugauccugcucagcauccugugccccgugcgcaagcacaagaaguccuga

SEQ ID NO: 11856 - RNA, 3402 nt, Artificial Sequence
  derived and/or modified CDS sequence (opt1) from SEOV(K24-v2)__AF288654.1__GP
auguggagccugcuccugcuggccgcccucgugggccagggguucgcgcugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcacgaucaacaagcugaccaaggugguguggcggaagaaggccaaccaggaguccgccaaccagaacagcuucgaggucguggaguccgaggugagcuucaagggccugugcaugcucaagcaccgcauggucgaggaguccuaccggaaccgccggagcgugaucugcuacgaccuggccugcaacuccaccuucugcaagcccaccguguacaugaucgucccgauccacgcgugcaacaugaugaaguccugccugaucgggcucggccccuaccgcauccaggugguguacgagcggacguacugcaccaccggcauccugaccgaggggaagugcuucguccccgacacggccguggugagcgcccugaagcgcggcauguacgccaucgcgagcaucgagaccaucugcuucuucauccaccagaaggggaacaccuacaagaucgucaccgccaucacguccgccaugggcagcaagugcaacaacaccgacaccaaggugcagggguacuacaucugcaucaucggcggcaacagcgcccccguguacgccccggcgggggaggacuuccgggccauggaggucuucuccggcaucaucaccagcccccacggggacgaccacgaccuccccggcgaggagaucgcccccuaccagaucuccggccagaucgaggccaagaucccgcacacggugagcuccaagaaccugaagcugaucgccuucgcggggauccccagcuacuccagcaccuccauccucgccgccagcgaggacggccgcuucaucuucucccccgggcuguuccccaaccugaaccagagcgugugcgacaacaacgcccucccgcugaucuggcggggccugaucgaccucaccggguacuacgaggccguccaccccugcaacguguucugcguccuguccggccccggcgcgagcugcgaggccuucuccgagggcgggaucuucaacaucaccagccccaugugccugguguccaagcagaaccgcuuccgggccgccgagcagcagaucagcuucaucugccagcgcguggacauggacaucaucgucuacugcaacgaccagaagaagacgauccucaccaagacccuggugaucgggcagugcaucuacaccaucacgucccuguucagccuccugccgggcguggcccacagcaucgcgaucgagcugugcguccccggguuccacggcugggccaccgccgcccuccugaucaccuucugcuucggcugggugcugauccccgcgugcacccucgccauccugcuggugcucaaguucuucgccaacauccugcacacguccaaccaggagaaccgguucaaggccauccugcgcaagaucaaggaggaguucgagaagaccaaggggagcauggucugcgagaucugcaaguacgagugcgagacccucaaggagcugaaggcccacaaccuguccugcgugcagggcgagugccccuacugcuucacccacugcgagccgacggagaccgcgauccaggcccacuacaaggugugccaggccacccaccgguuccgcgaggaccucaagaagaccgucacgccccagaacaucgggcccggcugcuaccggacccugaaccuguuccgcuacaagagccggugcuacauccugaccauguggacccuccugcugaucaucgaguccauccucugggccgccagcgcggccgagaucccccuggugccgcuguggaccgacaacgcccacggggugggcuccguccccaugcacacggaccucgagcuggacuucagccugcccuccagcuccaaguacaccuacaagcgccaccucaccaacccggugaacgaccagcagagcgugucccugcacaucgagaucgagagccagggcaucggggccgacguccaccaccugggccacugguacggggcccgccucaaccugaagaccuccuuccacugcuacggcgcgugcacgaaguaccaguaccccuggcacaccgccaagugccacuucgagaaggacuacgaguacgagaacagcugggccugcaacccgcccgacugccccggcguggggaccggcugcaccgccugcgggcuguaccucgaccagcugaagcccgugggcacggcguucaagaucaucuccguccgguacagccgcaaggugugcaugcaguucggggaggaguaccugugcaagaccaucgacaugaacgacugcuucgugacccggcacgccaagaucugcaucaucggcaccgucagcaaguucucccagggcgacacgcuccuguuccuggggcccauggagggcgggggcaucaucuucaagcacuggugcaccagcacgugccacuucggggaccccggcgacgugaugggcccgaaggacaagcccuucaucugccccgaguuccccgggcaguuccgcaagaagugcaacuucgccaccaccccgaucugcgaguacgacggcaacaucaucuccggguacaagaaggugcucgccaccaucgacagcuuccaguccuucaacaccagcaacauccacuucaccgacgagcggaucgaguggcgcgaccccgacggcaugcugcgggaccacaucaacaucgucaucuccaaggacaucgacuucgagaaccuggccgagaaccccugcaagguggggcuccaggcggccaacaucgagggcgccuggggcagcggggugggcuucacgcugaccugccaggucucccugaccgagugccccaccuuccucacgagcaucaaggccugcgacauggccaucugcuacggggcggaguccgugacccugagccgcggccagaacaccgugcggaucaccgggaagggcggccacuccgggagcuccuucaagugcugccacggcaaggagugcagcuccacggggcugcaggccagcgccccgcaccucgacaaggucaacggcaucuccgagcuggagaacgagaagguguacgacgacggcgcccccgagugcggggugaccugcugguucaagaaguccggcgagugggucauggggaucaucaacggcaacuggguggugcugaucguccucugcgugcugcuccuguucagccugauccugcucagcauccugugccccgugcgcaagcacaagaaguccuga

SEQ ID NO: 11857 - RNA, 3402 nt, Artificial Sequence
  derived and/or modified CDS sequence (opt1) from SEOV(KI-83-262)__D17592.1__GP
auguggagccugcuccugcuggccgcccucgugggccagggguucgcccugaagaacgucuucgacaugcgcauccagugcccccacuccgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgagguggucgaguccgaggugagcuucaagggccugugcaugcucaagcaccgcaugguggaggaguccuaccggaaccgccggagcgucaucugcuacgaccuggccugcaacuccaccuucugcaagcccaccguguacaugaucgugccgauccacgcgugcaacaugaugaaguccugccugaucgggcucggccccuaccgcauccaggucguguacgagcggacguacugcaccaccggcauccugaccgaggggaagugcuucgugcccgacaaggccgucgugagcgcccugaagcgcggcauguacgccaucgcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggucagcuccaagaaccugaagcugaccgccuucgcggggaucccgagcuacuccagcaccuccauccucgccgccagcgaggacggccgcuucaucuucucccccgggcuguuccccaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucacgagccccaugugccuggucuccaagcagaaccgcuuccgggccgccgagcagcagaucagcuucgugugccagcgcguggacauggacaucaucgucuacugcaacgggcagaagaagaccauccucaccaagacccuggugaucggccagugcaucuacacgaucaccucccuguucagccuccugcccgggguggcccacagcaucgcgaucgagcugugcgucccgggcuuccacggcugggccaccgccgcccuccugaucaccuucugcuucgggugggugcugauccccgcgugcacgcucgccauccugcuggugcucaaguucuucgccaacauccugcacaccuccaaccaggagaaccgguucaaggccauccugcgcaagaucaaggaggaguucgagaagaccaagggcagcauggucugcgagaucugcaaguacgagugcgagacccucaaggagcugaaggcccacaaccuguccugcgugcagggggagugccccuacugcuucacgcacugcgagcccaccgagaccgcgauccaggcccacuacaaggugugccaggccacccaccgguuccgcgaggaccucaagaagacggucaccccgcagaacaucggccccgggugcuaccggacccugagccuguuccgcuacaagucccggugcuacauccugaccauguggacccuccugcugaucaucgagagcauccucugggccgccuccgcggccgagaucccccuggugccccuguggacggacaacgcccacggcgugggcagcgucccgaugcacaccgaccucgagcuggacuucucccugcccagcuccagcaaguacaccuacaagcgccaccucaccaaccccgugaacgaccagcaguccgugagccugcacaucgagaucgagucccaggggaucggcgccgacguccaccaccuggggcacugguacgacgcccgccucaaccugaagacgagcuuccacugcuacggcgcgugcaccaaguaccaguacccguggcacaccgccaagugccacuucgagaaggacuacgaguacgagaacuccugggccugcaacccgcccgacugccccggcguggggaccggcugcacggccugcgggcuguaccucgaccagcugaagcccgugggcaccgcguucaagaucaucagcguccgguacagccgcaaggugugcgugcaguucggggaggaguaccugugcaagaccaucgacaugaacgacugcuucgucacccggcacgccaagaucugcaucaucggcacgguguccaaguucagccagggcgacacccuccuguuccuggggcccauggagggcgggggcaucaucuucaagcacuggugcaccuccacgugccacuucggggaccccggcgacgugaugggccccaaggacaagccguucaucugccccgaguuccccgggcaguuccgcaagaagugcaacuucgccaccacccccgucugcgaguacgacggcaacaucaucagcggguacaagaaggugcucgccaccaucgacuccuuccagagcuucaacaccuccaacauccacuucacggacgagcggaucgaguggcgcgacccggacggcaugcugcgggaccacaucaacaucgugaucagcaaggacaucgacuucgagaaccuggccgagaaccccugcaaggucgggcuccaggcggccaacaucgagggcgccuggggcuccggggugggcuucacccugaccugccaggugagccugaccgagugccccacguuccucaccuccaucaaggccugcgacauggccaucugcuacggggcggagagcgucacccugucccgcggccagaacaccgugaagaucacggggaagggcggccacagcggguccagcuucaagugcugccacggcaaggagugcuccagcaccgggcugcaggccuccgcgccccaccucgacaaggugaacggcaucagcgagcuggagaacgagaaggucuacgacgacggcgccccggagugcgggaucacgugcugguucaagaaguccggcgagugggugauggggaucaucaacggcaacugggugguccugaucgugcucugcgugcugcuccuguucagccugauccugcucagcauccugugccccguccggaagcacaagaaguccuga

SEQ ID NO: 11858 - RNA, 3402 nt, Artificial Sequence
  derived and/or modified CDS sequence (opt1) from SEOV(KI-85-1)__D17593.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgagguggucgaguccgaggugagcuucaagggccugugcaugcucaagcaccgcaugguggaggaguccuaccggaaccgccggagcgucaucugcuacgaccuggccugcaacuccaccuucugcaagcccaccguguacaugaucgugccgauccacgcgugcaacaugaugaaguccugccugaucgggcucggccccuaccgcauccaggucguguacgagcggacguacugcaccaccggcauccugaccgaggggaagugcuucgugcccgacaaggccgucgugagcgcccugaagcgcggcauguacgccaucgcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggucagcuccaagaaccugaagcugaccgccuucgcggggaucccgagcuacuccagcaccuccauccucgccgccagcgaggacggccgcuucaucuucucccccgggcuguuccccaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucacgagccccaugugccuggucuccaagcagaaccgcuuccgggccgccgagcagcagaucagcuucgugugccagcgcguggacauggacaucaucgucuacugcaacgggcagaagaagaccauccucaccaagacccuggugaucggccagugcaucuacacgaucaccucccuguucagccuccugcccgggguggcccacagcaucgcgaucgagcugugcgucccgggcuuccacggcugggccaccgccgcccuccugaucaccuucugcuucgggugggugcugauccccgcgugcacgcucgccauccugcuggugcucaaguucuucgccaacauccugcacaccuccaaccaggagaaccgguucaaggccauccugcgcaagaucaaggaggaguucgagaagaccaagggcagcauggucugcgagaucugcaaguacgagugcgagacccucaaggagcugaaggcccacaaccuguccugcgugcagggggagugccccuacugcuucacgcacugcgagcccaccgagaccgcgauccaggcccacuacaaggugugccaggccacccaccgguuccgcgaggaccucaagaagacggucaccccgcagaacaucggccccgggugcuaccggacccugaaccuguuccgcuacaagagccggugcuacauccugaccauguggacccuccugcugaucaucgaguccauccucugggccgccagcgcggccgagaucccccuggugccccuguggacggacaacgcccacggcgugggcuccgucccgaugcacaccgaccucgagcuggacuucagccugcccuccagcuccaaguacaccuacaagcgccaccucaccaaccccgugaacgaccagcagagcgugucccugcacaucgagaucgagagccaggggaucggcgccgacguccaccaccuggggcacugguacgacgcccgccucaaccugaagacguccuuccacugcuacggcgcgugcgccaaguaccaguacccguggcacaccgccaagugccacuucgagaaggacuacgaguacgagaacagcugggccugcaacccgcccgacugccccggcguggggaccggcugcaccgcgugcgggcuguaccucgaccagcugaagcccgugggcacggccuucaagaucaucuccguccgguacagccgcaaggugugcgugcaguucggggaggaguaccugugcaagaccaucgacaugaacgacugcuucgucacccggcacgccaagaucugcaucaucggcaccgugagcaaguucucccagggcgacacgcuccuguuccuggggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgucugcgaguacgacggcaacaucaucuccggguacaagaaggugcucgccaccaucgacagcuuccaguccuucaacaccagcaacauccacuucaccgacgagcggaucgaguggcgcgacccggacggcaugcugcgggaccacaucaacaucgugaucuccaaggacaucgacuucgagaaccuggcggagaaccccugcaaggucgggcuccaggccgccaacaucgagggcgccuggggcagcggggugggcuucacgcugaccugccaggugucccugaccgagugccccaccuuccucacgagcaucaaggccugcgacauggcgaucugcuacggggccgaguccgucacccugagccgcggccagaacaccgugaagaucaccgggaagggcggccacuccgggagcuccuucaagugcugccacggcaaggagugcagcuccacggggcugcaggccagcgcgccccaccucgacaaggugaacggcaucuccgagcuggagaacgagaaggucuacgacgacggcgccccggagugcgggaucacgugcugguucaagaaguccggcgagugggugauggggaucaucaacggcaacugggugguccugaucgugcucugcgugcugcuccuguucagcuucauccugcugagcauccucugccccguccggaagcacaagaaguccuga

SEQ ID NO: 11859 - RNA, 3402 nt, Artificial Sequence
  derived and/or modified CDS sequence (opt1) from SEOV(KI-88-15)__D17594.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgagaucguggaguccgaggucagcuucaagggccugugcaugcucaagcaccgcaugguggaggaguccuaccggaaccgccggagcgugaucugcuacgaccuggccugcaacuccaccuucugcaagcccaccgucuacaugaucgugccgauccacgcgugcaacaugaugaaguccugccugaucgggcucggccccuaccgcauccagguggucuacgagcggacguacugcaccaccggcauccugaccgaggggaagugcuucgugcccgacaaggccguggucagcgcccugaagcgcggcauguacgccaucgcgagcaucgagacgaucugcuucuucauccaccagaaggggaacaccuacaagaucgugaccgccaucaccuccgccaugggcagcaagugcaacaacacggacaccaaggugcagggguacuacaucugcaucaucggcggcaacagcgcccccgucuacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggugagcuccaagaaccugaagcugaccgccuucgcggggaucccgagcuacuccagcaccuccauccucgccgccagcgaggacggccgcuucaucuucucccccgggcuguuccccaaccugaaccagagcgucugcgacaacaacgcccucccccugaucuggcggggccugaucgaccucaccggguacuacgaggccgugcacccgugcaacguguucugcguccuguccggccccggcgcgagcugcgaggccuucuccgagggcgggaucuucaacaucacgagccccaugugccugguguccaagcagaaccgcuuccgggccgccgagcagcagaucagcuucgucugccagcgcguggacauggacaucaucguguacugcaacgggcagaagaagaccauccucaccaagacccuggucaucggccagugcaucuacacgaucaccucccuguucagccuccugcccgggguggcccacagcaucgcgaucgagcugugcgugccgggcuuccacggcugggccaccgccgcccuccugaucaccuucugcuucggguggguccugauccccgcgugcacgcucgccauccugcuggugcucaaguucuucgccaacauccugcacaccuccaaccaggagaaccgguucaaggccauccugcgcaagaucaaggaggaguucgagaagaccaagggcagcauggugugcgagaucugcaaguacgagugcgagacccucaaggagcugaaggcccacaaccuguccugcguccagggggagugccccuacugcuucacgcacugcgagcccaccgagaccgcgauccaggcccacuacaaggugugccaggccacccaccgguuccgcgaggaccucaagaagacggugaccccgcagaacaucggccccgggugcuaccggacccugaaccuguuccgcuacaagagccggugcuacauccugaccauguggacccuccugcugaucaucgaguccauccucugggccgccagcgcggccgagaucccccuggucccccuguggacggacaacgcccacggcgugggcuccgugccgaugcacaccgaccucgagcuggacuucagccugcccuccagcuccaaguacaccuacaagcgccaccucaccaaccccgucaacgaccagcagagcgugucccugcacaucgagaucgagagccaggggaucggcgccgacgugcaccaccuggggcacugguacgacgcccgccucaaccugaagacguccuuccacugcuacggcgcgugcaccaaguaccaguacccguggcacaccgccaagugccacuucgagaaggacuacgaguacgagaacagcugggccugcaacccgcccgacugccccggcgucgggaccggcugcacggccugcgggcuguaccucgaccagcugaagcccgugggcaccgcguucaagaucaucuccgugcgguacagccgcaaggucugcgugcaguucggggaggaguaccugugcaagaccaucgacaugaacgacugcuucgugacccggcacgccaagaucugcaucaucggcacggucagcaaguucucccagggcgacacccuccuguuccuggggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgugugcgaguacgacggcaacaucaucuccggguacaagaagguccucgccaccaucgacagcuuccaguccuucaacaccagcaacauccacuucacggacgagcggaucgaguggcgcgacccggacggcaugcugcgggaccacaucaacaucgugaucuccaaggacaucgacuucgagaaccuggccgagaaccccugcaagguggggcuccaggcggccaacaucgagggcgccuggggcagcggggucggcuucacccugaccugccaggugucccugaccgagugccccacguuccucaccagcaucaaggccugcgacauggccaucugcuacggggcggaguccgugacccugagccgcggccagaacaccgucaagaucacggggaagggcggccacuccgggagcuccuucaagugcugccacggcaaggagugcagcuccaccgggcugcaggccagcgcgccccaccucgacaaggugaacggcaucuccgagcugaagaacgagaagguguacgacgacggcgccccggagugcgggaucacgugcugguucaagaaguccggcgagugggucauggggaucaucaacggcaacuggguggugcugaucguccucugcgugcugcuccuguucagcuucauccugcugagcauccucugccccgugcggaagcacaagaaguccuga

SEQ ID NO: 11860 - RNA, 3402 nt, Artificial Sequence
  derived and/or modified CDS sequence (opt1) from SEOV(LongwanRn581)__GU592930.1__GP
auguggagccugcuccugcuggccgcccucgugggccagggguucgcccugaagaacgucuucgacaugcgcauccagugcccccacuccgugaacuucggcgagaccagcguguccggguacaccgagcugccgccccucagccugcaggaggccgagcagcugguccccgaguccagcugcaacauggacaaccaccagucccucagcacgaucaacaagcugaccaaggugaucuggcggaagaaggccaaccaggaguccgccaaccagaacagcuucgagguggucgaguccgaggugagcuucaagggccugugcaugcucaagcaccgcaugguggaggaguccuaccggaaccgccggagcgucaucugcuacgaccuggccugcaacuccaccuucugcaagcccaccguguacaugaucgugccgauccacgcgugcaacaugaugaaguccugccugaucgggcucggccccuaccgcauccaggucguguacgagcggacguacugcaccaccggcauccugaccgaggggaagugcuucgugcccgacaaggccgucgugagcgcccugaagcgcggcauguacgccaucgcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggucagcuccaagaaccugaagcugaccgccuucgcggggaucccgagcuacuccagcaccuccauccucgccgccagcgaggacggccgcuucaucuucucccccgggcuguuccccaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucacgagccccaugugccuggucuccaagcagaaccgcuuccgggccgccgagcagcagaucagcuucgugugccagcgcguggacauggacaucaucgucuacugcaacgggcagaagaagaccauccucaccaagacccuggugaucggccagugcaucuacacgaucaccucccuguucagccuccugcccgggguggcccacagcaucgcgaucgagcugugcgucccgggcuuccacggcugggccaccgccgcccuccugaucaccuucugcuucgggugggugcugauccccgcgugcacgcucgccauccugcuggugcucaaguucuucgccaacauccugcacaccuccaaccaggagaaccgguucaaggccauccugcgcaagaucaaggaggaguucgagaagaccaagggcagcauggucugcgagaucugcaaguacgagugcgagacccucaaggagcugaaggcccacaaccuguccugcgugcagggggagugccccuacugcuucacgcacugcgagcccaccgagaccgcgauccaggcccacuacaaggugugccaggccacccaccgguuccgcgaggaccucaagaagacggucaccccgcagaacaucggccccgggugcuaccggacccugaaccuguuccgcuacaagagccggugcuacauccugaccauguggacccuccugcugaucaucgaguccauccucugggccgccagcgcggccgagaucccccuggugccccuguggacggacaacgcccacggcgugggcuccgucccgaugcacaccgaccucgagcuggacuucagccugcccuccagcuccaaguacaccuacaagcgccaccucaccaaccccgugaacgaccagcagagcgugucccugcacaucgagaucgagagccaggggaucggcgccgacguccaccaccuggggcacugguacgacgcccgccucaaccugaagacguccuuccacugcuacggcgcgugcaccaaguaccaguacccguggcacaccgccaagugccacuucgagaaggacuacgaguacgagaacagcugggccugcaacccgcccgacugccccggcguggggaccggcugcacggccugcgggcuguaccucgaccagcugaagcccgugggcaccgcguucaagaucaucuccguccgguacagccgcaaggugugcgugcaguucggggaggaguaccugugcaagaccaucgacaugaacgacugcuucgucacccggcacgccaagaucugcaucaucggcacggugagcaaguucucccagggcgacacccuccuguuccuggggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgucugcgaguacgacggcaacaucaucuccggguacaagaaggugcucgccaccaucgacagcuuccaguccuucaacaccagcaacauccacuucacggacgagcggaucgaguggcgcgacccggacggcaugcugcgggaccacaucaacaucgugaucuccaaggacaucgacuucgagaaccuggccgagaaccccugcaaggucgggcuccaggcggccaacaucgagggcgccuggggcagcggggugggcuucacccugaccugccaggugucccugaccgagugccccacguuccucaccagcaucaaggccugcgacauggccaucugcuacggggcggaguccgucacccugagccgcggccagaacaccgugaagaucacggggaagggcggccacuccgggagcuccuucaagugcugccacggcaaggagugcagcuccaccgggcugcaggccaacgcgccccaccucgacaaggugaacggcaucagcgagcuggagaacgagaaggucuacgacgacggcgccccggagugcggggugaccugcugguucaagaaguccggcgagugggugauggggaucaucaacggcaacugggucgugcugaucgugcucugcguccugcuccuguucagccugauccugcucagcauccugugccccgugcggaagcacaagaaguccuga

SEQ ID NO: 11861 - RNA, 3402 nt, Artificial Sequence
  derived and/or modified CDS sequence (opt1) from SEOV(RuianRn180)__GU592931.1__GP
auguggagccugcucaucguggccgcccuggucggccagggguucgcccugaagaacguguucgacaugcgcauccagugcccccacagcgugaacuucggcgagaccagcgucuccggguacaccgagcucccgccccugagccugcaggaggccgagcagcucgugcccgaguccagcugcaacauggacaaccaccagucccugagcacgaucaacaagcugaccaaggugaucuggcggaagaaggccaaccaggaguccgccaaccagaacagcuucgaggucguggaguccgaggugagcuucaagggccucugcaugcugaagcaccgcauggucgaggaguccuaccggaaccgccggagcgugaucugcuacgaccuggccugcaacuccaccuucugcaagcccaccguguacaugaucgucccgauccacgcgugcaacaugaugaaguccugccucaucgggcugggccccuaccgcauccaggugguguacgagcggacguacugcaccaccggcauccugaccgaggggaagugcuucguccccgacaaggccguggugagcgcccucaagcgcggcauguacgccaucgcgagcaucgagacgaucugcuucuucauccaccagaaggggaacaccuacaagaucgucaccgccaucaccuccgccaugggcagcaagugcaacaacacggacaccaaggugcagggguacuacaucugcaucaucggcggcaacagcgcccccguguacgccccggcgggggaggacuuccgggccauggaggucuucuccggcaucaucaccagcccccacggggaggaccacgaccugcccggcgaggagaucgccaccuaccagaucuccggccagaucgaggccaagaucccccacacggugagcuccaagaaccugaagcucaccgccuucgcggggaucccgagcuacuccagcaccuccauccuggccgccagcgaggacggccgcuucaucuucucccccgggcuguuccccaaccucaaccagagcgugugcgacaacaacgcccugccccugaucuggcggggccucaucgaccugaccggguacuacgaggccguccacccgugcaacguguucugcguccuguccggccccggcgcgagcugcgaggccuucuccgagggcgggaucuucaacaucacgagccccaugugccucguguccaagcagaaccgcuuccgggccgccgagcagcagaucagcuucaucugccagcgcguggacauggacaucaucgucuacugcaacgggcagaagaagaccauccugaccaagacccuggugaucggccagugcaucuacacgaucaccucccucuucagccugcugcccgggguggcccacagcaucgcgaucgagcucugcgucccgggcuuccacggcugggccaccgccgcccugcugaucaccuucugcuucgggugggugcucauccccgcgugcacgcuggccauccugcucgugcugaaguucuucgccaacauccugcacaccuccaaccaggagaaccgguucaaggccauccuccgcaagaucaaggaggaguucgagaagaccaagggcagcauggucugcgagaucugcaaguacgagugcgagacccugaaggagcugaaggcccacaaccucuccugcgugcagggggagugccccuacugcuucacgcacugcgagcccaccgagaccgcgauccaggcccacuacaaggugugccaggccacccaccgguuccgcgaggaccugaagaagacggucaccccgcagaacaucggccccgggugcuaccggacccugaaccucuuccgcuacaagagccggugcuacauccugaccauguggacccugcugcucaucaucgaguccauccugugggccgccagcgcggccgagaucccccuggugccccucuggacggacaacgcccacggcgugggcuccgucccgaugcacaccgaccuggagcuggacuucagccuccccuccagcuccaaguacaccuacaagcgccaccugaccaaccccgugaacgaccagcagagcgugucccugcacaucgagaucgagagccaggggaucggcgccgacguccaccaccucgggcacugguacgacgcccgccugaaccugaagacguccuuccacugcuacggcgcgugcaccaaguaccaguacccguggcacaccgccaagugccacuucgagaaggacuacgaguacgagaacagcugggccugcaacccgcccgacugccccggcguggggaccggcugcacggccugcgggcucuaccuggaccagcugaagcccgugggcaccgcguucaagaucaucuccguccgguacagccgcaaggugugcgugcaguucggggaggaguaccucugcaagaccaucgacaugaacgacugcuucgucacccggcacgccaagaucugcaucaucggcacggugagcaaguucucccagggcgacacccugcuguuccucgggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgucugcgaguacgacggcaacaucaucuccggguacaagaaggugcuggccaccaucgacagcuuccaguccuucaacaccagcaacauccacuucacggacgagcggaucgaguggcgcgacccggacggcaugcugcgggaccacaucaacaucgugaucuccaaggacaucgacuucgagaaccucgccgagaaccccugcaaggucgggcugcaggcggccaacaucgagggcgccuggggcagcggggugggcuucacccugaccugccaggugucccucaccgagugccccacguuccugaccagcaucaaggccugcgacauggccaucugcuacggggcggaguccgucacccugagccgcggccagaacaccgugaagaucacggggaagggcggccacuccgggagcuccuucaagugcugccacggcaaggagugcagcuccaccgggcuccaggccagcgcgccccaccuggacaaggugaacggcaucuccgagcuggagaacgagaaggucuacgacgacggcgccccggagugcggggugaccugcugguucaagaaguccggcgagugggugauggggaucaucaacggcaacugggucgugcucaucgugcugugcguccugcuccuguucagccugauccuccugagcauccugugccccgugcggaagcacaagaaguccuga

SEQ ID NO: 11862 - RNA, 3402 nt, Artificial Sequence
  derived and/or modified CDS sequence (opt1) from SEOV(ShuangyangRn470)__GU592925.1__GP
auguggagccuccucuuccuggccgcccuggugggccagggguucgcccucaagaacgucuucgacaugcgcauccagugcccccacuccgugaacuucggcgagaccagcguguccggguacaccgagcugccgccccugagccuccaggaguccgagcagcugguccccgagagcuccugcaacauggacaaccaccagagccuguccacgaucaacaagcucaccaaggugaucuggcggaagaaggccaaccaggagagcgccaaccagaacuccuucgagguggucgagagcgagguguccuucaagggccugugcaugcugaagcaccgcaugguggaggagagcuaccggaaccgccgguccgucaucugcuacgaccucgccugcaacagcaccuucugcaagcccaccguguacaugaucgugccgauccacgccugcaacaugaugaaguccugccugaucgggcugggccccuaccgcauccaggucguguacgagcggacguacugcaccaccggcauccucaccgaggggaagugcuucgugcccgacaaggcggucgugagcgcccugaagcgcggcauguacgccaucgccuccaucgagacgaucugcuucuucauccaccagaaggggaacaccuacaagaucgugaccgcgaucaccagcgccaugggcagcaagugcaacaacacggacaccaagguccagggguacuacaucugcaucaucggcggcaacuccgcccccguguacgccccggccggggaggacuuccgggcgauggagguguucagcggcaucaucaccagcccccacggggaggaccacgaccugcccggcgaggagaucgccaccuaccagaucagcggccagaucgaggccaagaucccccacacggucuccagcaagaaccucaagcugaccgccuucgccgggaucccguccuacagcuccaccagcauccuggcggccuccgaggacggccgcuucaucuucagccccgggcuguuccccaaccugaaccaguccgugugcaacaacaacgcccugccccucaucuggcggggccugaucgaccugaccggguacuacgaggccgugcacccgugcaacgucuucugcgugcucagcggccccggcgccuccugcgaggcguucagcgagggcgggaucuucaacaucacgucccccaugugccuggucagcaagcagaaccgcuuccgggccgccgagcagcagaucuccuucgugugccagcgcguggacauggacaucaucgucuacugcaacgggcagaagaagaccauccugaccaagacccucgugaucggccagugcaucuacacgaucaccagccuguucagccugcuccccgggguggcccacuccaucgccaucgagcugugcgucccgggcuuccacggcugggcgaccgccgcccugcucaucaccuucugcuucgggugggugcugauccccgccugcacgcuggcgauccuccuggugcugaaguucuucgccaacauccuccacaccagcaaccaggagaaccgguucaaggccauccugcgcaagaucaaggaggaguucgagaagaccaagggcuccauggucugcgagaucugcaaguacgagugcgagacccugaaggagcucaaggcccacaaccugagcugcgugcagggggagugccccuacugcuucacgcacugcgagcccaccgagaccgccauccaggcgcacuacaaggugugccaggccacccaccgguuccgcgaggaccugaagaagacggucaccccgcagaacaucggccccgggugcuaccggacccucaaccuguuccgcuacaagucccggugcuacauccugaccauguggacccugcuccugaucguggagagcauccugugggccgccuccgccgcggagaucccccucgugccccuguggacggacaacgcccacggcgucggcagcgugccgaugcacaccgaccuggagcucgacuucucccugcccagcuccagcaaguacaccuacaagcgccaccugaccaaccccgugaacgaccagcaguccgucagccuccacaucgagaucgagucccaggggaucggcgccgacgugcaccaccuggggcacugguacgacgcccgccugaaccucaagacgagcuuccacugcuacggcgccugcaccaaguaccaguacccguggcacaccgcgaagugccacuucgagaaggacuacgaguacgagaacuccugggccugcaacccgcccgacugccccggcguggggaccggcugcacggccugcgggcuguaccuggaccagcucaagcccgucggcaccgccuucaagaucaucagcgugcgguacagccgcaaggugugcguccaguucggggaggaguaccugugcaagaccaucgacaugaacgacugcuucgugacccggcacgcgaagaucugcaucaucggcacgguguccaaguucagccagggcgacacccuccucuuccuggggcccauggagggcgggggcaucaucuucaagcacuggugcaccuccacgugccacuucggggaccccggcgacgucaugggccccaaggacaagccguucaucugccccgaguuccccgggcaguuccgcaagaccugcaacuucgccaccacccccgugugcgaguacgacggcaacaucaucagcggguacaagaaggugcuggccaccaucgacuccuuccagagcuucaacacguccaacauccacuucaccgacgagcggaucgaguggcgcgacccggacggcaugcuccgggaccacaucaacaucgucaucagcaaggacaucgacuucgagaaccuggccgagaaccccugcaagguggggcugcaggccgcgaacaucgagggcgccuggggcuccggggugggcuucacccugaccugccaggucagccugacggagugccccaccuuccugaccuccaucaaggccugcgacauggccaucugcuacggggccgagagcgugacccucucccgcggccagaacacggugaagaucaccgggaagggcggccacagcggguccagcuucaagugcugccacggcaaggagugcuccagcaccgggcugcaggcguccgcgccccaccuggacaaggucaacggcaucagcgagcucgagaacgagaagguguacgacgacggcgccccggagugcggggugaccugcugguucaagaaguccggcgagugggucauggggaucaucaacggcaacuggguggugcugaucguccugugcgugcuccugcuguucucccucauccugcugagcauccucugccccgugcggaagcacaagaaguccuga

SEQ ID NO: 11863 - RNA, 3402 nt, Artificial Sequence
  derived and/or modified CDS sequence (opt1) from SEOV(WuhanMm13)__JQ665886.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgaggugaucgaguccgaggucagcuucaagggccugugcaugcucaagcaccgcaugguggaggaguccuaccggaaccgccggagcgugaucugcuacgaccuggccugcaacuccaccuucugcaagcccaccgucuacaugaucgugccgauccacgcgugcaacaugaugaaguccugccugaucgggcucggccccuaccgcauccagguggucuacgagcggacguacugcaccaccggcauccugaccgaggggaagugcuucgugcccgacaaggccguggucagcgcccugaagcgcggcauguacgccguggcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggucagcuccaagaaccugaagcugaccgccuucgcggggaucccgagcuacuccagcaccuccauccucgccgccagcgaggacggccgcuucaucuucucccccgggcuguuccccaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucacgagccccaugugccuggucuccaagcagaaccgcuuccgggccgccgagcagcagaucagcuucgugugccagcgcguggacauggacaucaucgucuacugcaacgggcagaagaagaccauccucaccaagacccuggugaucggccagugcaucuacacgaucaccucccuguucagccuccugcccgggguggcccacagcaucgcgaucgagcugugcgucccgggcuuccacggcugggccaccgccgcccuccugaccacguucugcuucgggugggugcugauccccgcgugcacccucgccauccugcuggugcucaaguucuucgccaacauccugcacaccuccaaccaggagaaccgguucaaggccauccugcgcaagaucaaggaggaguucgagaagaccaagggcagcauggucugcgagaucugcaaguacgagugcgagacgcucaaggagcugaaggcccacaaccuguccugcgugcagggggagugccccuacugcuucacccacugcgagcccaccgagaccgcgauccaggcccacuacaaggugugccaggccacgcaccgguuccgcgaggaccucaagaagaccgucaccccgcagaacaucggccccgggugcuaccggacccugaaccuguuccgcuacaagagccggugcuacauccugaccauguggacgauccuccugaucaucgaguccauccugugggccgccagcgcggccgagaucccccucgugccccuguggaccgacaacgcccacggcgugggcuccgucccgaugcacaccgaccuggagcucgacuucagccugcccuccagcuccaaguacaccuacaagcgccaccugacgaaccccgugaacgaccagcagagcgugucccuccacaucgagaucgagagccaggggaucggcgccgacguccaccaccuggggcacugguacgacgcccgccugaaccucaagaccuccuuccacugcuacggcgcgugcaccaaguaccaguacccguggcacaccgccaagugccacuucgagaaggacuacgaguacgagaacagcugggccugcaacccgcccgacugccccggcguggggacgggcugcaccgccugcgggcuguaccuggaccagcucaagcccgugggcaccgcguucaagaucaucuccguccgguacagccgcaaggugugcgugcaguucggggaggaguaccugugcaagaccaucgacaugaacgacugcuucgucacgcggcacgccaagaucugcaucaucggcaccgugagcaaguucucccagggcgacacccuccucuuccuggggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgucugcgaguacgacggcaacaucaucuccggguacaagaaggugcuggccaccaucgacagcuuccaguccuucaacacgagcaacauccacuucaccgacgagcggaucgaguggcgcgacccggacggcaugcuccgggaccacaucaacaucgugaucuccaaggacaucgacuucgagaaccuggccgagaaccccugcaaggucgggcugcaggcggccaacaucgagggcgccuggggcagcggggugggcuucacccugaccugccaggugucccugacggagugccccaccuuccugaccagcaucaaggccugcgacauggccaucugcuacggggcggaguccgucacccucagccgcggccagaacacggugaagaucaccgggaagggcggccacuccgggagcuccuucaagugcugccacggcaaggagugcagcuccaccgggcugcaggccagcgcgccccaccuggacaaggugaacggcaucuccgagcucgagaacgagaaggucuacgacgacggcgccccggagugcgggaucacgugcugguucaagaaguccggcgagugggugauggggaucaucaacggcaacugggugguccugaucgcccugugcgugcuccugcuguucagccucauccugcugagcauccucugccccgugcggaagcacaagaaguccuga

SEQ ID NO: 11864 - RNA, 3402 nt, Artificial Sequence
  derived and/or modified CDS sequence (opt1) from SEOV(WuhanMm24)__JQ665887.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgaggugauggaguccgaggucagcuucaagggccugugcaugcucaagcaccgcaugguggaggaguccuaccggaaccgccggagcgugaucugcuacgaccuggccugcaacuccaccuucugcaagcccaccgucuacaugaucgugccgauccacgcgugcaacaugaugaaguccugccugaucgggcucggccccuaccgcauccagguggucuacgagcggacguacugcaccaccggcauccugaccgaggggaagugcuucgugcccgacaaggccguggucagcgcccugaagcgcggcauguacgccaucgcgagcaucgagacgaucugcuucuucauccaccagaaggggaacaccuacaagaucgugaccgccaucaccuccgccaugggcagcaagugcaacaacacggacaccaaggugcagggguacuacaucugcaucaucggcggcaacagcgcccccgucuacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggugagcuccaagaaccugaagcugaccgccuucgcggggaucccgagcuacuccagcaccuccauccucgccgccagcgaggacggccgcuucaucuucucccccgggcuguuccccaaccugaaccagagcgucugcgacaacaacgcccucccccugaucuggcggggccugaucgaccucaccggguacuacgaggccgugcacccgugcaacguguucugcguccuguccggccccggcgcgagcugcgaggccuucuccgagggcgggaucuucaacaucacgagccccaugugccugguguccaagcagaaccgcuuccgggccgccgagcagcagaucagcuucgucugccagcgcguggacauggacaucaucguguacugcaacgggcagaagaagaccauccucaccaagacccuggucaucggccagugcaucuacacgaucaccucccuguucagccuccugcccgggguggcccacagcaucgcgaucgagcugugcgugccgggcuuccacggcugggccaccgccgcccuccugaucaccuucugcuucggguggguccugauccccgcgugcacgcucgccauccugcuggugcucaaguucuucgccaacauccugcacaccuccaaccaggagaaccgguucaaggccauccugcgcaagaucaaggaggaguucgagaagaccaagggcagcauggugugcgagaucugcaaguacgagugcgagacccucaaggagcugaaggcccacaaccuguccugcguccagggggagugccccuacugcuucacgcacugcgagcccaccgagaccgcgauccaggcccacuacaaggugugccaggccacccaccgguuccgcgaggaccucaagaagacggugaccccgcagaacaucggccccgggugcuaccggacccugaaccuguuccgcuacaagagccggugcuacauccugaccauguggacccuccugcugaucaucgaguccauccucugggccgccagcgcggccgagaucccccuggucccccuguggacggacaacgcccacggcgugggcuccgugccgaugcacaccgaccucgagcuggacuucagccugcccuccagcucccgcuacaccuacaagcgccaccucaccaaccccgucaacgaccagcagagcgugucccugcacaucgagaucgagagccaggggaucggcgccgacgugcaccaccuggggcacugguacgacgcccggcucaaccugaagacguccuuccacugcuacggcgcgugcaccaaguaccaguacccguggcacaccgccaagugccacuucgagaaggacuacgaguacgagaacagcugggccugcaacccgcccgacugccccggcgucgggaccggcugcacggccugcgggcuguaccucgaccagcugaagcccgugggcaccgcguucaagaucaucuccgugcgcuacagccggaaggucugcgugcaguucggggaggaguaccugugcaagaccaucgacaugaacgacugcuucgugacccgccacgccaagaucugcaucaucggcacggucagcaaguucucccagggcgacacccuccuguuccuggggcccauggagggcgggggcaucaucuucaagcacuggugcaccagcacgugccacuucggggaccccggcgacgugaugggccccaaggacaagccguucaucugccccgaguuccccgggcaguuccggaagaagugcaacuucgccaccucccccgugugcgaguacgacggcaacaucaucagcggguacaagaagguccucgccaccaucgacuccuuccagagcuucaacaccuccaacauccacuucaccgacgagcgcaucgaguggcgggacccggacggcaugcugcgcgaccacaucaacaucgugaucagcaaggacaucgacuucgagaaccuggccgagaaccccugcaagguggggcuccaggcggccaacaucgagggcgccuggggcuccggggucggcuucacgcugaccugccaggugagccugaccgagugccccaccuuccucacguccaucaaggccugcgacauggccaucugcuacggggcggagagcgugacccugucccggggccagaacaccgucaagaucaccgggaagggcggccacagcggguccagcuucaagugcugccacggcaaggagugcucccugacggggcuccaggccagcgcgccccaccuggacaaggugaacggcaucuccgagcuggagaacgagaagguguacgacgacggcgccccggagugcgggaucacgugcugguucaagaaguccggcgagugggucauggggaucaucaacggcaacuggguggugcucaucgcccugugcguccugcuccuguucagccugauccuccugagcauccugugccccgugcgcaagcacaagaaguccuga

SEQ ID NO: 11865 - RNA, 3402 nt, Artificial Sequence
  derived and/or modified CDS sequence (opt1) from SEOV(WuhanRf02)__JQ665888.1__GP
auguggagccugcuccugcuggccgcccucgugggccagggguucgcgcugaagaacgucuucgacaugcgcauccagugcccccacuccgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgaggugaucgaguccgaggucagcuucaagggccugugcaugcucaagcaccgcaugguggaggaguccuaccggaaccgccggagcgugaucugcuacgaccuggccugcaacuccaccuucugcaagcccaccgucuacaugaucgugccgauccacgcgugcaacaugaugaaguccugccugaucgggcucggccccuaccgcauccagguggucuacgagcggacguacugcaccaccggcauccugaccgaggggaagugcuucgugcccgacaaggccguggucagcgcccugaagcgcggcauguacgccguggcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggucagcuccaagaaccugaagcugaccgccuucgcggggaucccgagcuacuccagcaccuccauccucgccgccagcgaggacggccgcuucaucuucucccccgggcuguuccccaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucacgagccccaugugccuggucuccaagcagaaccgcuuccgggccgccgagcagcgcaucagcuucgugugccagcggguggacauggacaucaucgucuacugcaacgggcagaagaagaccauccucaccaagacccuggugaucggccagugcaucuacacgaucaccucccuguucagccuccugcccgggguggcccacagcaucgcgaucgagcugugcgucccgggcuuccacggcugggccaccgccgcccuccugaccacguucugcuucgggugggugcugauccccgcgugcacccucgccauccugcuggugcucaaguucuucgccaacauccugcacaccuccaaccaggagaaccgcuucaaggccauccugcggaagaucaaggaggaguucgagaagaccaagggcagcgucgugugcgagaucugcaaguacgagugcgagacgcucaaggagcugaaggcccacaaccuguccugcgugcagggggagugccccuacugcuucacccacugcgagcccaccgagaccgcgauccaggcccacuacaaggucugccaggccacgcaccgcuuccgggaggaccucaagaagaccgugaccccgcagaacaucggccccgggugcuaccgcacccugaaccuguuccgguacaacagccgccccgacggccugaccauguggacgcuccugcugaucaucgaguccauccucugggccgccagcgcggccgagaucccccuggugccgcugugggccgacaacgcccacggcgucggguccgugcccaugcacaccgaccucgagcuggacuucagccugcccuccagcuccaaguacaccuacaagcgccaccucaccaacccggugaacgaccagcagagcgucucccugcacaucgagaucgagagccagggcaucggggccgacgugcaccaccugggccacugguacgacgcgcggcucaaccugaagacguccuuccacugcuacggcgccugcaccaaguaccaguaccccuggcacaccgccaagugccacuucgagaaggacuacgaguacgagaacagcugggccugcaacccgcccgacugccccggggugggcaccgggugcacggcgugcggccuguaccucgaccagcugaagcccgucgggaccgccuucaagaucaucuccgugcgcuacagccggaaggugugcguccaguucggcgaggaguaccugugcaagaccaucgacaugaacgacugcuucgugacccgccacgccaagaucugcaucaucggcacggugcccaaguucagccagggggacacccuccuguuccugggccccauggagggcggcgggaucaucuucaagcacuggugcaccuccacgugccacuucggggacccgggcgacgucauggggcccaaggacaagcccuucauccggcccgaguucccgggccaguuccgcaagaagugcaacuucgccaccacccccgugugcggguacgacggcaacaucaucagcggguacaagaaggugcucgccaccaucgacuccuuccagagcuucaacaccuccaacauccacuucacggacgagcggaucgaguggcgcgaccccgacggcaugcugcgggaccacaucaacaucgucaucagcaaggacaucgacuucgagaaccuggcggagaaccccugcaaggugggccuccaggccgccaacaucgagggggccuggggcuccggggugggcuucacccugaccugccaggucagccugaccgagugcccgacguuccucaccuccaucaaggccugcgacauggcgaucugcuacggggccgagagcgugacccugucccgcggccagaacaccgugaagaucacgggcaagggcgggcacagcggguccagcuucaagugcugccacggcaaggagugcuccagcaccggccugcaggccuccgcgccccaccucgacaaggucaacgggaucagcgagcuggagaacgagaagguguacgacgacggcgcccccgagugcgggaucacgugcugguucaagaaguccggcgagugggugauggggaucaucaacggcaacugggucgugcugaucgcccucugcgugcugcuccuguucagccugauccugcucagcauccugugccccguccggaagcacaagaaguccuga

SEQ ID NO: 11866 - RNA, 3402 nt, Artificial Sequence
  derived and/or modified CDS sequence (opt1) from SEOV(WuhanRf07)__JQ665889.1__GP
auguggagccugcuccugcuggccgcccucgugggccagggguucgcgcugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgaggugaucgaguccgaggucagcuucaagggccugugcaugcucaagcaccgcaugguggaggaguccuaccggaaccgccggagcgugaucugcuacgaccuggccugcaacuccaccuucugcaagcccaccgucuacaugaucgugccgauccacgcgugcaacaugaugaaguccugccugaucgggcucggccccuaccgcauccagguggucuacgagcggacguacugcaccaccggcauccugaccgaggggaagugcuucgugcccgacaaggccguggucagcgcccugaagcgcggcauguacgccguggcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggucagcuccaagaaccugaagcugaccgccuucgcggggaucccgagcuacuccagcaccuccauccucgccgccagcgaggacggccgcuucaucuucucccccgggcuguuccccaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucacgagccccaugugccuggucuccaagcagaaccgcuuccgggccgccgagcagcagaucagcuucgugugccagcgcguggacauggacaucaucgucuacugcaacgggcagaagaagaccauccucaccaagacccuggugaucggccagugcaucuacacgaucaccucccuguucagccuccugcccgggguggcccacagcaucgcgaucgagcugugcgucccgggcuuccacggcugggccaccgccgcccuccugaccacguucugcuucgggugggugcugauccccgcgugcacccucgccauccugcuggugcucaaguucuucgccaacauccugcacaccuccaaccaggagaaccgguucaaggccauccugcgcaagaucaaggaggaguucgagaagaccaagggcagcauggucugcgagaucugcaaguacgagugcgagacgcucaaggagcugaaggcccacaaccuguccugcgugcagggggagugccccuacugcuucacccacugcgagcccaccgagaccgcgauccaggcccacuacaaggugugccaggccacgcaccgguuccgcgaggaccucaagaagaccgucaccccgcagaacaucggccccgggugcuaccggacccugaaccuguuccgcuacaagagccggcccuacauccugaccauguggacgauccuccugaucaucgaguccauccugugggccgccagcgcggccgagaucccccucgugccgcuguggaccgacaacgcccacggcgugggcuccguccccaugcacaccgaccuggagcucgacuucagccugcccuccagcuccaaguacaccuacaagcgccaccugacgaacccggugaacgaccagcagagcgugucccuccacaucgagaucgagagccaggggaucggcgccgacguccaccaccuggggcacugguacgacgcccgccugaaccucaagaccuccuuccacugcuacggcgcgugcaccaaguaccaguaccccuggcacaccgccaagugccacuucgagaaggacuacgaguacgagaacagcugggccugcaacccgcccgacugccccggcguggggacgggcugcaccgccugcgggcuguaccuggaccagcucaagcccgugggcaccgcguucaagaucaucuccguccgguacagccgcaaggugugcgugcaguucggggaggaguaccugugcaagaccaucgacaugaacgacugcuucgucacgcggcacgccaagaucugcaucaucggcaccgugagcaaguucucccagggcgacacccuccucuuccuggggcccauggagggcgggggcaucaucuucaagcacuggugcaccagcacgugccacuucggggaccccggcgacgugaugggcccgaaggacaagcccuucaucugccccgaguuccccgggcaguuccgcaagaagugcaacuucgccaccaccccggucugcgaguacgacggcaacaucaucuccggguacaagaaggugcuggccaccaucgacagcuuccaguccuucaacacgagcaacauccacuucaccgacgagcggaucgaguggcgcgaccccgacggcaugcuccgggaccacaucaacaucgugaucuccaaggacaucgacuucgagaaccuggccgagaaccccugcaaggucgggcugcaggcggccaacaucgagggcgccuggggcagcggggugggcuucacccugaccugccaggugucccugacggagugccccaccuuccugaccagcaucaaggccugcgacauggccaucugcuacggggcggaguccgucacccucagccgcggccagaacacggugaagaucaccgggaagggcggccacuccgggagcuccuucaagugcugccacggcaaggagugcagcuccaccgggcugcaggccagcgccccgcaccuggacaaggugaacggcaucuccgagcucgagaacgagaaggucuacgacgacggcgcccccgagugcgggaucacgugcugguucaagaaguccggcgagugggugauggggaucaucaacggcaacugggugguccugaucgcccugugcgugcuccugcuguucagccucauccugcugagcauccucugccccgugcggaagcacaagaaguccuga

SEQ ID NO: 11867 - RNA, 3402 nt, Artificial Sequence
  derived and/or modified CDS sequence (opt1) from SEOV(WuhanRf18)__JQ665893.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgaggugaucgaguccgaggucagcuucaagggccugugcaugcucaagcaccgcaugguggaggaguccuaccggaaccgccggagcgugaucugcuacgaccuggccugcaacuccaccuucugcaagcccaccgucuacaugaucgugccgauccacgcgugcaacaugaugaaguccugccugaucgggcucggccccuaccgcauccagguggucuacgagcggacguacugcaccaccggcauccugaccgaggggaagugcuucgugcccgacaaggccguggucagcgcccugaagcgcggcauguacgccguggcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggucagcuccaagaaccugaagcugaccgccuucgcggggaucccgagcuacuccagcaccuccauccucgccgccagcgaggacggccgcuucaucuucucccccgggcuguuccccaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucacgagccccaugugccuggucuccaagcagaaccgcuuccgggccgccgagcagcgcaucagcuucgugugccagcggguggacauggacaucaucgucuacugcaacgggcagaagaagaccauccucaccaagacccuggugaucggccagugcaucuacacgaucaccucccuguucagccuccugcccgggguggcccacagcaucgcgaucgagcugugcgucccgggcuuccacggcugggccaccgccgcccuccugaccacguucugcuucgggugggugcugauccccgcgugcacccucgccauccugcuggugcucaaguucuucgccaacauccugcacaccuccaaccaggagaaccgcuucaaggccauccugcggaagaucaaggaggaguucgagaagaccaagggcagcauggucugcgagaucugcaaguacgagugcgagacgcucaaggagcugaaggcccacaaccuguccugcgugcagggggagugccccuacugcuucacccacugcgagcccaccgagaccgcgauccaggcccacuacaaggugugccaggccacgcaccgcuuccgggaggaccucaagaagaccgucaccccgcagaacaucggccccgggugcuaccgcacccugaaccuguuccgguacaagagccgcugcuacauccugaccauguggacgauccuccugaucaucgaguccauccugugggccgccagcgcggccgagaucccccucgugccccuguggaccgacaacgcccacggcgugggcuccgucccgaugcacaccgaccuggagcucgacuucagccugcccuccagcuccaaguacaccuacaagcgccaccugacgaaccccgugaacgaccagcagagcgugucccuccacaucgagaucgagagccaggggaucggcgccgacguccaccaccuggggcacugguacgacgcccggcugaaccucaagaccuccuuccacugcuacggcgcgugcaccaaguaccaguacccguggcacaccgccaagugccacuucgagaaggacuacgaguacgagaacagcugggccugcaacccgcccgacugccccggcguggggacgggcugcaccgccugcgggcuguaccuggaccagcucaagcccgugggcaccgcguucaagaucaucuccguccgcuacagccggaaggugugcgugcaguucggggaggaguaccugugcaagaccaucgacaugaacgacugcuucgucacgcgccacgccaagaucugcaucaucggcaccgugagcaaguucucccagggcgacacccuccucuuccuggggcccauggagggcgggggcaucaucuucaagcacuggugcaccagcacgugccacuucggggaccccggcgacgugaugggccccaaggacaagccguucaucugccccgaguuccccgggcaguuccggaagaagugcaacuucgccaccacccccgucugcgaguacgacggcaacaucaucuccggguacaagaaggugcuggccaccaucgacagcuuccaguccuucaacacgagcaacauccacuucaccgacgagcgcaucgaguggcgggacccggacggcaugcuccgcgaccacaucaacaucgugaucuccaaggacaucgacuucgagaaccuggccgagaaccccugcaaggucgggcugcaggcggccaacaucgagggcgccuggggcagcggggugggcuucacccugaccugccaggugucccugacggagugccccaccuuccugaccagcaucaaggccugcgacauggccaucugcuacggggcggaguccgucacccucagccggggccagaacacggugaagaucaccgggaagggcggccacuccgggagcuccuucaagugcugccacggcaaggagugcagcuccaccgggcugcaggccagcgcgccccaccuggacaaggugaacggcaucuccgagcucgagaacgagaaggucuacgacgacggcgccccggagugcgggaucacgugcugguucaagaaguccggcgagugggugauggggaucaucaacggcaacugggugguccugaucgcccugugcgugcuccugcuguucagccucauccugcugagcauccucugccccgugcgcaagcacaagaaguccuga

SEQ ID NO: 11868 - RNA, 3402 nt, Artificial Sequence
  derived and/or modified CDS sequence (opt1) from SEOV(WuhanRn10)__JQ665896.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgaggugaucgaguccgaggucagcuucaagggccugugcaugcucaagcaccgcaugguggaggaguccuaccggaaccgccggagcgugaucugcuacgaccuggccugcaacuccaccuucugcaagcccaccgucuacaugaucgugccgauccacgcgugcaacaugaugaaguccugccugaucgggcucggccccuaccgcauccagguggucuacgagcggacguacugcaccaccggcauccugaccgaggggaagugcuucgugcccgacaaggccguggucagcgcccugaagcgcggcauguacgccguggcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggucagcuccaagaaccugaagcugaccgccuucgcggggaucccgagcuacuccagcaccuccauccucgccgccagcgaggacggccgcuucaucuucucccccgggcuguuccccaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucacgagccccaugugccuggucuccaagcagaaccgcuuccgggccgccgagcagcagaucagcuucgugugccagcgcguggacauggacaucaucgucuacugcaacgggcagaagaagaccauccucaccaagacccuggugaucggccagugcaucuacacgaucaccucccuguucagccuccugcccgggguggcccacagcaucgcgaucgagcugugcgucccgggcuuccacggcugggccaccgccgcccuccugaccacguucugcuucgggugggugcugauccccgcgugcacccucgccauccugcuggugcucaaguucuucgccaacauccugcacaccuccaaccaggagaaccgguucaaggccauccugcgcaagaucaaggaggaguucgagaagaacaagggcagcgucgugugcgagaucugcaaguacgagugcgagacccucaaggagcugaaggcccacaaccuguccugcgugcagggggagugccccuacugcuucacgcacugcgagcccaccgagaccgcgauccaggcccacuacaaggucugccaggccacccaccgguuccgcgaggaccucaagaagacggugaccccgcagaacaucggccccgggugcuaccggacccugaaccuguuccgcuacaagagccggugcuacauccugaccauguggaccauccuccugaucaucgaguccauccugugggccgccagcgcggccgagaucccccucgugccccuguggacggacaacgcccacggcgucggcuccgugccgaugcacaccgaccuggagcucgacuucagccugcccuccagcuccaaguacaccuacaagcgccaccugaccaaccccgugaacgaccagcagagcgucucccuccacaucgagaucgagagccaggggaucggcgccgacgugcaccaccuggggcacugguacgacgcccgccugaaccucaagacguccuuccacugcuacggcgcgugcaccaaguaccaguacccguggcacaccgccaagugccacuucgagaaggacuacgaguacgagaacagcugggccugcaacccgcccgacugccccggcguggggaccggcugcacggccugcgggcuguaccuggaccagcucaagcccgucggcaccgcguucaagaucaucuccgugcgguacagccgcaaggugugcguccaguucggggaggaguaccugugcaagaccaucgacaugaacgacugcuucgugacccggcacgccaagaucugcaucaucggcacggugagcaaguucucccagggcgacacccuccucuuccuggggcccauggagggcgggggcaucaucuucaagcacuggugcaccagcacgugccacuucggggaccccggcgacgucaugggccccaaggacaagccguucaucugccccgaguuccccgggcaguuccgcaagaagugcaacuucgccaccacccccgugugcgaguacgacggcaacaucaucuccggguacaagaaggugcuggccaccaucgacagcuuccaguccuucaacaccagcaacauccacuucacggacgagcggaucgaguggcgcgacccggacggcaugcuccgggaccacaucaacaucgucaucuccaaggacaucgacuucgagaaccuggccgagaaccccugcaagguggggcugcaggcggccaacaucgagggcgccuggggcagcggggugggcuucacccugaccugccaggucucccugaccgagugccccacguuccugaccagcaucaaggccugcgacauggccaucugcuacggggcggaguccgugacccucagccgcggccagaacaccgugaagaucacggggaagggcggccacuccgggagcuccuucaagugcugccacggcaaggagugcagcuccaccgggcugcaggccagcgcgccccaccuggacaaggucaacggcaucuccgagcucgagaacgagaagguguacgacgacggcgccccggagugcgggaucacgugcugguucaagaaguccggcgagugggugauggggaucaucaacggcaacugggucgugcugaucgcccugugcgugcuccugcuguucagccucauccugcugagcauccucugccccguccggaagcacaagaaguccuga

SEQ ID NO: 11869 - RNA, 3402 nt, Artificial Sequence
  derived and/or modified CDS sequence (opt1) from SEOV(WuhanRn25)__JQ665897.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgaggugaucgaguccgaggucagcuucaagggccugugcaugcucaagcaccgcaugguggaggaguccuaccggaaccgccggagcgugaucugcuacgaccuggccugcaacuccaccuucugcaagcccaccgucuacaugaucgugccgauccacgcgugcaacaugaugaaguccugccugaucgggcucggccccuaccgcauccagguggucuacgagcggacguacugcaccaccggcauccugaccgaggggaagugcuucgugcccgacaaggccguggucagcgcccugaagcgcggcauguacgccguggcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggucagcuccaagaaccugaagcugaccgccuucgcggggaucccgagcuacuccagcaccuccauccucgccgccagcgaggacggccgcuucaucuucucccccgggcuguuccccaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucacgagccccaugugccuggucuccaagcagaaccgcuuccgggccgccgagcagcagaucagcuucgugugccagcgcguggacauggacaucaucgucuacugcaacgggcagaagaagaccauccucaccaagacccuggugaucggccagugcaucuacacgaucaccucccuguucagccuccugcccgggguggcccacagcaucgcgaucgagcugugcgucccgggcuuccacggcugggccaccgccgcccuccugaccacguucugcuucgggugggugcugauccccgcgugcacccucgccauccugcuggugcucaaguucuucgccaacauccugcacaccuccaaccaggagaaccgguucaaggccauccugcgcaagaucaaggaggaguucgagaagaacaagggcagcauggucugcgagaucugcaaguacgagugcgagacccucaaggagcugaaggcccacaaccuguccugcgugcagggggagugccccuacugcuucacgcacugcgagcccaccgagaccgcgauccaggcccacuacaaggugugccaggccacccaccgguuccgcgaggaccucaagaagacggucaccccgcagaacaucggccccgggugcuaccggacccugaaccuguuccgcuacaagagccggugcuacauccugaccauguggaccauccuccugaucaucgaguccauccugugggccgccagcgcggccgagaucccccucgugccccuguggacggacaacgcccacggcgugggcuccgucccgaugcacaccgaccuggagcucgacuucagccugcccuccagcuccaaguacaccuacaagcgccaccugaccaaccccgugaacgaccagcagagcgugucccuccacaucgagaucgagagccaggggaucggcgccgacguccaccaccuggggcacugguacgacgcccgccugaaccucaagacguccuuccacugcuacggcgcgugcaccaaguaccaguacccguggcacaccgccaagugccacuucgagaaggacuacgaguacgagaacagcugggccugcaacccgcccgacugccccggcguggggaccggcugcacggccugcgggcuguaccuggaccagcucaagcccgugggcaccgcguucaagaucaucuccguccgguacagccgcaaggugugcgugcaguucggggaggaguaccugugcaagaccaucgacaugaacgacugcuucgucacccggcacgccaagaucugcaucaucggcacggugagcaaguucucccagggcgacacccuccucuuccuggggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgucugcgaguacgacggcaacaucaucuccggguacaagaaggugcuggccaccaucgacagcuuccaguccuucaacaccagcaacauccacuucacggacgagcggaucgaguggcgcgacccggacggcaugcuccgggaccacaucaacaucgugaucuccaaggacaucgacuucgagaaccuggccgagaaccccugcaaggucgggcugcaggcggccaacaucgagggcgccuggggcagcggggugggcuucacccugaccugccaggugucccugaccgagugccccacguuccugaccagcaucaaggccugcgacauggccaucugcuacggggcggaguccgucacccucagccgcggccagaacaccgugaagaucacggggaagggcggccacuccgggagcuccuucaagugcugccacggcaaggagugcagcuccaccgggcugcaggccagcgcgccccaccuggacaaggugaacggcaucuccgagcucgagaacgagaaggucuacgacgacggcgccccggagugcgggaucacgugcugguucaagaaguccggcgagugggugauggggaucaucaacggcaacugggugguccugaucgcccugugcgugcuccugcuguucagccucauccugcugagcauccucugccccgugcggaagcacaagaaguccuga

SEQ ID NO: 11870 - RNA, 3402 nt, Artificial Sequence
  derived and/or modified CDS sequence (opt1) from SEOV(XiaotangshanRn7)__GU592929.1__GP
auguggagccuccucuuccuggccgcccuggugggccagggguucgcccucaagaacgucuucgacaugcgcauccagugcccccacagcgugaacuucggcgagaccagcguguccggguacaccgagcugccgccccugagccuccaggaggccgagcagcugguccccgaguccagcugcaacauggacaaccaccagucccugagcacgaucaacaagcucaccaaggugaucuggcggcgcaaggccaaccaggaguccgccaaccagaacagcuucgagguggucgaguccgaggugagcuucaagggccugugcaugcugaagcaccggaugguggaggaguccuaccgcaaccggcgcagcgucaucugcuacgaccucgccugcaacuccaccuucugcaagcccaccguguacaugaucgugccgauccacgcgugcaacaugaugaaguccugccugaucgggcugggccccuaccggauccaggucguguacgagcgcacguacugcaccaccggcauccucaccgaggggaagugcuucgugcccgacaaggccgucgugagcgcccugaagcggggcauguacgccaucgcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgcgccauggagguguucuccggcaucaucaccagcccccacggggaggaccacgaccugcccggcgaggagaucgccaccuaccagaucuccggccagaucgaggccaagaucccccacacggucagcuccaagaaccucaagcugaccgccuucgcggggaucccgagcuacuccagcaccuccauccuggccgccagcgaggacggccgguucaucuucucccccgggcuguuccccaaccugaaccagagcgugugcgacaacaacgcccugccccucaucuggcgcggccugaucgaccugaccggguacuacgaggccgugcacccgugcaacgucuucugcgugcucuccggccccggcgcgagcugcgaggccuucuccgagggcgggaucuucaacaucacgagccccaugugccuggucuccaagcagaaccgguuccgcgccgccgagcagcagaucagcuucgugugccagcggguggacauggacaucaucgucuacugcaacgggcagaagaagaccauccugaccaagacccucgugaucggccagugcaucuacacgaucaccucccuguucagccugcuccccgggguggcccacagcaucgcgaucgagcugugcgucccgggcuuccacggcugggccaccgccgcccugcucaucaccuucugcuucgggugggugcugauccccgcgugcacgcuggccauccuccuggugcugaaguucuucgccaacauccuccacaccuccaaccaggagaaccgcuucaaggccauccugcggaagaucaaggaggaguucgagaagaccaagggcagcauggucugcgagaucugcaaguacgagugcgagacccugaaggagcucaaggcccacaaccuguccugcgugcagggggagugccccuacugcuucacgcacugcgagcccaccgagaccgcgauccaggcccacuacaaggugugccaggccacccaccgcuuccgggaggaccugaagaagacggucaccccgcagaacaucggccccgggugcuaccgcacccucaaccuguuccgguacaagagccgcugcuacauccugaccauguggacccugcuccugaucaucgaguccauccugugggccgccagcgcggccgagaucccccucgugccccuguggacggacaacgcccacggcgugggcuccgucccgaugcacaccgaccuggagcucgacuucagccugcccuccagcuccaaguacaccuacaagcgccaccugaccaaccccgugaacgaccagcagagcgugucccuccacaucgagaucgagagccaggggaucggcgccgacguccaccaccuggggcacugguacgacgcccggcugaaccucaagacguccuuccacugcuacggcgcgugcaccaaguaccaguacccguggcacaccgccaagugccacuucgagaaggacuacgaguacgagaacagcugggccugcaacccgcccgacugccccggcguggggaccggcugcacggccugcgggcuguaccuggaccagcucaagcccgugggcaccgcguucaagaucaucuccguccgcuacagccggaaggugugcgugcaguucggggaggaguaccugugcaagaccaucgacaugaacgacugcuucgucacccgccacgccaagaucugcaucaucggcacggugagcaaguucucccagggcgacacccuccucuuccuggggcccauggagggcgggggcaucaucuucaagcacuggugcaccagcacgugccacuucggggaccccggcgacgugaugggccccaaggacaagccguucaucugccccgaguuccccgggcaguuccggaagaagugcaacuucgccaccacccccgucugcgaguacgacggcaacaucaucuccggguacaagaaggugcuggccaccaucgacagcuuccaguccuucaacaccagcaacauccacuucacggacgagcgcaucgaguggcgggacccggacggcaugcuccgcgaccacaucaacaucgugaucuccaaggacaucgacuucgagaaccuggccgagaaccccugcaaggucgggcugcaggcggccaacaucgagggcgccuggggcagcggggugggcuucacccugaccugccaggugucccugaccgagugccccacguuccugaccagcaucaaggccugcgacauggccaucugcuacggggcggaguccgucacccucagccggggccagaacaccgugaagaucacggggaagggcggccacuccgggagcuccuucaagugcugccacggcaaggagugcagcuccaccgggcugcaggccagcgcgccccaccuggacaaggugaacggcaucuccgagcucgagaacgagaaggucuacgacgacggcgccccggagugcggggugaccugcugguucaagaaguccggcgagugggugauggggaucaucaacggcaacugggucgugcugaucgugcugugcguccuccugcuguucagccucauccugcugagcauccucugccccgugcgcaagcacaagaaguccuga

SEQ ID NO: 11871 - RNA, 3402 nt, Artificial Sequence
  derived and/or modified CDS sequence (opt1) from SEOV(YongjiaRf45)__GU592926.1__GP
auguggggccugcuccugcuggccgccaugguggggcagggcagcgcccucaagaacgucuucgacaugaagauccagugcccccacuccgugaacuucggggagaccagcguguccggcuacaccgagcugccgccccugccccuccaggaggccgagcagcugguccccgagagcuccugcaacauggacaaccaccagagccuguccaccaucaacaagcucaccaaggugaucuggcgcaagaaggccaaccaggagagcgccucccagaacagcuucgagguggucgaguccgaggugagcuucaaggggcugugcaugcugaagcaccggaugguggaggaguccuaccgcaaccggcgcagcgucaucugcuacgaccucgccugcaacaccaccuucugcaagccgacgguguacaugaucgugcccauccacgcgugcaacaugaugaaguccugccugaucggccugggccccuaccggauccaggucaucuacgagcgcaccuacugcagcaccgggauccucaccgagggcaagugcuucgugcacgacaagacgguggucuccgcccugaagcgggggauguacgccaucgccagcaucgagaccgugugcuucuucgugcaccagaagggcaacaccuacaagaucgucaccgcgaucacguccgccauggggagcaagugcaacaacaccgacagcaaggugcagggcuacuacaucugcaucaucggcgggaacuccgcccccguguacgccccggccggcgaggacuuccgcgcgauggaggucuucagcgggaucaucaccagcccccacggcgaggaccacgaccugcccggcgaggagguggccaccuaccagaucagcgggcagaucgaggccaagaucccccacacgguguccagcaagaaccucaagcugaccgccuucgccggcaucccguccuacagcuccaccagccugcucgcggccuccgaggacgggcgguucaucuucagccccggccuguuccccaaccugaaccaguccgucugcgacaacaacgcccucccccugaucuggcgcgggcugaucgaccucaccggcuacuacgaggccgugcacccgugcaacgucuucugcgugcugagcggccccggggccuccugcgaggcguucagcgagggcgggaucuucaacaucacgucccccaugugccuggugagcaagcagaaccgguuccgcgccgccgagcagcagaucuccuucaucugccagcgggucgacauggacaucaucguguacugcaacggccagaagaagaccauccucaccaagacccuggugaucgggcagugcaucuacacgaucaccagccuguucagccuccugcccggcgucgcccacuccaucgccaucgagcugugcgugccgggcuuccacgggugggcgaccgccgcccuccugaucaccuucugcuucggcugggugcugauccccgccugcacgcucgcgguccugcuguuccucaaguucuucgccaacauccugcacaccagcaaccaggagaaccgcuucaaggccauccugcggaagaucaaggaggaguucgagaagaccaagggguccauggugugcgagaucugcaaguacgagugcgagacccucaaggagcugaaggcccacaaccugagcugcgugcagggcgagugccccuacugcuucacgcacugcgagcccaccgagaccgccauccaggcgcacuacaaggucugccaggccacccaccgcuuccgggaggaccucaagaagacggugaccccgcagaacaucgggcccggcugcuaccgcacccugaaccuguuccgguacaagucccgcugcuacauccugaccauguggauccuccugcuggugaucgagagcauccucugggccgccuccgccgcggagaucccccuggucccccuguggaccgacaacgcccacggcguggggagcgugccgaugcacacggaccucgagcuggacuucucccugcccagcuccagcaaguacaccuacaagcggcaccucaccaaccccgucaacgaccagcaguccgugagccugcacaucgagaucgagucccagggcaucggggccgacgugcaccaccugggccacugguacgacgcccgccucaaccugaagaccagcuuccacugcuacggcgccugcacgaaguaccaguacccguggcacaccgcgaagugcuacuucgagaaggacuacgaguacgagaacuccugggccugcaacccgcccgacugccccggggucggcaucgggugcaccgccugcggccuguaccucgaccagcugaagcccguggggaccgccuucaagaucaucagcgugcgcuacagccggaaggucugcgugcaguucggcgaggaguaccugugcaagacgaucgacaugaacgacugcuucgugacccgccacgcgaagaucugcaucaucggcaccgucuccaaguucagccagggggacacccuccuguuccugggccccauggagggcggcgggaucaucuucaagcacuggugcacguccacgugccacuucggggaccccggcgacgugauggggcccaaggacaagccguucaucugccccgaguuccccggccaguuccggaagaagugcaacuucgccaccacccccgugugcgaguacgacgggaacgucuucagcggcuaccgcaaguuccucgccaccaucgacuccuuccagagcuucaacaccuccaacgugcacuucaccgacgagcggaucgaguggcgcgacccggacgggaugcugcgggaccacaucaacaucgugaucagcaaggacaucgacuucgagaaccuggccgacaaccccugcaaggucggccuccaggccgcgaacaucgagggcgccuggggguccggcgugggguucacccugacgugccaggugagccugaccgagugccccaccuuccucaccuccaucaaggccugcgacauggccaucugcuacggcgccgagagcgucacgcugucccgcgggcagaacaccgugaagaucaccggcaagggcgggcacagcggcuccagcuucaagugcugccacgggaaggagugcuccagcaacggccugcaggcguccgcgccccaccucgacaaggugaacggcaucagcgagcuggagaacgagaaggucuacgacgacggggccccggagugcggcaucacgugcugguucaagaaguccggggagugggugaugggcaucaucaacgggaacuggaucgugcugaucguccucugcgugcugcuccuguucucccugauccugcucagcauccugugccccgugcggaagcacaagaaguccuga

SEQ ID NO: 11872 - RNA, 3402 nt, Artificial Sequence
  derived and/or modified CDS sequence (opt1) from SEOV(YongjiaRn14)__GU592927.1__GP
auguggggccugcuccugcuggccgccaugguggggcagggcagcgcgcucaagaacgucuucgacaugaagauccagugcccccacagcgugaacuucggggagaccagcguguccggcuacaccgagcugccgccccugccccuccaggaggccgagcagcugguccccgagagcuccugcaacauggacaaccaccagagccuguccacgaucaacaagcucaccaaggugaucuggcgcaagaaggccaaccaggagagcgccucccagaacagcuucgagguggucgaguccgaggugagcuucaaggggcugugcaugcugaagcaccggaugguggaggaguccuaccgcaaccggcgcagcgucaucugcuacgaccucgccugcaacaccaccuucugcaagccgacgguguacaugaucgugcccauccacgcgugcaacaugaugaaguccugccugaucggccugggccccuaccggauccaggucaucuacgagcgcaccuacugcaccaccgggauccucacggagggcaagugcuucgugcccgacaaggccguggucagcgcccugaagcgggggauguacgccaucgcguccaucgagaccgugugcuucuucgugcaccagaagggcaacaccuacaagaucgucaccgccaucacgagcgccaugggguccaagugcaacaacaccgacagcaaggugcagggcuacuacaucugcaucaucggcgggaacagcgccccgguguacgcccccgcgggcgaggacuuccgcgccauggaggucuucuccgggaucaucaccagcccccacggcgaggaccacgaccugcccggcgaggagguggccaccuaccagaucuccgggcagaucgaggccaagaucccgcacacggugagcuccaagaaccucaagcugaccgccuucgcgggcauccccagcuacuccagcaccucccugcucgccgccagcgaggacgggcgguucaucuucucccccggccuguuccccaaccugaaccagagcgucugcgacaacaacgcccucccgcugaucuggcgcgggcugaucgaccucaccggcuacuacgaggccgugcaccccugcaacgucuucugcgugcuguccggccccggggcgagcugcgaggccuucuccgagggcgggaucuucaacaucacgagccccaugugccugguguccaagcagaaccgguuccgcgccgccgagcagcagaucagcuucaucugccagcgggucgacauggacaucaucguguacugcaacggccagaagaagaccauccucaccaagacccuggugaucgggcagugcaucuacacgaucaccucccuguucagccuccugccgggcgucgcccacagcaucgcgaucgagcugugcgugcccggcuuccacgggugggccaccgccgcccuccugaucaccuucugcuucggcugggugcugauccccgcgugcacgcucgccguccugcuguuccucaaguucuucgccaacauccugcacaccuccaaccaggagaaccgcuucaaggccauccugcggaagaucaaggaggaguucgagaagaccaaggggagcauggugugcgagaucugcaaguacgagugcgagacccucaaggagcugaaggcccacaaccuguccugcgugcagggcgagugccccuacugcuucacgcacugcgagccgaccgagaccgcgauccaggcccacuacaaggucugccaggccacccaccgcuuccgggaggaccucaagaagacggugacgccccagaacaucgggcccggcugcuaccgcacccugaaccuguuccgguacaagagccgcugcuacauccugaccauguggauccuccugcuggugaucgaguccauccucugggccgccagcgcggccgagaucccccuggucccgcuguggaccgacaacgcccacggcgugggguccgugcccaugcacaccgaccucgagcuggacuucagccugcccuccagcuccaaguacaccuacaagcggcaccucaccaacccggucaacgaccagcagagcgugucccugcacaucgagaucgagagccagggcaucggggccgacgugcaccaccugggccacugguacgacgcccgccucaaccugaagaccuccuuccacugcuacggcgcgugcacgaaguaccaguaccccuggcacaccgccaagugccacuucgagaaggacuacgaguacgagaacagcugggccugcaacccgcccgacugccccggggucggcaccgggugcaccgccugcggccuguaccucgaccagcugaagcccguggggacggcguucaagaucaucuccgugcgcuacagccggaaggucugcgugcaguucggcgaggaguaccugugcaagaccaucgacaugaacgacugcuucgugacccgccacgccaagaucugcaucaucggcaccgucagcaaguucucccagggggacacgcuccuguuccugggccccauggagggcggcgggaucaucuucaagcacuggugcaccagcacgugccacuucggggaccccggcgacgugauggggccgaaggacaagcccuucaucugccccgaguuccccggccaguuccggaagaagugcaacuucgccaccaccccggugugcgaguacgacgggaacgucaucuccggcuaccgcaaggugcucgccaccaucgacagcuuccaguccuucaacaccagcaacgugcacuucaccgacgagcggaucgaguggcgcgaccccgacgggaugcugcgggaccacaucaacaucgucaucuccaaggacaucgacuucgagaaccuggccgagaaccccugcaaggugggccuccaggcggccaacaucgagggcgccugggggagcggcgugggguucacgcugaccugccaggucucccugaccgagugccccaccuuccucacgagcaucaaggccugcgacauggccaucugcuacggcgcggaguccgugacccugagccgcgggcagaacaccgugaagaucaccggcaagggcgggcacuccggcagcuccuucaagugcugccacgggaaggagugcagcuccaacggccugcaggccagcgccccgcaccucgacaaggucaacggcaucuccgagcuggagaacgagaagguguacgacgacggggcccccgagugcggcaucacgugcugguucaagaaguccggggagugggugaugggcaucaucaacgggaacuggaucguccugaucgugcucugcgugcugcuccuguucagccugauccugcucagcauccugugccccguccggaagcacaagaaguccuga

SEQ ID NO: 11873 - RNA, 3402 nt, Artificial Sequence
  derived and/or modified CDS sequence (opt1) from SEOV(ZT10)__DQ159911.1__GP
auguggagccugcuccugcuggccgcccucgugggccagggguucgcccugaagaacgucuucgacaugcgcauccagugcccccacuccgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgagguggucgaguccgaggugagcuucaagggccugugcaugcucaagcaccgcaugguggaggaguccuaccggaaccgccggagcgucaucugcuacgaccuggccugcaacuccaccuucugcaagcccaccguguacaugaucgugccgauccacgcgugcaacaugaugaaguccugccugaucgggcucggccccuaccgcauccaggucguguacgagcggacguacugcaccaccggcauccugaccgaggggaagugcuucgugcccgacaaggccgucgugagcgcccugaagcgcggcauguacgccaucgcgagcaucgagacgaucugcuucuucauccaccagaaggggaacaaguacaagaucgugaccgccaucaccuccgccaugggcagcaagugcaacaacaccgacacgaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacaccgucagcuccaagaaccugaagcugacggccuucgcggggaucccgagcuacuccagcaccuccauccucgccgccagcgaggacggccgcuucaucuucucccccgggcuguuccccaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucaccagccccaugugccuggucuccaagcagauccgcuuccgggccgccgagcagcagaucagcuucaucugccagcgcguggacauggacaucaucguguacugcaacgggcagaagaagacgauccucaccaagacccuggucaucggccagugcaucuacaccaucacgucccuguucagccuccugcccgggguggcccacagcaucgcgaucgagcugugcgugccgggcuuccacggcugggccaccgccgcccuccugaucaccuucugcuucggguggguccugauccccgcgugcacccucgccauccugcuggugcucaaguucuucgccaacauccugcacacguccaaccaggagaaccgguucaaggccauccugcgcaagaucaaggaggaguucgagaagaccaagggcagcauggugugcgagaucugcaaguacgagugcgagacccucaaggagcugaaggcccacaaccuguccugcguccagggggagugccccuacugcuucacccacugcgagcccacggagaccgcgauccaggcccacuacaaggugugccaggccacccaccgguuccgcgaggaccucaagaagaccgugacgccgcagaacaucggccccgggugcuaccggacccugaaccuguuccgcuacaagagccggugcuacauccugaccauguggacccuccugcugaucaucgaguccauccucugggccgccagcgcggccgagaucccccuggucccccuguggaccgacaacgcccacggcgugggcuccgugccgaugcacacggaccucgagcuggacuucagccugcccuccagcuccaaguacaccuacaagcgccaccucaccaaccccgucaacgaccagcagagcgugucccugcacaucgagaucgagagccaggggaucggcgccgacgugcaccaccuggggcacugcuacgacgcccgccucaaccugaagaccuccuuccacugcuacggcgcgugcacgaaguaccaguacccguggcacaccgccaagugccacuucgagaaggacuacgaguacgagaacagcugggccugcaacccgcccgacugccccggcgucgggaccggcugcaccgccugcgggcuguaccucgaccagcugaagcccgugggcacggcguucaagaucaucuccgugcgguacagccgcaaggucugcgugcaguucggggaggaguaccugugcaagaccaucgacaugaacgacugcuucgugacccggcacgccaagaucugcaucaucggcaccgucagcaaguucucccagggcgacacgcuccuguuccuggggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgugugcgaguacgacggcaacaucaucuccggguacaagaagguccucgccaccaucgacagcuuccaguccuucaacaccagcaacauccacuucaccgacgagcggaucgaguggcgcgacccggacggcaugcugcgggaccacaucaacaucgugaucuccaaggacaucgacuucgagaaccuggccgagaaccccugcaagguggggcuccaggcggccaacaucgagggcgccuggggccugggggucggcuucacgcugaccugccaggugagccucaccgagugccccaccuuccugacguccaucaaggccugcgacauggccaucugcuacggggcggagagcgugacccugucccgcggccagaacaccgucaagaucaccgggaagggcggccacagcggguccagcuucaagugcugccacggcaaggagugcuccagcacggggcuccaggccuccgcgccccaccuggacaaggugaacggcaucagcgagcuggagaacgagaagguguacgacgacggcgccccggagugcgggaucacgugcugguucaagaaguccggcgagugggucauggggaucaucaacggcaacuggguggugcucaucguccugugcgugcugcuccuguucagccugauccuccugagcauccugugccccgugcggaagcacaagaaguccuga

SEQ ID NO: 11874 - RNA, 3402 nt, Artificial Sequence
  derived and/or modified CDS sequence (opt1) from SEOV(ZT71)__EF117248.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgagguggucgaguccgaggugagcuucaagggccugugcaugcucaagcaccgcaugguggaggaguccuaccggaaccgccggagcgucaucugcuacgaccuggccugcaacuccaccuucugcaagcccaccguguacaugaucgugccgauccacgcgugcaacaugaugaaguccugccugaucgggcucggccccuaccgcauccaggucguguacgagcggacguacugcaccaccggcauccuggccgaggggaagugcuucgugcccgacaaggccgucgugagcgcccugaagcgcggcauguacgcgaucgccagcaucgagaccaucugcuucuucauccaccagaaggggaacaaguacaagaucgugacggccaucaccuccgccaugggcagcaagugcaacaacaccgacaccaagguccagggguacuacaucugcaucaucggcggcaacagcgcccccguguacgcgccggccggggaggacuuccgggccauggagguguucuccggcaucaucacgagcccccacggggaggaccacgaccuccccggcgaggagaucgccaccuaccagaucuccggccagaucgaggccaagaucccccacaccgucagcuccaagaaccugaagcugaccgcguucgccgggaucccgagcuacuccagcacguccauccucgccgccagcgaggacggccgcuucaucuucucccccgggcuguuccccaaccugaaccagagcgugugcgacaacaacgcccucccccugaucuggcggggccugaucgaccucaccggguacuacgaggcggugcacccgugcaacgucuucugcgugcuguccggccccggcgccagcugcgaggccuucuccgagggcgggaucuucaacaucaccagccccaugugccuggucuccaagcagaaccgcuuccgggccgccgagcagcagaucagcuucaucugccagcgcguggacauggacaucaucguguacugcaacgggcagaagaagaccauccucacgaagacccuggucaucggccagugcaucuacaccaucaccucccuguucagccuccugcccgggguggcgcacagcaucgccaucgagcugugcgugccgggcuuccacggcugggccacggccgcgcuccugaucaccuucugcuucggguggguccugauccccgccugcacccucgccauccugcuggugcucaaguucuucgccaacauccugcacaccuccaaccaggagaaccgguucaaggccauccugcgcaagaucaaggaggaguucgagaagacgaagggcagcauggugugcgagaucugcaaguacgagugcgagacccucaaggagcugaaggcgcacaaccuguccugcguccagggggagugccccuacugcuucacccacugcgagcccaccgagacggccauccaggcccacuacaaggugugccaggccacccaccgguuccgcgaggaccucaagaagaccgugaccccgcagaacaucggccccgggugcuaccggacgcugaaccuguuccgcuacaagagccggugcuacauccugaccauguggacccuccugcugaucaucgaguccauccucugggccgcgagcgccgccgagaucccccuggucccccuguggaccgacaacgcccacggcgugggcuccgugccgaugcacaccgaccucgagcuggacuucagccugcccuccagcuccaaguacacguacaagcgccaccucaccaaccccgucaacgaccagcagagcgugucccugcacaucgagaucgagagccaggggaucggcgccgacgugcaccaccuggggcacugguacgacgcgggccucaaccugaagaccuccuuccacugcuacggcgccugcaccaaguaccaguacccguggcacacggccaagugccacuucgagaaggacuacgaguacgagaacagcugggccugcaacccgcccgacugccccggggucggcaccgggugcaccgcgugcggccuguaccucgaccagcugaagcccguggggaccgccuucaagaucaucuccgugcgcuacagccggaaggucugcgugcaguucggcgaggaguaccugugcaagacgaucgacaugaacgacugcuucgugacccgccacgccaagaucugcaucaucggcaccgucagcaaguucucccagggggacacccuccuguuccugggccccauggagggcggcgggaucaucuucaagcacuggugcacgagcacgugccacuucggggaccccggcgacgugauggggcccaaggacaagccguucaucugccccgaguuccccggccaguuccggaagaagugcaacuucgccaccacccccgugugcgaguacgacgggaacaucaucuccggcuacaagaagguccucgccaccaucgacagcuuccaguccuucaacaccagcaacauccacuucaccgacgagcgcaucgaguggcgggacccggacgggaugcugcgcgaccacaucaacaucgugaucuccaaggacaucgacuucgagacccuggcggagaaccccugcaaggugggccuccaggccgccaacaucgagggcgccugggggagcggcgucggguucacgcugaccugccaggugucccugaccgagugccccaccuuccucacgagcaucaaggccugcgacauggcgaucugcuacggcgccgaguccgugacccugagccgggggcagaacaccgucaagaucaccggcaagggcgggcacuccggcagcuccuucaagugcugccacgggaaggagugcagcuccacgggccugcaggccagcgcgccccaccucgacaaggugaacggcaucuccgagcuggagaacgagaagguguacgacgacggggccccggagugcggcaucacgugcugguucaagaaguccggggagugggucaugggcaucaucaacgggaacuggguggugcugaucguccucugcgugcugcuccuguucagccugauccugcucagcauccugugccccgugcgcaagcacaagaaguccuga

SEQ ID NO: 11875 - RNA, 3402 nt, Artificial Sequence
  derived and/or modified CDS sequence (opt1) from SEOV(DN2)__KX289953.1__GP
auguggagccugcuccugcuggccgcccucgccggccagggguucgcccugaagaacguguucgacaugcgcauccagugcccccacuccgucaacuucggcgagaccagcguguccggguacaccgagcugccgccccucagccugcaggaggccgagcagcuggugcccgaguccagcugcaacauggacaaccaccagucccucagcaccaucaacaagcugaccaaggucaucuggcggaagaaggccaaccaggaguccgccagccagaacuccuucgaggugguggagagcgaggucuccuucaagggccugugcaugcucaagcaccgcaugguggaggagagcuaccggaaccgccgguccgugaucugcuacgaccuggcgugcaacagcaccuucugcaagcccaccgucuacaugaucgugccgauccacgccugcaacaugaugaaguccugccugaucgggcucggccccuaccgcauccagguggucuacgagcggacguacugcaccaccggcauccugaccgaggggaagugcuucgugcccgacaaggccguggucagcgcccugaagcgcggcauguacgcgaucgccuccaucgagacgaucugcuucuucauccaccagaaggggaacaccuacaagaucgugaccgccaucaccagcgccaugggcagcaagugcaacaacacggacaccaaggugcagggguacuacaucugcaucaucggcggcaacuccgcccccgucuacgcgccggccggggaggacuuccgggccauggagguguucagcggcaucaucaccagcccccacggggaggaccacgaccuccccggcgaggagaucgccaccuaccagaucagcggccagaucgaggccaagaucccccacacgguguccagcaagaaccugaagcugaccgcguucgccgggaucccguccuacagcuccaccagcauccucgccgccuccgaggacggccgcuucaucuucagccccgggcuguuccccaaccugaaccaguccgucugcgacaacaacgcccucccccugaucuggcggggccugaucgaccucaccggguacuacgaggcggugcacccgugcaacguguucugcguccugagcggccccggcgccuccugcgaggccuucagcgagggcgggaucuucaacaucacgucccccaugugccuggugagcaagcagaaccgcuuccgggccgccgagcagcagaucuccuucgucugccagcgcaucgacauggacaucaucguguacugcaacgggcagaagaagaccauccucaccaagacccuggugaucggccagugcaucuacacgaucaccagccuguucagccuccugcccggggucgcgcacuccaucgccaucgagcugugcgugccgggcuuccacggcugggccaccgccgcgcuccugaucaccuucugcuucgggugggugcugauccccgccugcacgcucgccauccugcugguccucaaguucuucgccaacauccugcacaccagcaaccaggagaaccgguucaaggccauccugcgcaagaucaaggaggaguucgagaagaccaagggcuccauggugugcgagaucugcaaguacgagugcgagacccucaaggagcugaaggcgcacaaccugagcugcgugcagggggagugccccuacugcuucacgcacugcgagcccaccgagaccgccauccaggcccacuacaaggucugccaggccacccaccgguuccgcgaggaccucaagaagacggugaccccgcagaacaucggccccgggugcuaccggacccugaaccuguuccgcuacaagucccggugcuacauccugaccauguggacccuccugcugaucaucgagagcauccucugggccgcguccgccgccgagaucccccugaucccccuguggacggacaacgcccacggcgugggcagcgucccgaugcacaccgaccucgagcuggacuucucccugcccagcuccagcaaguacaccuacaagcgccaccucaccaaccccgugaacgaccagcaguccgugagccugcacaucgagaucgagucccaggggaucggcgccgacguccaccaccuggggcacugguacgacgcgcgccucaaccugaagacgagcuuccacugcuacggcgccugcaccaaguaccaguacccguggcacaccgccaagugccacuucgagaaggacuacgaguacgagaacuccugggccugcaacccgcccgacugccccggcguggggaccggcugcacggcgugcgggcuguaccucgaccagcugcggcccgugggcaccgccuucaagaucaucagcguccgcuacagccggaaggugugcgugcaguucggggaggaguaccugugcaagaccaucgacaugaacgacugcuucgucacccgccacgccaagaucugcaucaucggcacgguguccaaguucagccagggcgacacccuccuguuccuggggcccauggagggcgggggcaucaucuucaagcacuggugcaccuccacgugccacuucggggaccccggcgacgugaugggccccaaggacaagccguucaucugccccgaguuccccgggcaguuccggaagaagugcaacuucgccaccacccccgucugcgaguacgacggcaacaccaucagcggguacaagaaggugcucgccaccaucgacuccuuccagagcuucaacacguccaacauccacuucaccgacgagcgcaucgaguggcgggacccggacggcaugcugcgcgaccacaucaacaucgugaucagcaaggacaucgacuucgagaaccuggcggagaaccccugcaaggucgggcuccaggccgccaacaucgagggcgccuggggcuccggggugggcuucacccugaccugccaggugagccugacggagugccccaccuuccucaccuccaucaaggccugcgacauggcgaucugcuacggggccgagagcgucacccugucccggggccagaacacggugaagaucaccgggaagggcggccacagcggguccagcuucaagugcugccacggcaaggagugcuccagcaccgggcugcaggccuccgcgccccaccucgacaaggugaacggcaucagcgagcuggagaacgagaaggucuacgacgacggcgccccggagugcgggaucacgugcugguucaagaaguccggcgagugggugauggggaucaucaacggcaacugggugguccugaucgugcucugcgugcugcuccuguucucccugauccugcucagcauccugugccccguccgcaagcacaagaaguccuga

SEQ ID NO: 11876 - RNA, 3402 nt, Artificial Sequence
  derived and/or modified CDS sequence (opt1) from SEOV(IR162)__KX079475.1__GP
auguggagccugcuccugcuggccgcccucgugggccgcggguucacccugaagaacgucuucgacaugcggauccagugcccccacagcgugaacuucggcgagaccagcguguccggguacacggagcugccgccccucagccugcaggaggcggagcagcugguccccgaguccagcugcaacauggacaaccaccagucccucagcaccaucaacaagcugaccaaggugaucuggcgcaagaaggccaaccaggaguccgccaaccagaacagcuucgagguggucgaguccgaggugagcuucaagggccugugcaugcucaagcaccggaugguggaggaguccuaccgcaaccggcgcagcgucaucugcuacgaccuggccugcaacuccaccuucugcaagcccacgguguacaugaucgugccgauccacgccugcaacaugaugaaguccugccugaucgggcucggccccuaccggauccaggucguguacgagcgcaccuacugcaccaccggcauccugacggaggggaagugcuucgugcccgacaaggcggucgugagcgcccugaagcggggcauguacgccaucgccagcaucgagaccaucugcuucuucauccaccagaaggggaacaccuacaagaucgugaccgcgaucacguccgccaugggcagcaagugcaacaacaccgacaccaagguccagggguacuacaucugcaucaucggcggcaacagcgcccccguguacgccccggccggggaggacuuccgcgcgauggagguguucuccggcaucaucaccagcccccacggggaggaccacgaccuccccggcgaggagaucgccacguaccagaucuccggccagaucgaggccaagaucccccacaccgucagcuccaagaaccugaagcugaccgccuucgccgggaucccgagcuacuccagcaccuccgugcucaucgcgagcgaggacggccgguucaucuucucccccgggcuguuccccaaccugaaccagagcgugugcgacaacaacgcccucccccugaucuggcgcggccugaucgaccucacgggguacuacgaggccguccacccgugcaacguguucugcguccuguccggccccggcgccagcugcgaggccuucuccgagggcgggaucuucaacaucaccagccccaugugccugguguccaagcagaaccgguuccgcgcggccgagcagcagaucagcuucgugugccagcgggucgacauggacaucaucguguacugcaacgggcagaagaagaccauccucaccaagacgcuggugaucggccagugcaucuacaccaucaccucccuguucagccuccugcccggggucgcccacagcaucgccaucgagcugugcgugccgggcuuccacggcugggccaccgcggcccuccugaucacguucugcuucgggugggugcugauccccgccugcacccucgccauccugcugguccucaaguucuucgcgaacauccugcacaccuccaaccaggagaaccgcuucaaggccauccugcggaagaucaaggaggaguucgagaagaccaagggcagcauggugugcgagaucugcaaguacgagugcgagacgcucaaggagcugaaggcccacaaccuguccugcgugcagggggagugccccuacugcuucacccacugcgagcccaccgagaccgccauccaggcccacuacaaggucugccaggcgacgcaccgcuuccgggaggaccucaagaagaccgugaccccgcagaacaucggccccgggugcuaccgcacccugaaccuguuccgguacaagagccgcugcuacauccugaccauguggacgcuccugcugaucaucgaguccauccucugggccgccagcgccaccgagaucccccuggugccccuguggaccgacaacgcccacggcgucggcuccgugccgaugcacaccgaccucgagcuggacuucagccugcccuccagcuccaaguacacguacaagcgccaccucaccaaccccgugaacgaccagcagagcgucucccugcacaucgagaucgagagccaggggaucggcgcggacgugcaccaccuggggcacugguacgacgcccggcucaaccugaagaccuccuuccacugcuacggcgccugcaccaaguaccaguacccguggcacacggccaagugccacuucgagaaggacuacgaguacgagaacagcugggccugcaacccgcccgacugccccggcaucgggaccggcugcaccgcgugcgggcuguaccucgaccagcugaagcccgugggcaccgccuucaagaucaucuccguccgcuacagccggaaggugugcgugcaguucggggaggaguaccugugcaagacgaucgacaugaacgacugcuucgucacccgccacgccaagaucugcaucaucggcaccgugagcaaguucucccagggcgacacccuccuguuccuggggcccauggagggcgggggcaucaucuucaagcacuggugcacgagcacgugccacuucggggaccccggcgacgugaugggccccaaggacaagccguucaucugccccgaguuccccgggcaguuccggaagaagugcaacuucgccaccacccccgucugcgaguacgacggcaacaucaucuccggguacaagaaggugcucgcgaccaucgacagcuuccaguccuucaacaccagcaacauccacuucaccgacgagcgcaucgaguggcgggacccggacggcaugcugcgcgaccacaucaacaucgugaucuccaaggacaucgacuucgagaaccuggccgagaaccccugcaaggucgggcuccaggccgccaacaucgagggcgccuggggcagcggggugggcuucacccugacgugccaggugucccugaccgagugccccaccuuccucaccagcaucaaggcgugcgacauggccaucugcuacggggccgaguccgucacgcugagccggggccagaacaccgugaagaucaccgggaagggcggccacuccgggagcuccuucaagugcugccacggcaaggagugcagcuccaccgggcugcaggccagcgcgccccaccucgacaaggugaacggcaucuccgaccuggagaacgagaaggucuacgacgacggcgccccggagugcgggaucacgugcugguucaagaaguccggcgagugggugauggggaucaucaacggcaacugggugguccugaucgugcucugcgugcugcuccuguucagccugauccugcucagcauccugugccccguccgcaagcacaagaaguccuga

SEQ ID NO: 11877 - RNA, 3402 nt, Artificial Sequence
  derived and/or modified CDS sequence (opt1) from SEOV(Gou3)__AF145977.2__GP
auguggggccugcuccugcuggccgcccucguggggcagggccuggcgcugaagaacgucuucgacaugaagauccagugcccccacagcgugaacuucggggagaccagcgugagcggcuacaccgagcucccgccccugccccugcaggaggccgagcagcucguccccgaguccagcugcaacauggacaaccaccagucccugagcaccaucaacaagcugaccaaggugaucuggcgcaagaaggccaaccaggaguccgccagccagaacuccuucgagguggucgagaacgaggugagcuucaaggggcucugcaugcugaagcaccggaugguggaggaguccuaccgcaaccggcgcagcgucaucugcuacgaccuggccugcaacaccaccuucugcaagccgacgguguacaugaucgugcccauccacgcgugcaacaugaugaaguccugccucaucggccugggccccuaccggauccaggucaucuacgagcgcaccuacugcaccaccgggauccugacggagggcaagugcuucgugcccgacaaggccguggucagcgcccucaagcgggggauguacgccaucgcguccaucgagaccaucugcuucuucgugcacaagaagggcaacaccuacaagaucgugagcgccaucacccuggccaugggguccaagugcaacaacacggacagcaagguccagggcuacuacaucugcaucaucggcgggaacuccgccccgguguacgcccccgcgggcgaggacuuccgcgccauggagguguucagcgggaucaucaccagcccccacggcgaggaccacgaccugcccggcgaggagaucgccaccuaccagaucuccgggcagaucgaggccaagaucccgcacaccgucagcuccaagaaccucaagcugacggccuucgcgggcauccccagcuacuccagcaccuccauccuggccgccagcgaggacgggcgguucaucuucucccccggccucuuccccaaccugaaccagagcgugugcgacaacaacgcccugccgcucaucuggcgcgggcugaucgaccugaccggcuacuacgaggccauccaccccugcaacguguucugcguccucuccggccccggggcgagcugcgaggccuucuccgagggcgggaucuucaacaucaccagccccaugugccugguguccaagcagaaccgguuccgcgccgccgagcagcagaucagcuucaucugccagcgggucgacauggacaucgugguguacugcaacggccagaagaagacgauccugaccaagacccucgucaucgggcagugcaucuacaccaucacgucccuguucagccugcucccgggcguggcccacuccaucgcgaucgagcugugcgugcccggcuuccacgggugggccaccgccgcccugcucgucaccuucugcuucggcugggugcugauccccgcgugcacccuggccgugcuccuguuccugaaguucuucgccaacauccuccacacgagcaaccaggagaaccgcuucaaggccauccugcggaagaucaaggaggaguucgagaagaccaaggggagcauggucugcgagaucugcaaguacgagugcgagacccugaaggagcucaaggcccacaaccuguccugcgugcagggcgagugccccuacugcuucacccacugcgagccgacggagaccgcgauccaggcccacuacaaggugugccaggccacccaccgcuuccgggaggaccugaagaagaccgucacgccccagaacaucgggcccggcugcuaccgcacccugaaccucuuccgguacaagagccgcugcuacauccugaccauguggauccugcuccuggugaucgaguccauccugugggccgccagcgcggccgagaucccccucgugccgcuguggaccgacaacgcccacggcgucggguccgugcccaugcacaccgaccuggagcucgacuucagccugcccuccagcuccaaguacacguacaagcggcaccugaccaacccggugaacgaccagcagagcgucucccuccacaucgagaucgagagccagggcaucggggccgacgugcaccaccugggccacugguacgacgcccgccugaaccucaagaccuccuuccacugcuacggcgcgugcaccaaguaccaguaccccuggcacacggccaagugccacuucgagaaggacuacgaguacgagaacagcugggccugcaacccgcccgacugccccggggugggcgccgggugcaccgcgugcggccuguaccuggaccagcucaagcccgucgggaccgccuucaagaucaucuccgugcgcuacagccggaaggugugcguccaguucggcgaggaguaccugugcaagaccaucgacaugaacgacugcuucgugacgcgccacgccaagaucugcaucaucggcaccguguccaaguucagccagggggacacccuccucuuccugggccccauggagggcggcgggaucaucuucaagcacuggugcaccagcacgugccacuucggggaccccggcgacgucauggggccgaaggacaagcccuucaucugccccgaguuccccggccaguuccggaagaagugcaacuucgccaccaccccggugugcgaguacgacgggaacgugaucuccggcuaccgcaagguccuggccaccaucgacagcuuccaguccuucaacacgagcaacgugcacuucaccgacgagcggaucgaguggaaggaccccgacgggaugcuccgcgaccacaucaacaucgugaucuccaaggacaucgacuucgagaaccuggcggagaaccccugcaaggucggccugcaggccgccaacaucgagggcgccugggggagcggcgugggguucacccugaccugccaggugucccugacggagugccccaccuuccugaccagcaucgaggccugcgacauggcgaucugcuacggcgccgaguccgucacccucagccgggggcagaacacgaucaagaucaccggcaagggcgggcacuccggcagcuccuucaagugcugccacgggaaggagugcagcgccaacggccugcaggccuccgccccgcaccuggacaaggugaacggcaucagcgagcucgagaacgagaagguguacgacgacggggcgcccgagugcggcaucacgugcugguucaagaaguccggggagugggucaugggcaucaucaacgggaacuggguggugcugaucguccugugcgugcuccugcuguucagccucauccugcuguccauccucugccccgugcgcaagcacaagaaguccuga

SEQ ID NO: 11878 - RNA, 3402 nt, Artificial Sequence
  derived and/or modified CDS sequence (opt1) from SEOV(HB55)__AF035832.1__GP
auguggagccugcuccugcuggccgcccucgugggccagggguucgcccugaagaacgucuucgacaugcgcauccagugcccccacuccgugaacuucggcgagaccagcguguccggguacaccgagcugccgccccucagccugcaggaggccgagcagcugguccccgaguccagcugcaacauggacaaccaccagucccucagcacgaucaacaagcugaccaaggugguguggcggaagaaggccaaccaggaguccgccaaccagaacagcuucgaggucguggaguccgaggugagcuucaagggccugugcaugcucaagcaccgcauggucgaggaguccuaccggaaccgccggagcgugaucugcuacgaccuggccugcaacuccaccuucugcaagcccaccguguacaugaucgucccgauccacgcgugcaacaugaugaaguccugccugaucgggcucggccccuaccgcauccaggugguguacgagcggacguacugcaccaccggcauccugaccgaggggaagugcuucguccccgacaaggccguggugggcgcccugaagcgcgggauguacgccaucgcguccaucgagacgaucugcuucuucauccaccagaagggcaacaaguacaagaucgucaccgccaucaccagcgccaugggguccaagugcaacaacaccgacacgaaggugcagggcuacuacaucugcaucaucggcgggaacagcgcccccguguacgccccggcgggcgaggacuuccgggccauggaggucuucagcgggaucaucaccagcccccacggcgaggaccacgaccuccccggcgaggagaucgccaccuaccagaucagcgggcagaucgaggccaagaucccccacaccguguccagcaagaaccugaagcugaucgccuucgcgggcaucccguccuacagcuccacgagcauccucgccgccuccgaggacgggcgcuucaucuucagccccggccuguuccccaaccugaaccaguccgugugcgacaacaacgcccucccccugaucuggcgggggcugaucgaccucaccggcuacuacgaggccguccacccgugcaacguguucugcguccugagcggccccggggcguccugcgaggccuucagcgagggcgggaucuucaacaucaccucccccaugugccuggugagcaagcagaaccgcuuccgggccgccgagcagcagaucuccuucaucugccagcgcguggacauggacaucaucgucuacugcaacggccagaagaagaccauccucacgaagacccuggugaucgggcagugcaucuacaccaucaccagccuguucucccuccugcccggcguggcccacagcaucgcgaucgagcugugcgucccgggcuuccacgggugggccacggccgcccuccugaucaccuucugcuucggcugggugcugauccccgcgugcacccucgccauccugcuggugcucaaguucuucgccaacauccugcacaccagcaaccaggagaaccgguucaaggccauccugcgcaagaucaaggaggaguucgagaagacgaagggguccauggucugcgagaucugcaaguacgagugcgagacccucaaggagcugaaggcccacaaccugagcugcgugcagggcgagugccccuacugcuucacccacugcgagcccaccgagacggcgauccaggcccacuacaaggugugccaggccacccaccgguuccgcgaggaccucaagaagaccgucaccccgcagaacaucgggcccggcugcuaccggacgcugaaccuguuccgcuacaagucccggugcuacauccugaccauguggacccuccugcugaucaucgagagcauccucugggccgccuccgcggccgagaucccccuggugccccuguggaccgacaacgcccacggcguggggagcgucccgaugcacaccgaccucgagcuggacuucucccugcccagcuccagcaaguacacguacaagcgccaccucaccaaccccgugaacgaccagcaguccgugagccugcacaucgagaucgagucccagggcaucggggccgacguccaccaccugggccacugguacgacgcccgccucaaccugaagaccagcuuccacugcuacggcgcgugcaccaaguaccaguacccguggcacacggccaagugccacuucgagaaggacuacgaguacgagaacuccugggccugcaacccgcccgacugccccggggugggcaccgggugcaccgccugcggccuguaccucgaccagcugaagcccguggggaccgcguucaagaucaucagcguccgguacucccgcaaggccugcgugcaguucggcgaggaguaccugugcaagacgaucgacaugaacgacugcuucgugaccggccacgccaagaucugcaucaucgggaccgucagcaaguucagccagggcgacacccuccuguuccuggggcccauggagggcgggggcaucaucuucaagcacuggugcacguccacgugccacuucggcgaccccggggacgugaugggccccaaggacaagccguucaucugccccgaguuccccgggcaguuccggaagaagugcaacuucgccaccacccccaucugcgaguacgacggcaacaucaucagcggguacaagaaggugcucgccaccaucgacuccuuccagagcuucaacaccuccaacauccacuucaccgacgagcgcaucgaguggcgggacccggacggcaugcugcgcgaccacaucaacaucgucaucagcaaggacaucgacuucgagaaccuggcggagaaccccugcaaggugggccuccaggccgccaacaucgagggggccuggggcuccggggugggcuucacccugacgugccaggucagccugaccgagugccccaccuuccucaccuccaucaaggccugcgacauggcgaucugcuacggggccgagagcgugacgcugucccggggccagaacaccgugcgcaucaccggcaagggcgggcacagcggguccagcuucaagugcugccacggcaaggagugcuccagcaccggccugcaggccuccgcgccccaccucgacaaggucaacgggaucagcgagcuggagaacgagaagguguacgacgacggcgccccggagugcggggugacgugcugguucaagaaguccggcgagugggucauggggaucaucaacggcaacuggguggugcugaucguccucugcgugcugcuccuguucagccugauccugcucagcauccugugccccgugcggaagcacaagaaguccuga

SEQ ID NO: 11879 - RNA, 3402 nt, Artificial Sequence
  derived and/or modified CDS sequence (opt1) from SEOV(L99)__AF035833.1__GP
auguggagccugcuccugcuggccgcccucgugggccagggguucgcccugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcacgaucaacaagcugaccaaggugguguggcggaagaaggccaaccaggagcuggccaaccagaacuccuucgaggucguggagagcgagguguccuucaagggccucugcaugcugaagcaccgcauggucgaggagagcuaccggaaccgccgguccgugaucugcuacgaccuggccugcaacagcaccuucugcaagcccaccguguacaugaucgucccgauccacgcgugcaacaugaugaaguccugccucaucgggcugggccccuaccgcauccaggugguguacgagcggacguacugcaccaccggcauccugaccgaggggaagugcuucguccccgacaaggccguggugagcgcccucaagcgcggcauguacgccaucgcguccaucgagacgaucugcuucuucauccaccagaaggggaacaccuacaagaucgucaccgccaucaccagcgccaugggcuccaagugcaacaacacggacaccaaggugcagggguacuacaucugcaucaucggcggcaacagcgcccccguguacgccccggcgggggaggacuuccgggccauggaggucuucagcggcaucaucaccagcccccacggggaggaccacgaccugcccggcgaggagaucgccaccuaccagaucagcggccagaucgaggccaagaucccccacacgguguccagcaagaaccugaagcucaucgccuucgcggggaucccguccuacagcuccaccagcauccuggccgccuccgaggacggccgcuucaucuucagccccgggcuguuccccaaccucaaccaguccgugugcgacaacaacgcccugccccugaucuggcggggccucaucgaccugaccggguacuacgaggccguccacccgugcaacguguucugcguccugagcggccccggcgcguccugcgaggccuucagcgagggcgggaucuucaacaucaccucccccaugugccucgugagcaagcagaaccgcuuccgggccgccgagcagcagaucuccuucaucugccagcgcguggacauggacaucaucgucuacugcaacgggcagaagaagacgauccugaccaagacccuggugaucggccagugcaucuacaccaucacgagccucuucucccugcugcccgggguggcccacagcaucgcgaucgagcucugcgucccgggcuuccacggcugggccaccgccgcccugcugaucaccuucugcuucgggugggugcucauccccgcgugcacccuggccauccugcucgugcugaaguucuucgccaacauccugcacacgagcaaccaggagaaccgguucaaggccauccuccgcaagaucaaggaggaguucgagaagaccaagggcuccauggucugcgagaucugcaaguacgagugcgagacccugaaggagcugaaggcccacaaccucagcugcgugcagggggagugccccuacugcuucacccacugcgagcccacggagaccgcgauccaggcccacuacaaggugugccaggccacccaccgguuccgcgaggaccugaagaagaccgucacgccgaagaacaucggccccgggugcuaccggacccugaaccuguuccgcuacaagucccggugcuacauccucaccauguggacccugcugcucaucaucgagagcauccugugggccgccuccgcggccgagaucccccuggugccccucuggaccgacaacgcccacggcgugggcagcgucccgaugcacacggaccuggagcuggacuucucccuccccagcuccagcaaguacaccuacaagcgccaccugaccaaccccgugaacgaccagcaguccgugagccugcacaucgagaucgagucccaggggaucggcgccgacguccaccaccucgggcacugguacgacgcccgccugaaccugaagaccagcuuccacugcuacggcgcgugcacgaaguaccaguacccguggcacaccgccaagugccacuucgagaaggacuacgaguacgagaacuccugggccugcaacccgcccgacugccccggcguggggaccggcugcaccgccugcgggcucuaccuggaccagcugaagcccgugggcacggcguucaagaucaucagcguccgguacucccgcaaggugugcgugcaguucggggaggaguaccucugcaagaccaucgacaugaacgacugcuucgucacccggcacgccaagaucugcaucaucggcaccgugagcaaguucagccagggcgacacgcugcuguuccucgggcccauggagggcgggggcaucaucuucaagcacuggugcaccuccacgugccacuucggggaccccggcgacgugaugggccccaaggacaagccguucagcugccccgaguuccccgggcaguuccgcaagaagugcaacuucgccaccacccccaucugcgaguacgacggcaacaucaucuccggguacaagaagguccuggccaccaucgacagcuuccaguccuucaacaccagcaacauccacuucaccgacgagcggaucgaguggcgcgacccggacggcaugcugcgggaccacaucaacaucgugaucuccaaggacaucgacuucgagaaccucgccgagaaccccugcaagguggggcugcaggcggccaacaucgagggcgccuggggcagcggggucggcuucacgcugaccugccaggugucccucaccgagugccccaccuuccugacgagcaucaaggccugcgacauggccaucugcuacggggcggaguccgugacccugagccgcggccagaacaccguccggaucaccgggaagggcggccacuccgggagcuccuucaagugcugccacggcaaggagugcagcuccacggggcuccaggccagcgcgccccaccuggacaaggugaacggcaucuccgagcuggagaacgagaagguguacgacgacggcgccccggagugcggggugaccugcugguucaagaaguccggcgagugggucauggggaucaucaacggcaacugggugguccucaucgugcugugcgugcugcuccuguucagccugauccuccuguccauccugugccccguccgcaagcacaagaaguccuga

SEQ ID NO: 11880 - RNA, 3402 nt, Artificial Sequence
  derived and/or modified CDS sequence (opt1) from SEOV(Z37)__AF187081.1__GP
auguggagccugcuccugcuggccgcccucgugggccagggguucgcgcugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgagguggucgaguccgaggugagcuucaagggccugugcaugcucaagcaccgcaugguggaggaguccuaccggaaccgccggagcgucaucugcuacgaccuggccugcaacuccaccuucugcaagcccaccguguacaugaucgugccgauccacgcgugcaacaugaugaaguccugccugaucgggcucggccccuaccgcauccaggucguguacgagcggaccuacugcaccaccggcauccugaccgaggggaagugcuucgugcccgacaaggccgucgugagcgcccugaagcgcggcauguacgccaucgcgagcaucgagacgaucugcuucuucauccaccagaaggggaacaaguacaagaucgugaccgccaucaccuccgccaugggcagcaagugcaacaacaccgacacgaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacaccgucagcuccaagaaccugaagcugacggccuucgcggggaucccgagcuacuccagcaccuccauccucgccgccagcgaggacggccgcuucaucuucucccccgggcuguuccccaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucaccagccccaugugccuggucuccaagcagauccgcuuccgggccgccgagcagcagaucagcuucaucugccagcgcguggacauggacaucaucguguacugcaacgggcagaagaagacgauccucaccaagacccuggucaucggccagugcaucuacaccaucacgucccuguucagccuccugcccgggguggcccacagcaucgcgaucgagcugugcgugccgggcuuccacggcugggccaccgccgcccuccugaucaccuucugcuucggguggguccugauccccgcgugcacccucgccauccugcuggugcucaaguucuucgccaacauccugcacacguccaaccaggagaaccgguucaaggccauccugcgcaagaucaaggaggaguucgagaagaccaagggcagcauggugugcgagaucugcaaguacgagugcgagacccucaaggagcugaaggcccacaaccuguccugcguccagggggagugccccuacugcuucacccacugcgagcccacggagaccgcgauccaggcccacuacaaggugugccaggccacccaccgguuccgcgaggaccucaagaagaccgugacgccgcagaacaucggccccgggugcuaccggacccugaaccuguuccgcuacaagagccggugcuacauccugaccauguggacccuccugcugaucaucgaguccauccucugggccgccagcgcggccgagaucccccuggucccccuguggaccgacaacgcccacggcgugggcuccgugccgaugcacacggaccucgagcuggacuucagccugcccuccagcuccaaguacaccuacaagcgccaccucaccaaccccgucaacgaccagcagagcgugucccugcacaucgagaucgagagccaggggaucggcgccgacgugcaccaccuggggcacugguacgacgcccgccucaaccugaagaccuccuuccacugcuacggcgcgugcacgaaguaccaguacccguggcacaccgccaagugccacuucgagaaggacuacgaguacgagaacagcugggccugcaacccgcccgacugccccggcgucgggaccggcugcaccgccugcgggcuguaccucgaccagcugaagcccgugggcacggcguucaagaucaucuccgugcgguacagccgcaaggucugcgugcaguucggggaggaguaccugugcaagaccaucgacaugaacgacugcuucgugacccggcacgccaagaucugcaucaucggcaccgucagcaaguucucccagggcgacacgcuccuguuccuggggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgugugcgaguacgacggcaacaucaucuccggguacaagaagguccucgccaccaucgacagcuuccaguccuucaacaccagcaacauccacuucaccgacgagcggaucgaguggcgcgacccggacggcaugcugcgggaccacaucaacaucgugaucuccaaggacaucgacuucgagaaccuggccgagaaccccugcaagguggggcuccaggcggccaacaucgagggcgccuggggcagcggggucggcuucacgcugaccugccaggugucccugaccgagugccccaccuuccucacgagcaucaaggccugcgacauggccaucugcuacggggcggaguccgugacccugagccgcggccagaacaccgucaagaucaccgggaagggcggccacuccgggagcuccuucaagugcugccacggcaaggagugcagcuccacggggcugcaggccagcacgccccaccucgacaaggugaacggcaucuccgagcuggagaacgagaagguguacgacgacggcgccccggagugcgggaucacgugcugguucaagaaguccggcgagugggucauggggaucaucaacggcaacuggguggugcugaucguccucugcgugcugcuccuguucagccugauccugcucagcauccugugccccgugcggaagcacaagaaguccuga

SEQ ID NO: 11881 - RNA, 3402 nt, Artificial Sequence
  derived and/or modified CDS sequence (opt1) from SEOV(Z37)__AF190119.1__GP
auguggagccugcuccugcuggccgcccucgugggccagggguucgcccugaagaacgucuucgacaugcgcauccagugcccccacuccgugaacuucggcgagaccagcguguccggguacaccgagcugccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgagguggucgaguccgaggugagcuucaagggccugugcaugcucaagcaccgcaugguggaggaguccuaccggaaccgccggagcgucaucugcuacgaccuggccugcaacuccaccuucugcaagcccaccguguacaugaucgugccgauccacgcgugcaacaugaugaaguccugccugaucgggcucggccccuaccgcauccaggucguguacgagcggacguacugcaccaccggcauccugaccgaggggaagugcuucgugcccgacaaggccgucgugagcgcccugaagcgcggcauguacgccaucgcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggucagcuccaagaaccugaagcugaccgccuucgcggggaucccgagcuacuccagcaccuccauccucgccgccagcgaggacggccgcuucaucuucucccccgggcuguuccccaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucacgagccccaugugccuggucuccaagcagaaccgcuuccgggccgccgagcagcagaucagcuucaucugccagcgcguggacauggacaucaucguguacugcaacgggcagaagaagaccauccucaccaagacccuggucaucggccagugcaucuacacgaucaccucccuguucagccuccugcccgggguggcccacagcaucgcgaucgagcugugcgugccgggcuuccacggcugggccaccgccgcccuccugaucaccuucugcuucggguggguccugauccccgcgugcacgcucgccauccugcuggugcucaaguucuucgccaacauccugcacaccuccaaccaggagaaccgguucaaggccauccugcgcaagaucaaggaggaguucgagaagaccaagggcagcauggugugcgagaucugcaaguacgagugcgagacccucaaggagcugaaggcccacaaccuguccugcguccagggggagugccccuacugcuucacgcacugcgagcccaccgagaccgcgauccaggcccacuacaaggugugccaggccacccaccgguuccgcgaggaccucaagaagacggugaccccgcagaacaucggccccgggugcuaccggacccugaaccuguuccgcuacaagagccggugcuacauccugaccauguggacccuccugcugaucaucgaguccauccucugggccgccagcgcggccgagaucccccuggucccccuguggacggacaacgcccacggcgugggcuccgugccgaugcacaccgaccucgagcuggacuucagccugcccuccagcuccaaguacaccuacaagcgccaccucaccaaccccgucaacgaccagcagagcgugucccugcacaucgagaucgagagccaggggaucggcgccgacgugcaccaccuggggcacugguacgacgcccgccucaaccugaagacguccuuccacugcuacggcgcgugcaccaaguaccaguacccguggcacaccgccaagugccacuucgagaaggacuacgaguacgagaacagcugggccugcaacccgcccgacugccccggcgucgggaccggcugcacggccugcgggcuguaccucgaccagcugaagcccgugggcaccgcguucaagaucaucuccgugcgguacagccgcaaggucugcgugcaguucggggaggaguaccugugcaagaccaucgacaugaacgacugcuucgugacccggcacgccaagaucugcaucaucggcacggucagcaaguucucccagggcgacacccuccuguuccuggggcccauggagggcgggggcaucaucuucaagcacuggugcaccagcacgugccacuucggggaccccggcgacgugaugggccccaaggacaagccguucaucugccccgaguucgccgggcaguuccgcaagaagugcaacuucgccaccacccccgugugcgaguacgacggcaacaucaucuccggguacaagaagguccucgagaccaucgacagcuuccaguccuucaacaccagcaacauccacuucacggacgagcggaucgaguggcgcgaccccgacggcaugcugcgggaccacaucaacaucgugaucuccaaggacaucgacuucgagaacauggccgagaacccgugcaagguggggcugcaggcggccaacaucgagggcgccuggggcagcggggucggcuucacccugaccugccaggugucccucaccgagugccccacgagccugaccuccaucaaggccugcgacauggccaucugcuacggggcggagagcgugacccucucccgcggccagaacaccgucaagaucacggggaagggcggccacagcggguccagcuucaagcggugccacggcaaggagugcuccagcaccgggcugcaggccuccgcgccccaccuggacaaggugaacggcaucagcgagcucgagaacgagaagguguacgacgacggcgcccccgagugcgggaucacgugcugguucaagaaguccggcgagugggucauggggaucaucaacggcaacuggguggugcugaucguccugugcgugcuccugcuguucagccucauccugcugagcauccucugcccggugcgcaagcacaagaaguccuga

SEQ ID NO: 11882 - RNA, 3402 nt, Artificial Sequence
  derived and/or modified CDS sequence (opt1) from SEOV__M34882.1__GP
auguggagccugcuccugcuggccgcccucgugggccagggguucgcccugaagaacgucuucgacaugcgcauccagcugccccacagcgugaacuucggcgagaccagcguguccggguacaccgaguucccgccccucagccugcaggaggccgagcagcugguccccgaguccagcugcaacauggacaaccaccagucccucagcaccaucaacaagcugaccaaggugaucuggcggaagaaggccaaccaggaguccgccaaccagaacagcuucgagguggucgaguccgaggugagcuucaagggccugugcaugcucaagcaccgcaugguggaggaguccuaccggaaccgccggagcgucaucugcuacgaccuggccugcaacuccaccuucugcaagcccaccguguacaugaucgugccgauccacgcgugcaacaugaugaaguccugccugaucgggcucggccccuaccgcauccaggucguguacgagcggacguacugcaccaccggcauccugaccgaggggaagugcuucgugcccgacaaggccgucgugagcgcccugaagcgcggcauguacgccaucgcgagcaucgagacgaucugcuucuucauccaccagaaggggaacaccuacaagaucgugaccgccaucaccuccgccaugggcagcaagugcaacaacacggacaccaagguccagggguacuacaucugcaucaucggcggcaacagcgcccccguguacgccccggcgggggaggacuuccgggccauggagguguucuccggcaucaucaccagcccccacggggaggaccacgaccuccccggcgaggagaucgccaccuaccagaucuccggccagaucgaggccaagaucccccacacggucagcuccaagaaccugaagcugaccgccuucgcggggaucccgagcuacuccagcaccuccauccucgccgccagcgaggacggccgcuucaucuucucccccgggcuguuccccaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucacgagccccaugugccuggucuccaagcagaaccgcuuccgggccgccgagcagcagaucagcuucgugugccagcgcguggacauggacaucaucgucuacugcaacgggcagaagaagaccauccucaccaagacccuggugaucggccagugcaucuacacgaucaccucccuguucagccuccugcccgggguggcccacagcaucgcgaucgagcugugcgucccgggcuuccacggcugggccaccgccgcccuccugaucaccuucugcuucgggugggugcugauccccgcgugcacgcucgccauccugcuggugcucaaguucuucgccaacauccugcacaccuccaaccaggagaaccgguucaaggccauccugcgcaagaucaaggaggaguucgagaagaccaagggcagcauggucugcgagaucugcaaguacgagugcgagacccucaaggagcugaaggcccacaaccuguccugcgugcagggggagugccccuacugcuucacgcacugcgagcccaccgagaccgcgauccaggcccacuacaaggugugccaggccacccaccgguuccgcgaggaccucaagaagacggucaccccgcagaacaucggccccgggugcuaccggacccugaaccuguuccgcuacaagagccggugcuacauccugaccauguggacccuccugcugaucaucgaguccauccucugggccgccagcgcggccgagaucccccuggugccccuguggacggacaacgcccacggcgugggcuccgucccgaugcacaccgaccucgagcuggacuucagccugcccuccagcuccaaguacaccuacaagcgccaccucaccaaccccgugaacgaccagcagagcgugucccugcacaucgagaucgagagccaggggaucggcgccgccguccaccaccuggggcacugguacgacgcgcgccucaaccugaagacguccuuccacugcuacggcgccugcaccaaguaccaguacccguggcacaccgccaagugccacuucgagaaggacuacgaguacgagaacagcugggccugcaacccgcccgacugccccggcguggggaccggcugcacggcgugcgggcuguaccucgaccagcugaagcccgugggcaccgccuucaagaucaucuccguccgguacagccgcaaggugugcgugcaguucggggaggagcaccugugcaagaccaucgacaugaacgacugcuucgucacccggcacgccaagaucugcaucaucggcacggugagcaaguucucccagggcgacacccuccuguuccuggggcccauggagggcgggggcaucaucuucaagcacuggugcaccagcacgugccacuucggggaccccggcgacgugaugggccccaaggacaagccguucaucugccccgaguuccccgggcaguuccgcaagaagugcaacuucgccaccacccccgucugcgaguacgacggcaacaucaucuccggguacaagaaggugcucgccaccaucgacagcuuccaguccuucaacaccagcaacauccacuucacggacgagcggaucgaguggcgcgacccggacggcaugcugcgggaccacaucaacaucgugaucuccaaggacaucgacuucgagaaccuggcggagaaccccugcaaggucgggcuccaggccgccaacaucgagggcgccuggggcagcggggugggcuucacccugaccugcaaggugucccugaccgagugccccacguuccucaccagcaucaaggccugcgacauggcgaucugcuacggggccgaguccgucacccugagccgcggccagaacaccgugaagaucacggggaagggcggccacuccgggagcuccuucaagugcugccacggcaaggagugcagcuccaccgggcugcaggccagcgcgccccaccucgacaaggugaacggcaucuccgagcuggagaacgagaaggucuacgacgacggcgccccggagugcgggaucacgugcugguucaagaaguccggcgagugggugauggggaucaucaacggcaacugggugguccugaucgugcucugcgugcugcuccuguucagccugauccugcucagcauccugugccccguccggaagcacaagaaguccuga

SEQ ID NO: 11883 - RNA, 3423 nt, Artificial Sequence
  derived and/or modified CDS sequence (opt1) from SNV(NM H10)__NC_005215.1__GP
auggugggcugggucugcaucuuccugguggugcucaccaccgccacggccgggcugacccgcaaccuguacgagcucaagaucgagugcccccacaccgucggccuggggcagggcuacgugaccgggagcguggagaucacgcccauccugcucacccaggucgcggaccugaagaucgaguccagcugcaacuucgaccugcacgugcccgccaccaccacgcagaaguacaaccagguggacuggaccaagaaguccagcaccaccgaguccacgaacgccggcgccaccaccuucgaggccaagaccaaggagaucaaccucaagggcacgugcaacaucccgcccaccaccuucgaggcggccuacaagagccggaagaccgucaucugcuacgaccuggccugcaaccagacgcacugccugcccaccgugcaccucaucgcccccgugcagaccugcauguccguccgcagcugcaugaucgggcugcuguccagccggauccaggugaucuacgagaagaccuacugcgugacgggccagcucaucgaggggcugugcuucauccccacccacaccaucgcgcugacccagcccggccacacguacgacaccaugacccucccggugaccugcuuccugguggccaagaagcuggggacgcagcucaagcuggccguggagcuggagaagcucaucaccggcgucuccugcaccgagaacagcuuccagggcuacuacaucugcuucaucgggaagcacuccgagccccuguucgugcccaccauggaggacuaccgcagcgccgagcuguucacgcggauggugcucaacccccgcggcgaggaccacgacccggaccagaacgggcagggccugaugcggaucgccggccccgucaccgcgaaggugcccuccaccgagaccaccgagacgaugcaggggaucgccuucgccggcgcccccauguacagcuccuucagcacccuggugcgcaaggccgacccggaguacgucuucucccccgggaucaucgcggagagcaaccacagcgugugcgacaagaagaccgucccccucaccuggacgggcuuccuggccguguccggggagaucgagaagaucaccggcugcaccguguucugcacccuggccggccccggggccagcugcgaggccuacuccgagacgggcaucuucaacaucagcuccccgaccugccucgucaacaaggugcagaaguuccgggggagcgagcagcgcaucaacuucaugugccagcggguggaccaggacgucgugguguacugcaacggccagaagaaggucauccugaccaagacccuggugaucgggcagugcaucuacacguucaccucccucuucagccugauccccggcguggcgcacucccuggccgucgagcucugcgugcccggccugcacgggugggccaccaccgcccugcucaucacguucugcuucggcuggcugcugauccccgccgugacccucaucauccugaagauccugcgccuccugaccuucagcugcucccacuacagcaccgaguccaaguucaaggucauccuggagcgggugaagguggaguaccagaagacgauggggagcauggucugcgacaucugccaccacgagugcgagaccgcgaaggagcuggagacccacaagaaguccugcccggagggccagugccccuacugcaugaccaucacggagagcaccgaguccgcccuccaggcccacuucgccaucugcaagcugaccaaccgcuuccaggagaaccugaagaagucccucaagcggcccgaggugcgcaaggggugcuaccggacccugggcguguuccgcuacaagagccggugcuacgucggccuggugugggggauccuccugacgaccgagcugaucaucugggcggccagcgccgacacgccccucauggagagcggcugguccgacaccgcccacggggugggcaucaucccgaugaagaccgaccuggagcuggacuucgcccucgcgagcuccagcuccuacagcuaccgccggaagcuggucaaccccgccaaccaggaggagacccugcccuuccacuuccagcucgacaagcaggucgugcacgccgagauccagaaccugggccacuggauggacgggaccuucaacaucaagaccgccuuccacugcuacggcgagugcaagaaguacgccuacccguggcagacggcgaagugcuucuucgagaaggacuaccaguacgagaccuccugggggugcaacccgcccgacugccccggcgucgggaccggcugcaccgccugcggcguguaccuggacaagcuccgcagcguggggaaggccuacaagaucgucucccugaaguacacccgcaaggugugcauccagcugggcacggagcagaccugcaagcacaucgacgugaacgacugccucgucacccccagcgugaaggugugcaugaucgggaccaucuccaagcugcagcccggcgacacgcuccuguuccuggggccccuggagcagggcggcaucauccucaagcaguggugcaccaccagcugcgucuucggggaccccggcgacaucauguccaccacgagcgggaugcggugcccggagcacaccggcuccuuccgcaagaucugcggguucgccaccacccccacgugcgaguaccagggcaacaccgugagcggcuuccagcggaugauggccacccgcgacuccuuccagagcuucaacgugaccgagccccacaucacgagcaaccggcuggaguggaucgaccccgacuccagcaucaaggaccacaucaacaugguccugaaccgcgacguguccuuccaggaccucagcgacaacccgugcaagguggaccugcacacccaguccaucgacggggcguggggcagcggggucggcuucacccuggugugcaccguggggcucacggagugcgccaacuucaucaccuccaucaaggccugcgacagcgccaugugcuacggcgcgaccgucaccaaccugcugcggggcuccaacacggugaagguggucgggaagggcgggcacagcggcucccucuucaagugcugccacgacaccgacugcaccgaggagggccuggccgccagcccgccccaccuggaccgcgugaccggguacaaccagaucgacuccgacaagguguacgacgacggcgccccgcccugcacgaucaagugcugguucaccaagagcggggaguggcuccugggcauccugaacgggaacugggucguggucgccgugcucaucgugauccugauccuguccauccuccuguucagcuucuucugccccguccggucccgcaagaacaaggcgaacuga

SEQ ID NO: 11884 - RNA, 3423 nt, Artificial Sequence
  derived and/or modified CDS sequence (opt1) from SNV(1)__JQ690283.1__GP
auggugggcugggucugcaucuuccugguggugcucaccaccgccacggccgggcugacccgcaaccuguacgagcucaagaucgagugcccccacaccgucggccuggggcagggcuacgugaccgggagcguggagacgacccccauccugcucacccaggucgcggaccugaagaucgaguccagcugcaacuucgaccugcacgugcccgccaccacgacccagaaguacaaccagguggacuggaccaagaaguccagcaccacggaguccaccaacgccggcgccgccaccuucgaggcgaagaccaaggaggucaaccucaagggcacgugcaacaucccgcccaccaccuucgaggccgccuacaagagccggaagaccgugaucugcuacgaccuggccugcaaccagacgcacugccugcccaccgugcaccucaucgcgcccguccagaccugcauguccgugcgcagcugcaugaucgggcugcuguccagccggauccaggugaucuacgagaagaccuacugcgucacgggccagcucaucgaggggcugugcuucauccccacccacaccaucgcccugacccagcccggccacacguacgacaccaugacccucccggugaccugcuuccugguggccaagaagcuggggacgcagcucaagcuggccgucgagcuggagaagcucaucaccggcguguccugcaccgagaacagcuuccagggcuacuacaucugcuucaucgggaagcacuccgagccccuguucgugcccaccauggaggacuaccgcagcgccgagcuguucacgcggaugguccucaacccccgcggcgaggaccacgacccggaccagaacgggcagggccugaugcggaucgcgggccccgugaccgccaaggugcccuccaccgagaccaccgagacgaugcaggggaucgccuucgccggcgcccccauguacagcuccuucagcacccugguccgcaaggcggacccggaguacguguucucccccgggaucaucgccgagagcaaccacagcgucugcgacaagaagaccgugccccucaccuggacgggcuuccuggccguguccggggagaucgagcggaucaccggcugcaccgucuucugcacccuggccggccccggggccagcugcgaggcguacuccgagacgggcaucuucaacaucagcuccccgaccugccucgugaacaaggugcagaaguuccgcgggagcgagcagcggaucaacuucaugugccagcgcgucgaccaggacgugguggucuacugcaacggccagaagaaggugauccugaccaagacccuggugaucgggcagugcaucuacacguucaccucccucuucagccugauccccggcgucgcccacucccuggccguggagcucugcgugcccggccugcacgggugggccaccaccgcccugcucaucacguucugcuucggcuggcugcugauccccaccgucacccucaucauccugaaggugcugcggcuccugaccuucagcugcucccacuacagcacggaguccaaguucaaggugauccuggagcgcgucaagguggaguaccagaagaccauggggagcauggugugcgacaucugccaccacgagugcgagaccgcgaaggagcuggagacccacaagaaguccugcccggagggccagugccccuacugcaugacgaucaccgagagcaccgaguccgcccuccaggcccacuucagcaucugcaagcugaccaaccgguuccaggagaaccugaagaagucccucaagcgccccgagguccggaaggggugcuaccgcacgcugggcguguuccgguacaagagccgcugcuacgugggccuggucugggggauccuccugaccaccgagcugaucaucugggccgcgagcgccgacacgccccucauggaguccggcuggagcgacaccgcccacggggugggcaucaucccgaugaagaccgaccuggagcuggacuucgcccucgccuccagcuccagcuacuccuaccggcgcaagcuggugaaccccgcgaaccaggaggagacccugcccuuccacuuccagcucgacaagcaggucgugcacgccgagauccagaaccugggccacuggauggacgggaccuucaacaucaagacggccuuccacugcuacggcgagugcaagaaguacgccuacccguggcagaccgccaagugcuucuucgagaaggacuaccaguacgagaccagcugggggugcaacccgcccgacugccccggcguggggaccggcugcaccgcgugcggcgucuaccuggacaagcuccgcuccguggggaaggccuacaagaucgugagccugaaguacacgcggaaggucugcauccagcugggcaccgagcagaccugcaagcacaucgacgugaacgacugccucgugacccccuccgucaaggugugcaugaucgggacgaucagcaagcugcagcccggcgacacccuccuguuccuggggccccuggagcagggcggcaucauccucaagcaguggugcaccaccuccugcguguucggggaccccggcgacaucaugagcacgaccuccgggaugcgcugcccggagcacaccggcagcuuccggaagaucugcggguucgccaccacgccgaccugcgaguaccagggcaacaccgucuccggcuuccagcgcaugauggccacccgggacagcuuccagagcuucaacgugacggagccccacaucaccuccaaccgccuggaguggaucgaccccgacagcuccaucaaggaccacaucaacauggugcugaaccgggacgucagcuuccaggaccucuccgacaaccccugcaagguggaccugcacacccagagcaucgacggggccuggggcuccggggugggcuucacccuggucugcacgguggggcucaccgagugcgcgaacuucaucaccagcaucaaggccugcgacuccgccaugugcuacggcgccaccgugacgaaccugcugcgcggcagcaacaccgucaaggugguggggaagggcgggcacuccggcagccucuucaagugcugccacgacaccgacugcaccgaggagggccuggcggccuccccgccccaccuggaccgggucacgggguacaaccagaucgacagcgacaagguguacgacgacggcgccccgcccugcaccaucaagugcugguucaccaaguccggggaguggcuccugggcauccugaacgggaacugggucgugguggccguccucaucgugauccugauccugagcauccuccuguucuccuucuucugccccgugcgcaaccggaagaacaaggccaacuga

SEQ ID NO: 11885 - RNA, 3423 nt, Artificial Sequence
  derived and/or modified CDS sequence (opt1) from SNV(1)__JQ690279.1__GP
auggugggcugggucugcaucuuccugguggugcucaccaccgccacggccgggcugacccgcaaccuguacgagcucaagaucgagugcccccacaccgucggccuggggcagggcuacgugaccgggagcguggagacgacccccauccugcucacccaggucgcggaccugaagaucgaguccagcugcaacuucgaccugcacgugcccgccaccacgacccagaaguacaaccagguggacuggaccaagaaguccagcaccacggaguccaccaacgccggcgccaacaccuucgaggccaagaccaaggagaucaaccucaagggcacgugcaacaucccgcccaccaccuucgaggcggccuacaagagccggaagaccgucaucugcuacgaccuggccugcaaccagacgcacugccugcccaccgugcaccucaucgcccccgugcagaccugcauguccguccgcagcugcaugaucgggcugcuguccagccggauccaggugaucuacgagaagaccuacugcgugacgggccagcucaucgaggggcugugcuucauccccacccacaccaucgcgcugacccagcccggccacacguacgacaccaugacccucccggugaccugcuuccugguggccaagaagcuggggacgcagcucaagcuggccguggagcuggagaagcucaucaccggcgucuccugcaccgagaacagcuuccagggcuacuacaucugcuucaucgggaagcacuccgagccccuguucgugcccaccauggaggacuaccgcagcgccgagcuguucacgcggauggugcucaacccccgcggcgaggaccacgacccggaccagaacgggcagggccugaugcggaucgccggccccgucaccgcgaaggugcccuccaccgagaccaccgagacgaugcaggggaucgccuucgccggcgcccccauguacagcuccuucagcacccuggugcgcaaggccgacccggaguacgucuucucccccgggaucaucgcggagagcaaccacagcgugugcgacaagaagaccgucccccucaccuggacgggcuuccuggccguguccggggagaucgagcggaucaccggcugcaccguguucugcacccuggccggccccggggccagcugcgaggccuacuccgagacgggcaucuucaacaucagcuccccgaccugccucgucaacaaggugcagaaguuccgcgggagcgagcagcggaucaacuucaugugccagcgcguggaccaggacgucgugguguacugcaacggccagaagaaggucauccugaccaagacccuggugaucgggcagugcaucuacacguucaccucccucuucagccugauccccggcguggcgcacucccuggccgucgagcucugcgugcccggccugcacgggugggccaccaccgcccugcucaucacguucugcuucggcuggcugcugauccccaccgugacccuccugauccugaagauccuccggcugcugaccuucagcugcucccacuacagcacggaguccaaguucaaggucauccuggagcgcgugaagguggaguaccagaagaccauggggagcauggucugcgacaucugccaccacgagugcgagaccgccaaggagcucgagacccacaagaaguccugcccggagggccagugccccuacugcaugacgaucaccgagagcaccgaguccgcgcugcaggcccacuucagcaucugcaagcugaccaaccgguuccaggagaaccucaagaagucccugaagcgccccgaggugaagaaggggugcuaccggacgcugggcguguuccgcuacaagagccggugcuacgucggccucgugugggggauccugcugaccaccgagcucaucaucugggccgccagcgcggacacgccccugauggaguccggcuggagcgacaccgcccacggggugggcaucaucccgaugaaguccgaccuggagcucgacuucgcccuggccagcuccagcuccuacagcuaccgccggaagcuggucaaccccgccaaccaggaggagacccuccccuuccacuuccagcuggacaagcaggucgugcacgcggagauccagaaccugggccacuggauggacgggaccuucaacaucaagaccgccuuccacugcuacggcgagugcaagaaguacgccuacccguggcagacggccaagugcuucuucgagaaggacuaccaguacgagaccuccugggggugcaacccgcccgacugccccggcgucgggaccggcugcaccgccugcggcguguaccucgacaagcugcgcagcguggggaaggcguacaagaucgucucccugaaguacacccgcaaggugugcauccagcucggcacggagcagaccugcaagcacaucgacgugaacgacugccuggucacccccagcgugaaggugugcaugaucgggaccaucuccaagcugcagcccggcgacacgcuccuguuccuggggccccucgagcagggcggcaucauccugaagcaguggugcaccaccagcugcgucuucggggaccccggcgacaucauguccaccacgagcgggaugcggugcccggagcacaccggcuccuuccgcaagaucugcggguucgccaccacccccacgugcgaguaccagggcaacaccgugagcggcuuccagcggaugauggccacccgcgacagcuuccaguccuucaacgugaccgagccccacaucacgagcaaccggcuggaguggaucgaccccgacuccagcaucaaggaccacaucaacaugauccucaaccgcgacgucuccuuccaggaccugagcgacaacccgugcaagguggaccugcacacccaguccaucgacggggccuggggcagcggggugggcuucacccucgucugcaccguggggcugacggagugcgccaacuucaucaccuccaucaaggcgugcgacagcgccaugugcuacggcgccaccgugaccaaccugcuccggggcuccaacacggucaaggugguggggaagggcgggcacagcggcucccuguucaagugcugccacgacaccgacugcaccgaggagggccuggccgcgagcccgccccaccucgaccgcgucaccggguacaaccagaucgacuccgacaagguguacgacgacggcgccccgcccugcacgaucaagugcugguucaccaagagcggggaguggcugcugggcauccucaacgggaacuggguggucguggccguccugaucgugauccugauccucuccauccugcuguucagcuucuucugccccgugcggucccgcaagaacaaggccaacuga

SEQ ID NO: 11886 - RNA, 3423 nt, Artificial Sequence
  derived and/or modified CDS sequence (opt1) from SNV(2)__JQ690284.1__GP
auggugggcugggucugcaucuuccugguggugcucaccaccgccacggccgggcugacccgcaaccuguacgagcucaagaucgagugcccccacaccgucggccuggggcagggcuacgugaccgggagcguggagacgacccccauccugcucacccaggucgcggaccugaagaucgaguccagcugcaacuucgaccugcacgugcccgccaccacgacccagaaguacaaccagguggacuggaccaagaagggcuccaccacggagagcaccaacgccggcgccaacaccuucgaggccaagaccaaggaggucaaccucaaggggacgugcaacaucccgcccaccaccuucgaggcggccuacaagucccggaagaccgugaucugcuacgaccuggccugcaaccagacgcacugccugcccaccgugcaccucaucgcccccguccagaccugcaugagcgugcgcuccugcaugaucggccugcugagcucccggauccaggugaucuacgagaagaccuacugcgucacggggcagcucaucgagggccugugcuucauccccacccacaccaucgcgcugacccagcccgggcacacguacgacaccaugacccucccggugaccugcuuccugguggccaagaagcugggcacgcagcucaagcuggccgucgagcuggagaagcucaucaccggcgugagcugcaccgagaacuccuuccagggguacuacaucugcuucaucggcaagcacagcgagccccuguucgugcccaccauggaggacuaccgcuccgccgaggucuucacgcggauggugcugaacccccgcggggaggaccacgacccggaccagaacggccagggccucaugcggaucgccgggcccgugaccgcgaagguccccagcaccgagaccaccgagacgaugcagggcaucgccuucgccggggcccccauguacuccagcuucuccacccuggugcgcaaggccgacccggaguacgucuucagccccggcaucaucgcggaguccaaccacagcgugugcgacaagaagaccgugccccugaccuggacgggguuccucgccgucagcggcgagaucgagcggaucaccggcugcaccguguucugcacccuggccgggcccggcgccuccugcgaggccuacagcgagacggggaucuucaacaucuccagcccgaccugccuggugaacaagguccagaaguuccgcggcuccgagcagcggaucaacuucaugugccagcgcguggaccaggacguggucguguacugcaacgggcagaagaaggugauccucaccaagacccuggucaucggccagugcaucuacacguucaccagccuguucucccucauccccggcguggcgcacagccuggccguggagcugugcguccccgggcuccacggcugggccaccaccgcccugcugaucacguucugcuucggguggcuccugauccccaccgugacccugaucauccucaagauccugcggcugcucaccuucuccugcagccacuacuccacggagagcaaguucaaggugauccuggagcgcgucaagguggaguaccagaagaccaugggcuccauggugugcgacaucugccaccacgagugcgagaccgccaaggagcuggagacccacaagaaguccugcccggaggggcagugccccuacugcaugacgaucaccgagagcaccgagagcgcgcugcaggcccacuucuccaucugcaagcucaccaaccgguuccaggagaaccugaagaagucccugaagcgccccgaggucaagaagggcugcuaccggacgcucggcguguuccgcuacaagagccggugcuacguggggcuggucuggggcauccugcucaccaccgagcugaucaucugggccgccagcgcggacacgccccugauggagagcgggugguccgacaccgcccacggcgugggcaucaucccgaugaagaccgaccucgagcuggacuucgcccuggccagcuccagcuccuacagcuaccgccggaagcucgugaaccccgccaaccaggaggagacccugcccuuccacuuccagcuggacaagcaggucgugcacgcggagauccagaaccucgggcacuggauggacggcaccuucaacaucaagacggccuuccacugcuacggggagugcaagaaguacgccuacccguggcagaccgccaagugcuucuucgagaaggacuaccaguacgagaccuccuggggcugcaacccgcccgacugccccggggugggcaccggcugcaccgccugcggggucuaccuggacaagcugcgcagcgugggcaaggcguacaagaucgugucccucaaguacacgcgcaaggucugcauccagcuggggaccgagcagaccugcaagcacaucgacgugaacgacugccuggugacccccagcgucaaggugugcaugaucggcacgaucuccaagcuccagcccggggacacccugcuguuccucggcccccuggagcagggcgggaucauccugaagcaguggugcaccaccagcugcguguucggcgaccccggggacaucauguccacgaccagcggcaugcggugcccggagcacaccggguccuuccgcaagaucugcggcuucgccaccacgccgaccugcgaguaccagggcaacaccgucagcggguuccagcggaugauggccacccgcgacuccuuccagagcuucaacgugacggagccccacaucaccagcaaccggcucgaguggaucgaccccgacuccagcaucaaggaccacaucaacauggugcugaaccgcgacgucuccuuccaggaccugagcgacaaccccugcaagguggaccuccacacccaguccaucgacggcgccugggggagcggcgugggguucacccuggucugcacggugggccugaccgagugcgccaacuucaucaccuccaucaaggcgugcgacagcgccaugugcuacggcgccaccgugacgaaccuccugcggggguccaacaccgucaagguggugggcaagggcgggcacagcggcucccuguucaagugcugccacgacaccgacugcaccgaggaggggcucgccgcgagcccgccccaccuggaccgcgucacgggcuacaaccagaucgacuccgacaagguguacgacgacggggccccgcccugcaccaucaagugcugguucaccaagagcggcgaguggcugcucgggauccugaacggcaacugggucgugguggccguccugaucgugauccucauccuguccauccuccuguucagcuucuucugccccgugcggucccgcaagaacaaggccaacuga

SEQ ID NO: 11887 - RNA, 3423 nt, Artificial Sequence
  derived and/or modified CDS sequence (opt1) from SNV(2)__JQ690280.1__GP
auggugggcugggucugcaucuuccugguggugcucaccaccgccacggccgggcugacccgcaaccuguacgagcucaagaucgagugcccccacaccgucggccuggggcagggcuacgugaccgggagcguggagacgacccccauccugcucacccaggucgcggaccugaagaucgaguccagcugcaacuucgaccugcacgugcccgccaccacgacccagaaguacaaccagguggacuggaccaagaaguccagcaccacggaguccaccaacgccggcgccaacaccuucgaggccaagaccaaggaggucaaccucaagggcacgugcaacaucccgcccaccaccuucgaggcggccuacaagagccggaagaccgugaucugcuacgaccuggccugcaaccagacgcacugccugcccaccgugcaccucaucgcccccguccagaccugcauguccgugcgcagcugcaugaucgggcugcuguccagccggauccaggugaucuacgagaagaccuacugcgucacgggccagcucaucgaggggcugugcuucauccccacccacaccaucgcgcugacccagcccggccacacguacgacaccaugacccucccggugaccugcuuccugguggccaagaagcuggggacgcagcucaagcuggccgucgagcuggagaagcucaucaccggcguguccugcaccgagaacagcuuccagggcuacuacaucugcuucaucgggaagcacuccgagccccuguucgugcccaccauggaggacuaccgcagcgccgagcuguucacgcggaugguccucaacccccgcggcgaggaccacgacccggaccagaacgggcagggccugaugcggaucgccggccccgugaccgcgaaggugcccuccaccgagaccaccgagacgaugcaggggaucgccuucgccggcgcccccauguacagcuccuucagcacccugguccgcaaggccgacccggaguacguguucucccccgggaucaucgcggagagcaaccacagcgucugcgacaagaagaccgugccccucaccuggacgggcuuccuggccguguccggggagaucgagcggaucaccggcugcaccgucuucugcacccuggccggccccggggccagcugcgaggccuacuccgagacgggcaucuucaacaucagcuccccgaccugccucgugaacaaggugcagaaguuccgcgggagcgagcagcggaucaacuucaugugccagcgcgucgaccaggacgugguggucuacugcaacggccagaagaaggugauccugaccaagacccuggugaucgggcagugcaucuacacguucaccucccucuucagccugauccccggcgucgcgcacucccuggccguggagcucugcgugcccggccugcacgggugggccaccaccgcccugcucaucacguucugcuucggcuggcugcugauccccaccgucacccucaucauccugaagauccugcggcuccugaccuucagcugcucccacuacagcacggaguccaaguucaaggugauccuggagcgcgugaaggucgaguaccagaagaccauggggagcauggugugcgacaucugccaccacgagugcgagaccgccaaggagcuggagacccacaagaaguccugcccggagggccagugccccuacugcaugacgaucaccgagagcaccgaguccgcgcuccaggcccacuucagcaucugcaagcugaccaaccgguuccaggagaaccugaagaagucccucaagcgccccgaggugaagaaggggugcuaccggacgcugggcgucuuccgcuacaagagccggugcuacgugggccuggugugggggauccuccugaccaccgagcugaucaucugggccgccagcgcggacacgccccucauggaguccggcuggagcgacaccgcccacggggucggcaucaucccgaugaagaccgaccuggagcuggacuucgcccucgccuccagcuccagcuacuccuaccgccggaagcuggugaaccccgccaaccaggaggagacccugcccuuccacuuccagcucgacaagcaggucgugcacgcggagauccagaaccugggccacuggauggacgggaccuucaacaucaagacggccuuccacugcuacggcgagugcaagaaguacgccuacccguggcagaccgccaagugcuucuucgagaaggacuaccaguacgagaccagcugggggugcaacccgcccgacugccccggcguggggaccggcugcaccgccugcggcguguaccuggacaagcuccgcuccgucgggaaggcguacaagaucgugagccugaaguacacgcgcaaggugugcauccagcugggcaccgagcagaccugcaagcacaucgacgucaacgacugccucgugacccccuccgugaaggucugcaugaucgggacgaucagcaagcugcagcccggcgacacccuccuguuccuggggccccuggagcagggcggcaucauccucaagcaguggugcaccaccuccugcguguucggggaccccggcgacaucaugagcacgaccuccgggaugcggugcccggagcacaccggcagcuuccgcaagaucugcggguucgccaccacgccgaccugcgaguaccagggcaacaccguguccggcuuccagcggaugauggccacccgcgacagcuuccagagcuucaacgucacggagccccacaucaccuccaaccggcuggaguggaucgaccccgacagcuccaucaaggaccacaucaacauggugcugaaccgcgacgugagcuuccaggaccucuccgacaaccccugcaaggucgaccugcacacccagagcaucgacggggccuggggcuccggggugggcuucacccuggugugcacggucgggcucaccgagugcgccaacuucaucaccagcaucaaggcgugcgacuccgccaugugcuacggcgccaccgugacgaaccugcugcggggcagcaacaccgugaaggucguggggaagggcgggcacuccggcagccucuucaagugcugccacgacaccgacugcaccgaggagggccuggccgcguccccgccccaccuggaccgcgugacgggguacaaccagaucgacagcgacaaggucuacgacgacggcgccccgcccugcaccaucaagugcugguucaccaaguccggggaguggcuccugggcauccugaacgggaacuggguggucguggccgugcucaucgucauccugauccugagcauccuccuguucuccuucuucugccccgugcggagccgcaagaacaaggccaacuga

SEQ ID NO: 11888 - RNA, 3423 nt, Artificial Sequence
  derived and/or modified CDS sequence (opt1) from SNV(CC107/POR)__KT885045.1__GP
auggugggcugggucugcaucuuccugguggugcucaccaccgccacggccgggcugacccgcaaccuguacgagcucaagaucgagugcccccacaccgucggccuggggcagggcuacgugaccgggagcguggagacgacccccauccugcucacccaggucgcggaccugaagaucgaguccagcugcaacuucgaccugcacgugcccgccaccacgacccagaaguacaaccagguggacuggaccaagaaguccagcaccacggaguccaccaacgccggcgccaccaccuucgaggccaagacgaaggaggucaaccucaaggggaccugcaacaucccgcccaccaccuucgaggcggccuacaagagccggaagacggugaucugcuacgaccuggccugcaaccagacccacugccugcccaccgugcaccucaucgcccccguccagaccugcauguccgugcgcagcugcaugaucggccugcuguccagccggauccaggugaucuacgagaagacguacugcgucaccggccagcucaucgaggggcugugcuucauccccacccacaccaucgcgcugacgcagcccggccacaccuacgacaccaugacccucccggugacgugcuuccugguggccaagaagcuggggacccagcucaagcuggccgucgagcuggagaagcucaucaccggcguguccugcaccgagaacagcuuccagggcuacuacaucugcuucaucgggaagcacuccgagccccuguucgugcccacgauggaggacuaccgcagcgccgagcuguucacccggaugguccucaacccccgcggcgaggaccacgacccggaccagaacgggcagggccugaugcggaucgccggccccgugaccgcgaaggugcccuccaccgagaccacggagaccaugcaggggaucgccuucgccggcgcccccauguacagcuccuucagcacccugguccgcaaggccgacccggaguacguguucucccccgggaucaucgcggagagcaaccacagcgucugcgacaagaagaccgugccccucacguggaccggcuuccuggccguguccggggagaucgagcggaucaccggcugcaccgucuucugcacgcuggccggccccggggccagcugcgaggccuacuccgagaccggcaucuucaacaucagcuccccgaccugccucgugaacaaggugcagaaguuccgcgggagcgagcagcggaucaacuucaugugccagcgcgucgaccaggacgugguggucuacugcaacggccagaagaaggugauccugaccaagacgcuggugaucgggcagugcaucuacaccuucaccucccucuucagccugauccccggcgucgcgcacucccuggccguggagcucugcgugcccggccugcacgggugggccaccacggcccugcucaucaccuucugcuucggcuggcugcugauccccaccgucacccucaucauccugaagauccugcggcuccugacguucagcugcucccacuacagcaccgaguccaaguucaaggugauccuggagcgcgugaaggucgaguaccagaagaccauggggagcauggugugcgacaucugccaccacgagugcgagaccgccaaggagcuggagacgcacaagaaguccugcccggagggccagugccccuacugcaugaccaucaccgagagcaccgaguccgcgcuccaggcccacuucagcaucugcaagcugacgaaccgguuccaggagaaccugaagaagucccucaagcgccccgaggugcggaaggggugcuaccgcacccugggcgucuuccgguacaagagccgcugcuacgugggccuggugugggggauccuccugaccaccgagcugaucaucugggccgccagcgcggacacgccccucauggaguccggcuggagcgacaccgcccacggggucggcaucgugccgaugaagaccgaccuggagcuggacuucgcccucgccuccagcuccagcuacuccuaccggcgcaagcuggugaaccccgccaaccaggaggagacccugcccuuccacuuccagcucgacaagcaggucgugcacgcggagauccagaaccugggccacuggauggacgggacguucaacaucaagaccgccuuccacugcuacggcgagugcaagaaguacgccuacccguggcagaccgccaagugcuucuucgagaaggacuaccaguacgagaccagcugggggugcaacccgcccgacugccccggcguggggaccggcugcacggccugcggcgucuaccuggacaagcuccgcuccguggggaaggcguacaagaucgugagccugaaguacacccggaaggucugcauccagcugggcaccgagcagaccugcaagcacaucgacgugaacgacugccucgugacgcccuccgucaaggugugcaugaucgggaccaucagcaagcugcagcccggcgacacccuccuguuccuggggccccuggagcagggcggcaucauccucaagcaguggugcaccacguccugcguguucggggaccccggcgacaucaugagcaccaccuccgggaugcgcugcccggagcacaccggcagcuuccggaagaucugcggguucgccacgaccccgaccugcgaguaccagggcaacaccgucuccggcuuccagcgcaugauggccacgcgggacagcuuccagagcuucaacgugaccgagccccacaucaccuccaaccgccuggaguggaucgaccccgacagcuccaucaaggaccacaucaacauggugcugaaccgggacgucagcuuccaggaccucuccgacaaccccugcaagguggaccugcacacccagagcaucgacggggccuggggcuccggggugggcuucacgcuggucugcaccguggggcucaccgagugcgccaacuucaucaccagcaucaaggcgugcgacuccgccaugugcuacggcgccacggugaccaaccugcugcgcggcagcaacaccgucaaggugguggggaagggcgggcacuccggcagccucuucaagugcugccacgacaccgacugcacggaggagggccuggccgcguccccgccccaccuggaccgggucaccggguacaaccagaucgacagcgacaagguguacgacgacggcgccccgcccugcaccaucaagugcugguucaccaaguccggggaguggcuccugggcauccugaacgggaacugggucgugguggccguccucaucgugauccugauccugagcauccuccuguucuccuucuucugccccgugcgcaaccggaagaacaaggccaacuga

SEQ ID NO: 11889 - RNA, 3423 nt, Artificial Sequence
  derived and/or modified CDS sequence (opt1) from HPS(Convict Creek 107)__L33474.1__GP
auggugggcugggucugcaucuuccugguggugcucaccaccgccacggccgggcugacccgcaaccuguacgagcucaagaucgagugcccccacaccgucggccuggggcagggcuacgugaccgggagcguggagacgacccccauccugcucacccaggucgcggaccugaagaucgaguccagcugcaacuucgaccugcacgugcccgccaccacgacccagaaguacaaccagguggacuggaccaagaaguccagcaccacggaguccaccaacgccggcgccaccaccuucgaggccaagacgaaggaggucaaccucaaggggaccugcaacaucccgcccaccaccuucgaggcggccuacaagagccggaagacggugaucugcuacgaccuggccugcaaccagacccacugccugcccaccgugcaccucaucgcccccguccagaccugcauguccgugcgcagcugcaugaucggccugcuguccagccggauccaggugaucuacgagaagacguacugcgucaccggccagcucaucgaggggcugugcuucauccccacccacaccaucgcgcugacgcagcccggccacaccuacgacaccaugacccucccggugacgugcuuccugguggccaagaagcuggggacccagcucaagcuggccgucgagcuggagaagcucaucaccggcguguccugcaccgagaacagcuuccagggcuacuacaucugcuucaucgggaagcacuccgagccccuguucgugcccacgauggaggacuaccgcagcgccgagcuguucacccggaugguccucaacccccgcggcgaggaccacgacccggaccagaacgggcagggccugaugcggaucgccggccccgugaccgcgaaggugcccuccaccgagaccacggagaccaugcaggggaucgccuucgccggcgcccccauguacagcuccuucagcacccugguccgcaaggccgacccggaguacguguucucccccgggaucaucgcggagagcaaccacagcgucugcgacaagaagaccgugccccucacguggaccggcuuccuggccguguccggggagaucgagcggaucaccggcugcaccgucuucugcacgcuggccggccccggggccagcugcgaggccuacuccgagaccggcaucuucaacaucagcuccccgaccugccucgugaacaaggugcagaaguuccgcgggagcgagcagcggaucaacuucaugugccagcgcgucgaccaggacgugguggucuacugcaacggccagaagaaggugauccugaccaagacgcuggugaucgggcagugcaucuacaccuucaccucccucuucagccugauccccggcgucgcgcacucccuggccguggagcucugcgugcccggccugcacgggugggccaccacggcccugcucaucaccuucugcuucggcuggcugcugauccccaccgucacccucaucauccugaagauccugcggcuccugacguucagcugcucccacuacagcaccgaguccaaguucaaggugauccuggagcgcgugaaggucgaguaccagaagaccauggggagcauggugugcgacaucugccaccacgagugcgagaccgccaaggagcuggagacgcacaagaaguccugcccggagggccagugccccuacugcaugaccaucaccgagagcaccgaguccgcgcuccaggcccacuucagcaucugcaagcugacgaaccgguuccaggagauccugaagaagucccucaagcgccccgaggugcggaaggggugcuaccgcacccugggcgucuuccgguacaagagccgcugcuacgugggccuggugugggggauccuccugaccaccgagcugaucaucugggccgccagcgcggacacgccccucauggaguccggcuggagcgacaccgcccacggggucggcaucgugccgaugaagaccgaccuggagcuggacuucgcccucgccuccagcuccagcuacuccuaccggcgcaagcuggugaaccccgccaaccaggaggagacccugcccuuccacuuccagcucgacaagcaggucgugcacgcggagauccagaaccugggccacuggauggacgggacguucaacaucaagaccgccuuccacugcuacggcgagugcaagaaguacgccuacccguggcagaccgccaagugcuucuucgagaaggacuaccaguacgagaccagcugggggugcaacccgcccgacugccccggcguggggaccggcugcacggccugcggcgucuaccuggacaagcuccgcuccguggggaaggcguacaagaucgugagccugaaguacacccggaaggucugcauccagcugggcaccgagcagaccugcaagcacaucgacgugaacgacugccucgugacgcccuccgucaaggugugcaugaucgggaccaucagcaagcugcagcccggcgacacccuccuguuccuggggccccuggagcagggcggcaucauccucaagcaguggugcaccacguccugcguguucggggaccccggcgacaucaugagcaccaccuccgggaugcgcugcccggagcacaccggcagcuuccggaagaucugcggguucgccacgaccccgaccugcgaguaccagggcaacaccgucuccggcuuccagcgcaugauggccacgcgggacagcuuccagagcuucaacgugaccgagccccacaucaccuccaaccgccuggaguggaucgaccccgacagcuccaucaaggaccacaucaacauggugcugaaccgggacgucagcuuccaggaccucuccgacaaccccugcaagguggaccugcacacccagagcaucgacggggccuggggcuccggggugggcuucacgcuggucugcaccguggggcucaccgagugcgccaacuucaucaccagcaucaaggcgugcgacuccgccaugugcuacggcgccacggugaccaaccugcugcgcggcagcaacaccgucaaggugguggggaagggcgggcacuccggcagccucuucaagugcugccacgacaccgacugcacggaggagggccuggccgcguccccgccccaccuggaccgggucaccggguacaaccagaucgacagcgacaagguguacgacgacggcgccccgcccugcaccaucaagugcugguucacccgcuccggggaguggcuccugggcauccugaacgggaacugggucgugguggccguccucaucgugauccugauccugagcauccuccuguucuccuucuucugccccgugcggaaccgcaagaacaaggccaacuga

SEQ ID NO: 11890 - RNA, 3423 nt, Artificial Sequence
  derived and/or modified CDS sequence (opt1) from HPS(Convict Creek 74)__L33684.1__GP
auggugggcugggucugcaucuuccugguggugcucaccaccgccacggccgggcugacccgcaaccuguacgagcucaagaucgagugcccccacaccgucggccuggggcagggcuacgugaccgggagcguggagacgacccccauccugcucacccaggucgcggaccugaagaucgaguccagcugcaacuucgaccugcacgugcccgccaccacgacccagaaguacaaccagguggacuggaccaagaaguccagcaccacggaguccaccaacgccggcgccaccaccuucgaggccaagacgaaggaggucaaccucaaggggaccugcaacaucccgcccaccaccuucgaggcggccuucaagagccggaagacggugaucugcuacgaccuggccugcaaccagacccacugccugcccaccgugcaccucaucgcccccguccagaccugcauguccgugcgcagcugcaugaucggccugcuguccagccggauccaggugaucuacgagaagacguacugcgucaccggccagcucaucgaggggcugugcuucauccccacccacaccaucgcgcugacgcagcccggccacaccuacgacaccaugacccucccggugacgugcuuccugguggccaagaagcuggggacccagcucaagcuggccgucgagcuggagaagcucaucaccggcguguccugcaccgagaacagcuuccagggcuacuacaucugcuucaucgggaagcacuccgagccccuguucgugcccacgauggaggacuaccgcagcgccgagcuguucacccggaugguccucaacccccgcggcgaggaccacgacccggaccagaacgggcagggccugaugcggaucgccggccccgugaccgcgaaggugcccuccaccgagaccacggagaccaugcaggggaucgccuucgccggcgcccccauguacagcuccuucagcacccugguccgcaaggccgacccggaguacguguucucccccgggaucaucgcggagagcaaccacagcgucugcgacaagaagaccgugccccucacguggaccggcuuccuggccguguccggggagaucgagcggaucaccggcugcaccgucuucugcacgcuggccggccccggggccagcugcgaggccuacuccgagaccggcaucuucaacaucagcuccccgaccugccucgugaacaaggugcagaaguuccgcgggagcgagcagcggaucaacuucaugugccagcgcgucgaccaggacgugguggucuacugcaacggccagaagaaggugauccugaccaagacgcuggugaucgggcagugcaucuacaccuucaccucccucuucagccugauccccggcgucgcgcacucccuggccguggagcucugcgugcccggccugcacgggugggccaccacggcccugcucaucaccuucugcuucggcuggcugcugauccccaccgucacccucaucauccugaagauccugcggcuccugacguucagcugcucccacuacagcaccgaguccaaguucaaggugauccuggagcgcgugaaggucgaguaccagaagaccauggggagcauggugugcgacaucugccaccacgagugcgagaccgccaaggagcuggagacgcacaagaaguccugcccggagggccagugccccuacugcaugaccaucaccgagagcaccgaguccgcgcuccaggcccacuucagcaucugcaagcugacgaaccgguuccaggagauccugaagaagucccucaagcgccccgaggugcggaaggggugcuaccgcacccugggcgucuuccgguacaagagccgcugcuacgugggccuggugugggggauccuccugaccaccgagcugaucaucugggccgccagcgcggacacgccccucauggaguccggcuggagcgacaccgcccacggggucggcaucgugccgaugaagaccgaccuggagcuggacuucgcccucgccuccagcuccagcuacuccuaccggcgcaagcuggugaaccccgccaaccaggaggagacccugcccuuccacuuccagcucgacaagcaggucgugcacgcggagauccagaaccugggccacuggauggacgggacguucaacaucaagaccgccuuccacugcuacggcgagugcaagaaguacgccuacccguggcagaccgccaagugcuucuucgagaaggacuaccaguacgagaccagcugggggugcaacccgcccgacugccccggcguggggaccggcugcacggccugcggcgucuaccuggacaagcuccgcuccguggggaaggcguacaagaucgugagccugaaguacacccggaaggucugcauccagcugggcaccgagcagaccugcaagcacaucgacgugaacgacugccucgugacgcccuccgucaaggugugcaugaucgggaccaucagcaagcugcagcccggcgacacccuccuguuccuggggccccuggagcagggcggcaucauccucaagcaguggugcaccacguccugcguguucggggaccccggcgacaucaugagcaccaccuccgggaugcgcugcccggagcacaccggcagcuuccggaagaucugcggguucgccacgaccccgaccugcgaguaccagggcaacaccgucuccggcuuccagcgcaugauggccacgcgggacagcuuccagagcuucaacgugaccgagccccacaucaccuccaaccgccuggaguggaucgaccccgacagcuccaucaaggaccacaucaacauggugcugaaccgggacgucagcuuccaggaccucuccgacaaccccugcaagguggaccugcacacccagagcaucgacggggccuggggcuccggggugggcuucacgcuggucugcaccguggggcucaccgagugcgccaacuucaucaccagcaucaaggcgugcgacuccgccaugugcuacggcgccacggugaccaaccugcugcgcggcagcaacaccgucaaggugguggggaagggcgggcacuccggcagccucuucaagugcugccacgacaccgacugcacggaggagggccuggccgcguccccgccccaccuggaccgggucaccggguacaaccagaucgacagcgacaagguguacgacgacggcgccccgcccugcaccaucaagugcugguucaccaaguccggggaguggcuccugggcauccugaacgggaacugggucgugguggccguccucaucgugauccugauccugagcauccuccuguucuccuucuucugccccgugcgcaaccggaagaacaaggccaacuga

SEQ ID NO: 11891 - RNA, 3423 nt, Artificial Sequence
  derived and/or modified CDS sequence (opt1) from BRV(Indiana)__AF030551.1__GP
auggugggcugggucugcaucuuccugguggugcucaccaccgccacggccgggcugacccgcaaccuguacgagcucaagaucgagugcccccacaccgucggccuggggcagggcuacgugaccgggagcguggagacgacccccgucccccugggccaggugaccgaccucaagaucgaguccagcugcaacuucgaccugcacgugcccuccaccacgauccagaaguacaaccaggucgagugggcgaagaagaccagcaccaccgaguccacgaacgccggcgccagcaccuucgaggccaagaccaaggaggugaaccugaaggggaccugcaacauccccgugacgaccuucgaggccgcguacaagucccggaagaccgucaucugcuacgaccucgccugcaaccagacccacugccugccgacggugcaccugaucgcccccgugcagaccugcaugagcguccgcuccugcaugaucggccuccugagcucccggauccacgugaucuacgagaagaccuacugcgugaccgggcaggucguggagggccugugcuucauccccacgcacaccaucgcccucacccagcccgggcacaccuacgacacgaugacccugccgaucacgugcuuccugguggcgaagaagcucggcacccagcugaagaucgccgucgagcuggagaagcucaucacggccagcggcugcaccgagaacuccuuccagggguacuacaucugcuuccugggcaagcacagcgagccccuguacgugcccaccauggacgacuaccgcuccgccgagcuguucacccggauggugcugaaccccaagggggaggaccacgacccggaccaggacggccagggccugaugcgcaucacggggcccaucaccgccaagguccccagcaccgagaccaccgagacgaugcagggcguggcguucgccgggacccccauguacuccagcuucuccacccuccugcggaaggccgacccggaguacgucuucagccccggcaucauccccgagagcaaccacuccgugugcgacaagaagaccaugcccaucacguggaccggguuccuggccgugagcggcgagaucgagaagaucaccggcugcaccgucuucugcacgcucgccgggccgggcgcguccugcgaggccuacagcgagaccgggaucuucaacaucuccagcccgaccugccuggugaacaaggugcagaaguuccgcggcuccgagcagcgggucaacuucaugugccagcgcguggaccaggacguggucguguacugcaacgggcagaagaaggugauccugaccaagacgcucgucaucggccagugcaucuacaccuucaccagccuguucucccugcuccccggcguggcccacagccuggccguggagcugugcguccccgggcuccacggcugggccaccacggcgcugcugaucaccuucugcuucggguggcuccugauccccuccgugacccugaucauccuccggauccugcgccugcucaccuucagcugcucccacuacagcacggaguccaaguucaagauccugcuggagaaggugaaggucgaguaccagaagaccaugggcagcauggugugcgacaucugccaccacgagugcgagaccgccaaggagcuggacacccaccggaaguccugccccgaggggcagugccccuacugcaugacgaugaccgagagcaccgaguccgcccuccaggcccacuucagcgugugcaagcugaccaaccgcuuccaggagaaccugaagaagucccucaagcaccccgaggucaagcagggcugcuaccggacgcugggcguguuccgcuacaagagccggugcuacguggggcuggucuggggcauccuccugaccgccgagcugaucaucugggcggccagcgccgagaccccgcucauggaguccggguggagcgacaccgcccacggcgugggcaucgugcccaugaagacggaccuggagcuggacuucgcgcucgccuccagcuccagcuacuccuaccgccggaagcuggucaaccccgccaacagcgaggagacccugccguuccaccuccagcuggagaagcaggucgugcacgccgagauccacaaccuggggcacuggauggacggcaccuucaacaucaagaccgccuuccacugcuacggggagugcaagaaguacgcguaccccuggcagacggccaagugcuucuucgagaaggacuaccaguacgagaccuccuggggcugcaacccgcccgacugccccggggugggcaccggcuggaccgccugcgggguguaccucgacaagcugcgcagcgugggcaaggccuacaagaucgucucccugaaguacacccggaaggugugcauccagcucgggacggagcagaccugcaagcacaucgacgugaacgacugccuggucacccccagcgugaaggugugcaugaucggcaccgucuccaagcugcagcccggggacacgcuccuguuccugggcccccucgagcagggcgggaucauccugaagcaguggugcaccaccagcugcguguucggcgacccgggggacaucauguccaccacgagcggcaugaagugccccgagcacaccgggagcuuccgcaagaucugcggcuucgccaccacccccacgugcgaguaccagggcaacaccguguccggguucaagcgcaugauggcgacccgggacagcuuccaguccuucaacgucaccgagccccacaucacgagcaaccgccuggaguggaucgacccggacuccagcaucaaggaccacaucaacguggugcucaaccgggacgucuccuuccaggaccugagcgacaaccccugcaagguggaccugcacacccaguccaucgacggcgccugggggagcggcgugggguucacccucgucugcaccgugggccugacggagugcgccaacuucaucaccuccaucaaggccugcgaccuggccaugugcuacggcgcgaccgugaccaaccuccugcgcgggagcaacacggucaagguggucggcaagggcgggcacuccggcagccuguucaagugcugccacgacaccgacugcaccgacgaggggcucgccgccuccccgccccaccuggaccgggugaccggcuucaaccagaucgacagcgacaagguguacgacgacggggccccgcccugcuccgucaagugcugguucaccaagagcggcgaguggcugcuccgcauccugaacgggaacuggauggugguggcgguccugaucgugauccucauccuguccauccuccucuucagcuucuucugccccauccggagccgcaaguccaagcccaacuga

SEQ ID NO: 11892 - RNA, 3423 nt, Artificial Sequence
  derived and/or modified CDS sequence (opt1) from BRV(Oklahoma)__AF030552.1__GP
auggugggcugggucugcaucuuccugguggugcucaccaccagcacggccgggcugacccgcaaccuguacgagcucaagaucgagugcccccacaccgucggccuggggcagggcuacgugaccggguccguggagaucacgccggucccccugggccaggugaccgaccucaagaucgagagcuccugcaacuucgaccugcacgugcccagcaccaccauccagaaguacacgcaggucgagugggccaagaaguccagcaccaccgaguccaccaacgcggccgccacgaccuucgaggccaagaccaaggaggugagccugaagggcaccugcaacauccccgugacgaccuucgaggccgcguacaagucccggaagaccgucaucugcuacgaccucgccugcaaccagacccacugccugccgacggugcaccugaucgcccccgugcagaccugcaugagcguccgcuccugcaugguggggcuccugagcucccggauccaggugaucuacgagaagaccuacugcgucaccggccagcugguggaggggcucugcuucauccccacgcacaccaucgcccugacccagcccggccacaccuacgacacgaugacccugccgaucaccugcuuccucguggcgaagaagcuggggacccagcugaagaucgccgucgagcucgagaagcugaucacggccagcggcugcaccgagaacuccuuccagggcuacuacaucugcuuccuggggaagcacagcgagcccauguacgugcccaccauggacgacuaccgcuccgccgagcucuucacccggauggugcugaaccccaagggcgaggaccacgacccggaccagaacgggcagggccugaugcgcaucgccggccccaucacggcgaagguccccagcaccgagaccaccgagaccaugcaggggaucgccuucgccggcgcccccauguacuccacguucgccacccucgugcggaaggcggacccggaguacgucuucagccccgggaucauccccgagagcaaccacuccgugugcgacaagaagaccaugcccaucaccuggacgggcuuccuggcccugagcggggagaucgagcgcaucaccggcugcaccguguucugcacccucgccggcccgggggccuccugcgaggccuacagcgagacgggcaucuucaacaucuccagccccaccugccuggucaacaaggugcagaaguuccggggguccgagcagcgcaucaacuucaugugccagcggguggaccaggacgucgugguguacugcaacggccagaagaaggucauccugaccaagacccucgugaucgggcagugcaucuacacguucaccagccuguucucccugcuccccggcguggcgcacagccuggccgucgagcugugcgugcccggccuccacgggugggccaccaccgcccugcugaucacguucugcuucggcuggcuccugaucccggccaucacccugaucgugcucaagauccugcgccugcucaccuucuccugcagccacuacuccaaggagagccgguucaagauccugcuggagaaggucaagguggaguaccagaagaccaugggguccauggugugcgacaucugccaccacgacugcgagacggcgaaggagcuggacacccacaagaagagcugccccgagggccagugccccuacugcaugaccaugaccgaguccacggagagcgcccuccaggcccacuucuccgucugcaagcugaccaaccgcuuccaggagaaccugaagaagagccucaagcaccccgaggugaagcaggggugcuaccggacccugggcguguuccgcuacaagagccggugcuacgucggccuggugugggggcuccugcugaccacggagcucaucaucugggccgcguccgccgagaccccgcugauggagagcggcugguccgacaccgcccacggggugggcaucguccccaugcgcaccgaccuggagcucgacuucgcccuggccagcuccagcuccuacagcuaccggcgcaagcuggugaaccccgcgaacacggaggagacccucccguuccaccugcagcuggagaagcaggugguccacgccgagauccagaaccucggccacuggauggacgggaccuucaacaucaagaccgccuuccacugcuacggcgagugcaagaaguacgccuaccccuggcagacggccaagugcuucuucgagaaggacuaccaguacgagaccuccugggggugcaacccccccgacugcccgggcguggggaccggcugcaccgcgugcggcguguaccuggacaagcugcggagcgucgggaaggccuacaagaucgugucccucaaguacacccgcaaggugugcauccagcugggcacggagcagaccugcaagcacaucgacgucaacgacugccuggugagccccuccgugaaggucugcaugaucgggaccgugagcaagcuccagcccggcgacacccugcuguuccucgggccccuggagcagggcggcaucauccugaagcaguggugcacgaccuccugcguguucggggacccgggcgacaucaugagcaccaccuccgggaugcgcugccccgagcacacgggcagcuuccggaagaucugcggguucgccaccacccccaccugcgaguaccagggcaacacgaucagcggcuucaagcgcaugauggccacccgggacuccuuccagagcuucaacgucaccgagccccacaucaccuccaaccgccucgaguggaucgacccggacagcuccaucaaggaccacaucaacguggugcugaaccgggacgucagcuuccaggaccuguccgacaaccccuacaagguggaccuccacacgcagagcaucgacggggccuggggcuccggggugggcuucacccuggucugcaucguggggcugaccgagugcgcgaacuucaucaccagcaucaaggccugcgacauggccaugugcuacggcgccacggugaccaaccuccugcgcggcuccaacaccgucaaggugguggggaagggcgggcacagcggcucccuguucaagugcugccacgacaccgacugcacggaggagggccucgcggccagccccccccaccuggaccgggucaccggguacaaccagaucgacuccgacaaggugugcgacgacggcgccccgcugugcagcgucaagugcugguucaccaaguccggggaguggcuccugggcauccugaacgggaacuggauggugguggccguccucguggugauccugauccugagcauccuccuguucuccuucuucugccccauccgcagcaagaagagcaagcccaacuga

SEQ ID NO: 11893 - RNA, 3399 nt, Artificial Sequence
  derived and/or modified CDS sequence (opt1) from THAIV(Thai749)__L08756.1__GP
auguggggccugcucgugaucgccguccugguggggcccggcuucgccaucaagaacguguacgacaugaagaucgagugcccgcacagcgucaacuucggggagaccuccgugaccggccagguggagcugcccgcccuccccaucacggaggccgagcagcugguccccgagagcuccugcaacauggacaaccaccagagccuggccaccaucaacacccucaccaagguguccuggcgcaagaaggccgaccaggugagcgccucccagaacagcuucgaggucaucgaggcggagacguccuucaaggggcugugcaugcugaagcaccggaugaucgaggagagcuucaagaaccgccgguccgugaucugcuacgaccucagcugcaacaccaccuucugcaagccgaccguguacauggucgugcccgugcacgccugcaacaugaugaaguccugccuggucggccugggccccuaccgcguccaggugguguacgagcggacguacugcaccguggggauccucaccgagggcaagugcuucauccccgacaagaccauccugagcuccaucaagcgcgggauguucguggucacgagcguccaggugcugugcuucuucaucgugcagaagggccacuccuacaagaucauggacgaggugaagaaguccaugaugaacaagugcaacgacaccgagaacaagguccagggguacuacaucugcauccucggcggcaacagcgccccgguguacgugcccagccuggacgacuuccggagcauggagaucuucuccaacaugcugcgcagccccuucggggaggaccacgaccuccccggcgaggaguucuccaccuaccagaucgccgggccgaccgaggcgaaggucccccacacggccagcuccaagaaccuggcccugaucgccuacagcggcaaccccuccuacagcucccucagccugaucaccuccagccaggacggccgguacguguucucccccgggcuguucccgaaccucaaccagacccagugcgagaagaacgcccugcccaugguguggcgcggcaugaucgaccugagcggguacuacgaggcgauccaccccugcaacaucuucugcguccucuccggccccggggccagcugcgaggccuucuccgagggcggcaucuucaacaucaccagcccgacgugccugguguccaagcagaaccgguuccgcgccgccgagcagcagaucaacuucgugugccagcgggucgacauggacaucgugguguacugcaacgggcagaagaagaccauccugaccaagacccucaucaucggccagugcaucuacacgaucaccagccuguucagccugcuccccggggucgcgcacuccaucgccaucgagcugugcgugcccggcuuccacgggugggccaccgccgcccugcucaucaccuucugcuucggcuggauccugauccccacgaucacccuggcggugcucgucgugcugaaguucaucgccaacauccugcacaccaacagccaggagaaccgcuucaagcucauccugaagaaggugaaggaggaguucgagaagaccaagggcuccauggucugcgaggugugcaaguacgagugcgagacgagcaaggagcugaaggcccacaaccucuccugcccgcagagcaagugccccuacugcuucacccacugcgagcccaccgaggccaccuucaaggcccacuacaaggugugccaggcgacgcaccgguuccgcgaggaccugaagaagaccgucacgccccagaccguggggccgggcugcuaccggacccugaaccucuuccgcuacaagucccggugcuacauccugaccauguggcuguuccugcucagcaucgaguccaucaugugggccgccagcgccgcggagaucccccuggugccccuguggaccgacaacgcccacgggaucggcuccgucccgaugcacaccgaccucgagcuggacuucagccugcccuccagcuccaaguacaccuacaagcgcaagcucacgaaccccgugaacaccgagcagggggugcagcugcacaucgagaucgaggagcagggcaucggcgccgacguccaccaccuggggcacugguucgacgcccggcucaaccugaagaccagcuuccacugcuacggcgccugcuccaaguaccaguaccccuggcacaccgcgaagugccacuucgagaaggacuacgaguacgagaacagcugggccugcaacccggccgacugccccggggugggcacgggcugcaccgccugcgggcuguaccucgaccagaugaagcccaucggcaccgccuacaagcugguggcgauccgcuacagccgcaaggccugcguccaguucggggaggagcaccugugcaagaccaucgacaugaacgacugcuucgugacgcggcacgugaagaucugcaucaucggcaccgucuccaaguucauccagggggacacccuccuguuccugggcccccucgagggcgggggccugaucuucaagcacuggugcaccagcacgugccaguucggggacccgggcgacaucaugucccccaaggacaagcccuuccugugccccgaguucccggggcaguuccgcaagaagugcaacuucgccaccacccccgugugcgaguacgacggcaaccagaucagcggcuacaagaagaugaaggccaccaucgacuccuuccagagcuucaacacguccagcauccacuucaccgacgagcggcucauggaggaccccgacgggaugcugcgcgaccacaucaacaucguggucaccaaggacaucgacuucgagaaccuggccgagaaccucugcggcaucgggcuccagguguccgcgaucaagggcgccugggggagcggcgugggcuucacccugacgugccaggucucccugaccgagugccccaccuuccugaccagcaucaaggccugcgacauggccaucugcuacggggcggaguccgugacgcuggugcggggccagaacaccgucaagaucagcgggaagggcgggcacuccggcagcuccuucaagugcugccacggcguggacugcagcuccaacgggcuccaggccaacccgccccaccuggaccgcguggccggcgucagcgagcugaccaacgagaagguguacgacgacggggcgccccagugcggcaucgccugcugguucaucaagagcggcgagugggugaaggggaucuucuccggcaacuggaucguccucaucgugcugugcgugcugcuccugaucagccugauccuccuggggaucuucugccccguccggaagcacaagaaguccuga

SEQ ID NO: 11894 - RNA, 3426 nt, Artificial Sequence
  derived and/or modified CDS sequence (opt1) from TULV(Moravia/5302v/95)__NC_005228.1__GP
auguucugccugugccucagccugcugggccuccugcugugcuggcccgccgccacccgcaaccuccuggagcugaagguggagugcccgcacaccaucgggcucggccaggggaucgucaucggcuccgcggagcugccgcccgugccccuggccaagguggagagccucaagcuggaguccagcugcaacuucgaccugcacacguccaccgccgcccagcaggccuucaccaaguggagcugggagaagaaggcggacaccgccgagaacgccaaggccgcguccacgaccuuccagagcuccagcaaggagguccagcuccgggggcugugcgugauccccacccuggugcucgagaccgccucccgcacgcggaagaccgugaccugcuucgaccugagcugcaaccagaccgucugccagcccacgguguaccugauggcccccauccagaccugcgucaccaccaaguccugccuccugggccugggcgaccagcgcauccaggugguguacgagaagacguacugcgucagcgggcagcucaucgagggcaacugcuucaacccccugcacaccaucgccaucucccagccgacccacaccuacgacaucaugacgcuggccgugcacugcuucuucaucagcaagaagggcgggaccgacgacacccucaagaucgagaagcaguucgagacccugguggagaagacggggugcaccgagaacgcgcugaagggcuacuacgccugcauccucggcaccuccagcgaggucguguacgugcccgccauggacgacuaccgguccagcgagauccugagccgcaugaccacggcgccccacggggaggaccacgacaucgaccccaacgccaucuccagccugcggaucgucggccagcucaccgggaaggccccguccaccgagagcuccgacaccgugcagggcaucgccuucgccggcacgccccuguacaccagcaccuccauccuggugcgcaaggaggaccccaucuaccucuggagccccgggaucaucccggagggcaaccacucccagugcgacaagaagacccugccccugacguggaccggguucaucacccuccccggcgagaucgagaagaccacccagugcacggucuucugcacccugagcgggcccggcgccgacugcgaggccuacuccgacaccggcaucuucaacaucagcuccccgaccugccuggugaaccgggugcagcgcuuccgcggggcggagcagcaggucaaguucgugugccagcgggucgaccucgacaucacgguguacugcaacggcgugaagaaggucauccugaccaagacccuggugaucgggcagugcaucuacaccuucacgagcaucuucucccucaugcccggcguggcccacagccuggccgucgagcugugcgugcccgggcuccacggcugggccaccaucucccugcugaucaccuucugcuucggcuggcuggccaucccccuccugagcaugaucaucauccgguuccugcucaucuucaccuaccugugcuccaaguacagcacggacagcaaguucaagcugaucaucgagaaggugaagcaggaguaccagaagaccaugggguccauggucugcgaggugugccagcagggcugcgagaccgcgaaggagcucgagagccacaagaaguccugcccgcacgggcagugccccuacugccugaaccccaccgaggccacggagagcgcccugcaggcccacuucaaggugugcaagcucaccacccgcuuccaggagaaccugaagaagucccugagcaccuacgagcccaagcggggccucuaccgcacgcuguccauguuccgguacaagagcaagugcuacgucgggcugguguggugcauccuccugaccauggagcugaucgugugggcggccuccgccgagaccaucaaccucgagccgggcuggaccgacacggcccacggcagcgggaucaucccccugaagaccgaccuggagcucgacuucucccugcccagcuccgccaccuacaccuaccgccgggagcugcagaacccggcgaacgagcaggagaagauccccuuccacuuccagauggagcgccaggucauccacgccgagauccagcaccucggccacuggauggacgggacguucaaccugaagaccgccuuccacugcuacggcagcugcaucaaguacgccuaccccuggcagaccgccaagugcuuccuggagaaggacuucgaguucgagaccggcugggggugcaacccgcccgacugccccggcguggggacgggcugcaccgcgugcgggguguaccucgacaagcugcgguccgucggcaagguguacaagauccugagccucaaguacacccgcaaggugugcauccagcugggcaccgagcagacgugcaagaccaucgacuccaacgacugccuggucaccaccagcgugaaggugugcaugaucgggaccaucagcaaguuccagcccggcgacacgcuccuguuccuggggccccucgaggagggcgggaugaucuucaagcaguggugcaccacgaccugccaguucggcgacccgggcgacaucauguccacgccccuggggaugaagugccccgagcacgccggcagcuuccgcaagaagugcuccuucgccacccugcccagcugccaguacgacgggaacaccgucuccggcuaccagcggaugaucgccaccaaggacagcuuccaguccuucaacaucaccgagccgcacaucaccaccaacagccucgaguggguggaccccgacuccagccugaaggaccacgugaaccugaucgucaaccgcgaccucuccuuccaggaccuggccgagaaccccugccagguggaccugagcguguccagcaucgacggggcguggggcuccggcgucggguucaaccucgugugcagcgugucccugaccgagugcgccagcuuccugacguccaucaaggccugcgacagcgccaugugcuacggcagcuccaccgcgaaccucguccgggggcagaacaccgugcacguggucggcaagggcgggcacagcggcuccaaguucaugugcugccacgacaagaagugcagcgccaccgggcugguggccgccgcgccccaccuggaccgcgugacgggcuacaaccagaucgacaccaacaaggucuucgacgacggggccccgcagugcggcgugcacugcugguucaagaaguccggcgaguggcuccuggggauccugagcggcaacuggaugguggucgccgugcucaucgcccuguucaucuucucccugcuccuguucagccugugcugcccccggcgccagaacuacaagaagaacaaguga

SEQ ID NO: 11895 - RNA, 5055 nt, Artificial Sequence
  derived and/or modified CDS sequence (opt1) from CCHFV(10200)__U39455.2__GP
augcacaucagccugauguacgccauccucugccugcagcugugcggccucggggagacccacggcucccacaacgagacccgccacaacaagacggacaccaugaccacccacggggacaaccccagcuccgagccgcccgugagcacggcccuguccaucacccuggaccccagcaccgucacccccacgaccccggcguccggccucgaggggagcggcgagguguacaccuccccgcccaucaccacgggcagccugccccuguccgagaccacccccgagcuccccgugaccacggggaccgacacccugagcgccggcgacgucgaccccuccacccagacggccgggggcaccagcgcccccaccgugcggaccucccugccgaacagccccuccacgcccagcacgccccaggacacccaccacccggugcgcaaccuccuguccgucaccagccccgggcccgacgagaccagcacccccuccggcaccggcaaggagagcuccgccaccagcuccccgcaccccgugagcaaccggccgcccacgccgcccgcgaccgcccaggggcccaccgagaacgacucccacaacgccaccgagcaccccgagagccugacgcaguccgccacccccggccucaugaccagccccacccagaucgugcacccccaguccgcgaccccgaucacgguccaggacacccaccccagccccaccaaccgcuccaagcggaaccugaagauggagaucauccugacccucagccaggggcugaagaaguacuacggcaagauccugcgccuccugcagcugacgcucgaggaggacaccgagggccugcuggaguggugcaagcggaaccucgggcuggacugcgacgacaccuucuuccagaagcgcaucgaggaguucuucaucaccggcgaggggcacuucaacgaggugcugcaguuccggacgcccggcacccucuccaccaccgagagcacgccggccgggcugcccaccgccgagcccuucaaguccuacuucgccaagggcuuccugagcaucgacuccggcuacuacagcgccaagugcuacagcgggaccuccaacagcggccuccagcugaucaacaucacccgccacuccacgcggaucguggacacccccgggccgaagaucaccaaccugaagaccaucaacugcaucaaccucaaggcgagcaucuucaaggagcaccgcgaggucgagaucaacgugcugcugccccagguggccgucaaccucuccaacugccacguggugaucaagagccacgucugcgacuacucccuggacaucgacggcgccgugcggcugccccacaucuaccacgaggggguguucauccccggcacguacaagaucgucaucgacaagaagaacaagcucaacgaccgcugcacccuguucaccgacugcgugaucaagggccgggaggugcgcaaggggcagagcguccugcggcaguacaagaccgagauccgcaucggcaaggccuccacgggguuccggcgccuccugagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggcagggcaagaccaucgaggccuaccgggcccgcgagggguacaccuccaucugccucuucguccugggcagcauccuguucaucguguccugccucaugaaggggcugguggacagcgucggcaacuccuucuuccccggccugagcaucugcaagacgugcagcaucuccagcaucaacggguucgagaucgagucccacaagugcuacugcagccucuucugcugcccguacugccggcacugcuccaccgacaaggagauccacaagcugcaccugagcaucugcaagaagcgcaagaccggcuccaacgugaugcucgccgugugcaagcugaugugcuuccgcgcgaccauggaggucagcaaccgggcccuguucauccgcuccaucaucaacacgaccuucgugcucugcauccugauccuggccgugugcgucgugagcaccuccgccguggagauggagaaccuccccgccgggaccugggagcgggaggaggaccugacgaacuucugccaccaggagugccaggucaccgagaccgagugccugugccccuacgaggcgcucgugcugcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccagcacgugccugcacaaggaguggccccacucccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucggguga

SEQ ID NO: 11896 - RNA, 5055 nt, Artificial Sequence
  derived and/or modified CDS sequence (opt1) from CCHFV(IbAr10200)__AF467768.2__GP
augcacaucagccugauguacgccauccucugccugcagcugugcggccucggggagacccacggcucccacaacgagacccgccacaacaagacggacaccaugaccacccccggggacaacccgagcuccgagccccccgugagcacggcccuguccaucacccuggaccccagcaccgucaccccgacgacccccgcguccggccucgaggggagcggcgagguguacaccuccccccccaucaccacgggcagccugccgcuguccgagaccacccccgagcuccccgugaccacggggaccgacacccugagcgccggcgacgucgaccccuccacccagacggccgggggcaccagcgccccgaccgugcggaccucccugcccaacagccccuccacgcccagcaccccgcaggacacccaccaccccgugcgcaaccuccuguccgucaccagccccgggcccgacgagacgagcaccccguccggcaccggcaaggagagcuccgccaccagcuccccccaccccgugagcaaccggcccccgacgccccccgcgaccgcccaggggcccaccgagaacgacucccacaacgccaccgagcacccggagagccugacgcaguccgccacccccggccucaugaccagccccacccagaucgugcacccgcaguccgcgacccccaucacgguccaggacacccaccccagccccaccaaccgcuccaagcggaaccugaagauggagaucauccugacccucagccaggggcugaagaaguacuacggcaagauccugcgccuccugcagcugacgcucgaggaggacaccgagggccugcuggaguggugcaagcggaaccucgggcuggacugcgacgacaccuucuuccagaagcgcaucgaggaguucuucaucaccggcgaggggcacuucaacgaggugcugcaguuccggacgccgggcacccucuccaccaccgagagcacgcccgccgggcugcccaccgccgagcccuucaaguccuacuucgccaagggcuuccugagcaucgacuccggcuacuacagcgccaagugcuacagcgggaccuccaacagcggccuccagcugaucaacaucacccgccacuccacgcggaucguggacaccccggggcccaagaucaccaaccugaagaccaucaacugcaucaaccucaaggcgagcaucuucaaggagcaccgcgaggucgagaucaacgugcugcugccccagguggccgucaaccucuccaacugccacguggugaucaagagccacgucugcgacuacucccuggacaucgacggcgccgugcggcugccccacaucuaccacgaggggguguucaucccgggcacguacaagaucgucaucgacaagaagaacaagcucaacgaccgcugcacccuguucaccgacugcgugaucaagggccgggaggugcgcaaggggcagagcguccugcggcaguacaagaccgagauccgcaucggcaaggccuccacggggagccggcgccuccuguccgaggagcccagcgacgacugcaucucccggacccagcugcuccgcaccgagaccgccgagauccacggcgacaacuacgggggccccggcgacaagaucacgaucugcaacgggagcaccaucguggaccagcgccugggcuccgagcuggggugcuacaccaucaaccggguccgcagcuucaagcugugcgagaacuccgcgaccggcaagaacugcgagaucgacagcgugcccgugaagugccggcagggcuacugccuccgcaucacgcaggaggggcggggccacgucaagcugagccgcggguccgagguggugcuggacgccugcgacaccagcugcgagaucaugaucccgaagggcaccggggacauccucgucgacugcuccggcggccagcagcacuuccugaaggacaaccugaucgaccucgggugccccaagaucccccugcugggcaagauggccaucuacaucugccggaugagcaaccaccccaagaccacgauggccuuccucuucugguucuccuucggguacgugaucaccugcauccugugcaaggccaucuucuaccugcucaucaucgugggcacccuggggaagcgccugaagcaguaccgggagcucaagccgcagaccugcaccaucugcgagacgacccccgucaacgcgaucgacgccgagaugcacgaccugaacugcagcuacaacaucugccccuacugcgccucccgccugaccagcgacggccucgcccggcacgugauccagugccccaagcgcaaggagaagguggaggagaccgagcuguaccugaaccucgagcggaucccgugggucgugcgcaagcugcugcagguguccgagagcacgggcgucgcccucaagcgguccagcuggcugaucgugcugcucgugcuguucaccgucucccugagccccgugcaguccgcgcccaucgggcagggcaagaccaucgaggccuaccgcgcccgggagggguacaccagcaucugccucuucgugcugggcuccauccuguucaucgucagcugccucaugaaggggcugguggacuccgugggcaacagcuucuucccgggccugagcaucugcaagacgugcuccaucagcuccaucaacggguucgagaucgagagccacaagugcuacugcucccucuucugcugccccuacugccgccacugcagcaccgacaaggagauccacaagcugcaccuguccaucugcaagaagcggaagaagggcagcaacgucaugcucgccgugugcaagcugaugugcuuccgcgcgaccauggagguguccaaccgcgcccuguucauccggagcaucaucaacaccacguucguccucugcauccugauccuggccgugugcguggucuccaccagcgccguggagauggagaaccuccccgccgggaccugggagcgcgaggaggaccugaccaacuucugccaccaggagugccaggugacggagaccgagugccugugccccuacgaggcgcucguccugcggaagccgcuguuccucgacuccaccgccaagggcaugaagaaccugcugaacagcaccucccucgagacgagccuguccaucgaggcccccuggggggccaucaacgugcagagcaccuacaagcccaccguguccaccgccaacaucgcgcugagcuggagcuccgucgagcaccgcggcaacaagauccucgugagcggccgguccgagagcaucaugaagcuggaggagcgcacggggaucuccugggaccugggcguggaggacgccagcgaguccaagcuccugaccgucagcgugauggaccugucccagauguacagccccguguucgaguaccucuccggggaccggcaggucggcgaguggccgaaggccaccugcaccggcgacugccccgagcgcugcgggugcacgagcuccaccugccugcacaaggaguggccccacagccggaacuggcgcugcaaccccaccuggugcuggggcguggggaccggcugcacgugcugcgggcuggacgugaaggaccucuucaccgacuacauguucgucaaguggaagguggaguacaucaagaccgaggccaucgugugcgucgagcugaccucccaggagcggcagugcagccugaucgaggccggcacgcgcuucaaccucggcccggugaccaucacccuguccgagccccggaacauccagcagaagcugccccccgagaucaucacccuccacccgcgcaucgaggagggguucuucgaccugaugcacgugcagaagguccugagcgcguccaccgugugcaagcuccagagcugcacgcacggcguccccggggaccugcagguguaccacaucggcaaccugcucaagggggacaaggugaacggccaccugauccacaagaucgagccccacuucaacaccagcuggauguccugggacggcugcgaccuggacuacuacugcaacaugggggacuggcccagcugcaccuacaccggcgucacgcagcacaaccacgccuccuucgugaaccuccugaacaucgagaccgacuacaccaagaacuuccacuuccacagcaagcgggugaccgcccacggggacacgccgcagcuggaccucaaggcccgccccaccuacggcgcgggggagaucaccguccugguggagguggccgacauggagcugcacaccaagaagaucgagaucuccggccucaaguucgccagccuggccugcacgggcugcuacgccugcuccagcgggaucuccugcaagguccggauccacguggacgagcccgacgagcugaccgugcacgucaagagcgacgaccccgacgugguggcggccuccagcucccucauggcccgcaagcuggaguucggcaccgacagcaccuucaaggccuucuccgccaugccgaagacgagccugugcuucuacaucgucgagcgggagcacugcaaguccugcagcgaggaggacaccaagaagugcgugaacaccaagcucgagcagccccaguccauccugaucgagcacaaggggaccaucaucggcaagcagaacagcacgugcaccgcgaaggccagcugcuggcuggaguccgugaagagcuucuucuacggccugaagaacaugcucuccgggaucuucggcaacgucuucauggggaucuuccuguuccuggcccccuucauccuccugauccuguucuucauguucggcuggcgcauccucuucugcuucaagugcugccggcgcacccgcgggcuguucaaguaccggcaccugaaggacgacgaggagaccggcuaccgccggaucaucgagaagcucaacaacaagaagggcaagaacaagcugcuggacggggagcgccucgccgaccggcgcaucgccgagcuguucagcacgaagacccacaucggcuga

SEQ ID NO: 11897 - RNA, 5067 nt, Artificial Sequence
  derived and/or modified CDS sequence (opt1) from CCHFV(Turkey-Kelkit06)__GQ337054.1__GP
augcccaccaacaucaugcacaccccgcuggugugcuucauccucuaccugcagcugcucugccugggcggggcccacggccagcugaacgccacggagcacaacgggaccaacaacaccaccgcgcccggcgccagccagucccccaagcccccgaugagcacgacccccccccacgcccccgaguccagcaccaucaagccgaccacgcccaucuccgaggccgaggggagcggcgagaccaccuccccccccaacaccacgcagggccucagcuccccggagaccaccagcgagcgccccgccaccacguccaucagcaccuccagcaccgacuccaccaaccccacgacccagaugaccgacaacacccccacgccgaccgucagcaccucccccagcuccagccccagcacccccuccacgccgcaggggauccaccaccccgcgcggagccugcuguccgugagcucccccaagaccgugaccacccccacgccgaccagccccggcgagauguccagcgagaccuccagccagcacuccgccaugagccgcauccccaccccccacacggccacccgggucuccaccgagaucaccaaccaccgcaccccgcggcagagcgaguccagcgcccagcagacgacccccucccccaugaccagcccggcgcaguccauccuccugaugagcgccgcccccaccgccgugcaggacauccaccccagccccacgaaccgcuccaagcggaaccuggagaccgagaucauccucacccugagccaggggcugaagaaguacuacggcaagauccucaagcugcugcaccucacccuggagcaggacacggaggggcugcucgaguggugcaagggcaaccugggcuccaacugcgacgacgacuucuuccagaagcgcaucgaggaguucuucaugaccggggagugcuacuucaacgaggugcugcaguucaagacccucagcacccuguccccgacggagcccagccacgcccggcugcccaccgcggagcccuucaaguccuacuucgccaagggcuuccucagcaucgacuccggguacuucagcgccaagugcuacccgcgcuccagcgccuccggccugcagcugaucaacgucacccagcaccccgcccggaucgcggagacccccggccccaagacgaccagccucaagaccaucaacugcaucaaccugcgcgccuccguguucaaggagcaccgggagguggagaucaacguccugcucccgcagaucgccgugaaccugagcaacugccacguggucaucaacucccacgugugcgacuacagccuggacaccgacgggcccgugcgccucccccggaucuaccacgagggcacguucauccccgggaccuacaagaucgucaucgacaagaagaacaagcugaacgaccgcugcacccuggugaccaacugcgugaucaagggccgggagguccgcaaggggcagagcgugcuccggcaguacaagacggagaucaagaucggcaaggccuccaccggcuuccgcaagcugcugagcgaggagccgggggacgacugcaucucccggacccagcuccugcgcaccgagacggccgagauccacgacgacaacuacggcgggcccggcgacaagaucaccaucugcaacgggagcaccaucguggaccagcgccugggcuccgagcucggcugcuacaccaucaaccgggucaagagcuucaagcugugcaagaacuccgcgacggggaagaccugcgagguggacagcacccccgugaagugccgccagggcuucugccugaagaucacccaggaggggcggggccacgucaagcucucccgcgggagcgaggugguccuggacgccugcgacuccagcugcgaggugaugauccccaagggcacgggcgacauccugguggacugcuccgggggccagcagcacuuccugaaggacaaccucaucgaccuggggugcccgcacaucccccugcucggccggauggccaucuacaucugccgcaugagcaaccacccccggaccaccauggccuuccuguucugguucuccuucggcuacgucaucaccugcaucuucugcaaggcccuguucuacagccucaucaucaucgggacccugggcaagaagaucaagcaguaccgcgagcugaagccccagacgugcaccaucugcgagaccgcgccggugaacgccaucgacgccgagaugcacgaccucaacugcuccuacaacaucugccccuacugcgccagccggcugaccuccgacgggcuggcgcgccacgugacgcagugccccaagcggaaggagaaggucgaggagaccgagcucuaccugaaccuggagcgcaucccguggaucgugcggaagcuccugcaggugagcgagagcaccggcgucgcccugaagcgcuccagcuggcucaucgugcugcuggugcuccugaccgucucccugagccccgugcaguccgcccccguggggcacggcaagacgaucgagaucuaccagacccgggagggcuucgccagcaucugccucuucaugcugggguccauccuguucaucgucagcugccucgugaagggccugguggacuccgucagcgaguccuucuuccccgggcugagcgugugcaagaccugcuccaucggcagcgugaacggguucgagaucgagucccacaagugcuacugcagccucuucugcugcccguacugccgccacugcuccgccgaccgggagauccaccagcugcaccugagcaucugcaagaagcgcaagaccggcuccaacgucaugcucgcggugugcaagcggaugugcuuccgcgccacgaucgaggccagccgccgggcccugcugauccgcagcaucaucaacaccaccuucgugaucugcauccucacccugacgaucugcgucguguccaccagcgccguggagauggagaaccugcccgcgggcaccugggagcgggaggaggaccucaccaacuucugccaccaggagugccaggucacggagaccgagugccugugccccuacgaggcccuggugcuccgcaagccccuguuccuggacuccaucgugaaggggaugaagaaccuccugaacagcaccucccuggagaccagccucuccaucgaggccccguggggcgccaucaacguccagagcacguucaagcccaccguguccaccgccaacaucgcgcugagcugguccagcgugguccaccgggggaacaagauccuggugaccggccgcuccgagagcaucaugaagcucgaggagcggacggggguguccugggaccugggcgucgaggacgccagcgaguccaagcugcucaccgugagcaucauggaccugucccagauguacagccccguguucgaguaccugagcggcgaccgccaggucgaggaguggcccaaggccaccugcaccggggacugcccggagcggugcggcugcacguccagcaccugccuccacaaggaguggucccacagccgcaacuggcggugcaaccccaccuggugcuggggggugggcaccgggugcacgugcugcggcguggacgucaaggaccuguucaccgaccacauguucgugaaguggaagguggaguacaucaagaccgaggccaucgucugcguggcgcugaccucccaggagcgccagugcagccucaucgaggccggcacccgguucaaccuggggcccgugacgaucacccuguccgagccccgcaacauccagcagaagcucccgcccgagaucaucacccugcaccccaagaucgaggagggcuucuucgaccugaugcacguccagaaggugcucagcgccuccaccgugugcaagcugcagagcugcacgcacgggauccccggcgaccugcaggucuaccacaucggcaaccuccugaagggggaccgggugaacggccaccugauccacaagaucgagucccacuucaacaccagcuggauguccugggacgggugcgaccucgacuacuacugcaacaugggcgacuggccgagcugcaccuacaccggggucacgcagcacaaccacgccgccuucgugaaccugcugaacaucgagaccgacuacaccaagaccuuccacuuccacuccaagcgcgugacggcgcacggcgacaccccccagcucgaccugaaggcccggcccaccuacggcgccgggggcaucaccguccugguggagguggccgacauggagcuccacacgaagaaggucgagaucagcgggcugaaguucgccucccuggcgugcaccggcugcuacgccugcagcuccgggaucagcugcaaggugcgcauccacguggacgagcccgacgagcucaccguccacgugaagagcuccgacccggacguggucgccgccagcaccucccugauggcccggaagcuggaguucggcacggacagcaccuucaaggcguucuccgccaugcccaagaccagccucugcuucuacaucguggagcgcgaguacugcaaguccugcagcgaggacgacacccagaagugcguggacacgcggcuggagcagccccaguccauccugaucgagcacaagggcaccaucaucgggaagcagaacgacaccugcaccgccaaggccagcugcuggcucgaguccgucaagagcuucuucuacggccugaagaacaugcugggguccguguucggcaaccucuucaucgggauccugcuguuccucgcgcccuucgugcugcugguccuguucuucauguucggcuggaagauccucuucugcuucaagugcugccgccgcacgcggggccuguucaaguaccgccaccugaaggacgacgaggagaccggguaccggcgcaucaucgagcggcucaacagcaagaagggcaagaaccgccugcuggacggggaccggcucgccgaccgcaagaucgccgagcuguucuccaccaagacccacaucggcuga

SEQ ID NO: 11898 - RNA, 5103 nt, Artificial Sequence
  derived and/or modified CDS sequence (opt1) from CCHFV(UCCR4416)__KY484026.1__GP
auguuccugcacuucaaguucaugcuccugaccaacuucuucuucugccagcugcucuggggcgggggcgggguggccagcggcgggcgcaccaacacguccagcacccagaccacccugaucuccagcaacacgcugaacuccaccaugagcguccucgaguccagcaucggcaccgccaccgagacggugcccuccaccaccaccaacacgccggacacccaggugaccaccgacagcggcuccggggagagcuccacggacccccagaccaccagcaaggagguccccuccaccagcguggcgacgaucaagacccaggaguccgagacccaccgggcccagaaccccagcaccacggccggcuccggggccagcaccccgagcaacaccaccuccaacaagcccgacgugaacagccugacgucccccauccuggaggccaagagcucccccagcccguccaagaccagcaugccccagaccgcgcaccaccucucccgcagccugcuguccgccgccaccacggagaccaaccaggccgcgagcgucaugaccaccacgcgggagaccaccaccauguccagccccaccacggugaagaacuccgugaccgccauccccacccagggcaucaccacgagcaacaccuccaagcagaccgacaccaucacgcucgagaucagcccgaagauccagaccacccagucccagcagaccgccacgcccgccaucgcccccgcgaccaccgccaucgccuucaucagccccaccaaccgcagcaagcgggaguccaagguccagaucauccugacguucagccaggggcugaagaaguacuacuccaagauccucaagcugcugcaccucacccaggaggaggacagcgagggccugcuggaguggugcacccgcgugcucgagcaggccugcaacgacgacuacuucaacgagcggaucgaggaguucuucaucaccggcaagggguacuucaacgacgugcugcaguuccgccuguacgacacgcucuccaccaccgagagcacccagaacacguccccgaccgccaagcccuuccggagcuacuacgcgaagggcucccugaccuucgacagcggguacuucuccgccaagugcuacccccgcgccagcaacuccggccugcagcucaucaacgucacccagcacagcgugaagaucgccaacacgcccggcccgaagaucuccaaccccaagaccaucaacugcaucaaccugaaggugagcaccgacaaggaccacuccaagcuggagaucaacguccuccugccccagguggccgugaaccugagcaacugccacguccucaucgagagccacgugugcgacuacucccuggacaccgacgggacgaucaagcugcccaagaucacccacaacggcgcguucaucccggggaccuacaagaucgugaucgacaagaagaacaagcucaacgaccggugcgcccuguucaccaacugcgucaucaagggccgcgaggugcggcgcgggcagagcgcccugcggcaguaccgcacggagauccggaucggccagaccuucaccggcucccgccggcuccuggccgagggcgggagcaacgacugcgugucccgcacccagcuggucaagaccgagguggccgagauccacgaggacagcuacgggggccccggggagaagaucacgaucugcaacggcuccaccaucgucgaccagcggcucggcagcgagcuggggugcuacaccaucaaccgcgugcgcaccuacaagcugugcgagaacuccgcgacggagaaguccugcgagaucgacagcgugcccgucaagugcaagcagggcuucugccucaagaucacccaggaggggcggggccacgugaagcugagccgcgggaccgagaucgugcuggacgucugcgacaccuccugcgagcucaugauccccaagggcacgggcgacauccugguggacugcagcgggggccagcagcacuuccugcaggacaaccugaucgaccucgggugcccgaacaucccccugcugggccggaccgccaucuacgugugccgcauguccaaccaccccaagaccaccauggccuuccucuucugguucagcuucggcuacgucaucacgugcguggugugcaagguccuguucuaccugcucaucgugaucgggacccugggcaagcggcugaagcaguaccgcgagcucaagccgcagaccugcaucgugugcgaguccauccccgucaacgccaucgacgcggagaugcacgaccugaacugcaacuacaacaucugccccuacugcgccagccggcugaccuccgacgggcucgugcgccacgugacgcagugccccaagcggaaggagaaggucgaggagaccgagcuguaccugaaccucgagcgcaucccguggcuggugcggaagcugcuccaggugagcgagagcaccggcgucgcccugaagcgcuccugcuggaugaucacccugcucauccugcugacggugagcaugucccccgugcagagcgcccccgucgggcacaagcgggccguggagguguaccagaugcgcgaguccuacaccggcaucugccucuucguccugggcagcgugcuguucgcgguguccuggcucgucaaggcccugaucgacagcaucgggaacuccuucuuccccggccugagcaucugcaagaccugcuccaucgggagcaucaacggcuucgagaucgagucccacaagugcuacugcagccucuucugcugcccguacugccgggccugcuccagcgacaagaucacccaccgcaugcaccugaacgugugcaagaagcggaaggugggguccaacgucaugcuggccgugugcaagcgcaugugcuucaaggccacgaucgaggcgagcaaccgggccaccuucauccgcaacaucaucaacuccaccuucgugaucugcauccucauccuggucaucugcguggugagcaccagcgccgucgacauggagaaccugcccgccggcaucugggagaaggaggaggaccucacgaacuucugccaccaggagugccaggugaccgagaccgagugccugugccccuacgaggcccugaugcuccgcaagccccuguuccuggaccggaucgcgaagggcaugaagucccuccugaacagcaccucccuggagacgagccucuccaucgaggccccguggggcgccaucaacgugcagagcaccuucaagcccaccgucuccgccgcgaacaucgcccugagcugguccagcguggagcacaaggggaacaagauccugguguccgggcgcagcgaguccaucaugaagcucgaggagcggaccggcaucagcuggugccugggggucgaggacgccuccgagagcaagacgcugaccguguccgugauggaccucagccagauguacucccccgucuucgaguaccugagcggcgaccgccagguggaggaguggcccaaggcgaccugcaccggcgacugcccggagcggugcgggugcaccagcuccacgugccugcacaaggaguggccccacagccgcaacuggcggugcaaccccaccuggugcuggggcguggggaccggcugcacgugcugcgggcucgacgucaaggaccuguucaccgacuacaugcuggugaaguggaaggucgaguacaucaagaccgaggccaucaucugcguggagcucaccucccaggagcgccagugcagccugaucgaggccggcacccgguucaaccugggccccgugacgaucacccucuccgagccgcgcaacguccagcagcggcugccgcccgagaucaucacccugcaccccaagaucgaggagggguucuucgaccucaugcacgugcagaaggugaugagcgccuccaccgucugcaagcugcagagcugcacgcacggcgugcccggggaccuccagguguaccacgucggcaaccuccugaagggcgacaaggugaacgggcacuccauccacaagaucgagagccaccugaacaccuccuggaugagcugggacggcugcgaccucgacuacuucugcaacaugggggacuggcccuccugcaccuacaccggcgugacgcagcacaaccacgccgccuucaucaacaugcugaacaucgagaccgacuacaccaagaccuuccacuuccacagcaagcgcgucacggcccacggggacacgccccagcuggaccucaaggcgcggccggccuacggcgccggcgagaucaccgugcugguggaggucgccgaccuggagcuccacaccaagaagaucgagguguccgggcugaaguucgccagccuguccugcagcggcugcuacgcgugcuccagcgggaucagcugcaaggugcgcauccacgucaacgagcccgacgaguucaccgugcacgugaaguccaacgaccccgacgucguggccgccggcagcucccucauggcccggaagaucgagagcggggcggacuccaccuucaaggccuucagcuccaugcccaagaacagccugugcuucuacaucguggagcgcgacuacugcuccagcugcaccgacgacgacacccagaagugcgucgacaucaagcuggagcacccgcaguccauccucaucgagcacaagggcacgaucaucggcaagcagaacgacacgugccccaccaagaccagcugcuggcuggaguccaucaagagcuucuucuacgggcugaagaacaugcucuccggcaucuucgggaacguguuccugggcaugcugcuguuccuggcccccuucauccugcucauccuguucuucuucuucggguggcggcuccuguucugccugaagugcugccgccggacccgcaagcugcugaaguacaagcaccuccgggacgaggaggagagcggcuacaagaagaucaucgagcgccugaacgacaagaagggcaagucccgccuguucgacggggagcggcucgccgaccgcaagaucgccgagcuguucagcaccaagacccacaucggcuga

SEQ ID NO: 11899 - RNA, 5103 nt, Artificial Sequence
  derived and/or modified CDS sequence (opt1) from CCHFV(ArD15786)__DQ211627.1__GP
auguuccugcacuucaaguucgugcuccugaccaacuucuucuucugccagcugcucuggggcgggggcggggucaccagcggcgggggcacgaacaccuccagcacccaggccauccugaucuccagcaacacccccaacuccacgaugagcgugcuggaguccagcaccggcaccgccgcggagaccgugccguccacgaccaucaacacccccgacacccaggucacgaccgacagcggguccggcgagagcuccaccgacccccagaccacgaacggggaggugcccagcaccuccaucgccaccaucaagacccaggagagcgagacgcgccggacccagaaccucuccaccaccgccggcagcggggccuccacgccgggcaacaccaccagcaacaagcccgacgugaaccugcugaccagccccaucuccgaggccaagagcucccccagcccguccaagacgagcacgccccagaccgcgcaccaccucucccgcagccugcuguccgccgccaccaccgagaccagccaggccgcguccgucaugaccaccacgcgggagaccaccaccaugagcucccccaccacggugaagaacagcgccaccgccacccccacccagggcaucacgaccuccaacaccagcaagcagaccgacacgaccacccucgagaucccgcccaagauccagaccacgcagucccagcagaccgccacccccgccaucacccccgcgacgaccgccaucgccuucaucagcccgaccaaccgcuccaagcgggagagcaaggugcagaucauccugaccuucagccaggggcugaagaaguacuacuccaagauccucaagcugcugcaccucacgcaggaggaggacagcgagggccugcuggaguggugcacccgcguccucgagcaggccugcgacgacgacuacuucaacgagcggaucgaggaguucuucaucaccgggaagggcuacuucaacgacgugcugcaguuccgccuguacgacaccuucuccacgaccgagagcacccagaacaccucccccacggccaagcccuuccggagcuacuacgcgaagggcucccucaccuucgacagcggguacuucuccgccaagugcuacccccgcgccagcaacuccggccugcagcugaucaacgugacccagcacagcgucaagaucgccaacaccccggggcccaagaucuccaaccccaagacgaucaacugcaucaaccucaaggugagcaccgacaaggaccacuccaagcuggagaucaacgugcugcucccccaggucgccgugaaccugagcaacugccacgugcugaucgagucccacgucugcgacuacagccucaacaccgacggcaccaucaagcugccgaagaucgcgcacaacggggccuucauccccggcacguacaagaucgugaucgacaagaagaacaagcugaacgaccggugcgcccucuucaccaacugcgugaucaagggccgcgagguccggcgcgggcagagcgcccugcggcaguaccgcaccgagauccggaucggccagaccuucaccgggucccgccggcugcucgccgagggcgggagcaacgacugcgugucccgcacgcagcuggugaagaccgaggucaccgagauccacgaggacagcuacggcggccccggggagaagaucaccaucugcaacggcuccacgaucguggaccagcggcuggggagcgagcucggcugcuacaccaucaaccgcguccgcaccuacaagcugugcgagaacuccgcgaccgagaaguccugcgagaucgacagcgugcccgugaagugcaagcagggguucugccugaagaucacgcaggagggccggggccacgucaagcucagccgcgggaccgagaucgugcuggacgugugcgacaccuccugcgagcugaugaucccgaagggcaccggggacauccucgucgacugcagcggcggccagcagcacuuccugcaggacaaccugaucgaccuggggugccccaacaucccccuccugggccagacggccaucuacgugugccggauguccaaccacccgaagaccaccauggccuuccuguucugguucagcuucggguacgugaucacgugcgucgugugcaaggugcuguucuaccugcugaucgucaucggcacccucgggaagcgccugaagcaguaccgggagcugaagccccagaccugcaucgugugcgaguccauccccgugaacgccaucgacgcggagaugcacgaccucaacugcaacuacaacaucugccccuacugcgccagccgccugaccuccgacggccugguccggcacgugacccagugcccgaagcgcaaggagaagguggaggagacggagcucuaccugaaccuggagcggauccccuggcucguccgcaagcugcuccaggugagcgaguccaccggcguggcccucaagcggagcugcuggaucaucacccugcugauccuccugaccgucagcaugucccccgugcagagcgcccccguggggcacaagcgcgccgucgagguguaccagauccgggaguccuacacgggcaucugccuguucgugcucgggggcguccuguucgcggugagcuggcuggugaaggcccucaucgacuccaucgggaacagcuucuucccgggccuguccaucugcaagaccugcagcaucggcuccaucaacggguucgagaucgagagccacaagugcuacugcucccugcucugcugccccuacugccgcgccugcagcuccgacaagaucacccaccggaugcaccugaacgucugcaagaagcgcaaggugggcagcaacgugaugcuggccgucugcaagcggaugugcuucaaggccaccaucgaggcgaacaaccgcgccacguucauccggaacaucaucaacuccaccuucgugaucugcauccucauccuggugaucugcgucgugagcaccuccgccguggacauggagaaccugcccgccgggaucugggagaaggaggaggaccucaccaacuucugccaccaggagugccaggucacggagaccgagugccugugccccuacgaggcccugaugcuccgcaagccgcugagccuggacuccaucgcgaagggcaugaagucccuccugaacagcaccagccuggagaccagccucuccaucgaggcccccuggggcgccaucaacgugcagagcacguucaagcccaccaucuccgccgcgaacaucgcccugagcugguccagcguggagcacaaggggaacaagauccuggucuccggccgcagcgaguccaucaugaagcucgaggagcggaccgggaucagcuggugccugggcguggaggacgccuccgagagcaagacccugaccguguccgucauggaccucagccagauguacucccccguguucgaguaccugagcggggaccgccagguggaggaguggccgaaggccacgugcaccggcgacugccccgagcggugcgggugcaccuccagcacgugccugcacaaggaguggccccacagccgcaacuggcggugcaaccccaccuggugcuggggcgucggcaccgggugcacgugcugcggccucgacgugaaggaccuguucaccgacuacaugcuggugaaguggaaggucgaguacaucaagaccgaggccaucaucugcguggagcucaccucccaggagcgccagugcagccugaucgaggcggggacccgguucaaccugggcccggucaccaucacgcucuccgagccccgcaacgugcagcagcggcugccgcccgagaucaucacccugcaccccaagaucgaggagggcuucuucgaccucaugcacgugcagaaggucaugagcgccuccaccgugugcaagcugcagagcugcacccacggggugcccggcgaccugcaggucuaccacguggggaaccuccugaagggcgacaaggugaacgggcacuccauccacaagaucgagagccaccugaacacguccuggaugagcugggacggcugcgaccucgacuacuucugcaacaugggcgacuggcccuccugcaccuacaccggggucacccagcacaaccgcgccgccuucaucaacaugcugaacaucgagacggacuacaccaagaccuuccacuuccacagcaagcgggugaccgcccacggcgacacgccgcagcuggaccucaaggcgcgccccaccuacggggccggcgagaucaccgugcuggucgagguggccgaccuggagcuccacaccaagaagaucgagguguccgggcugaaguucgccagccugacgugcuccggcugcuacgccugcagcuccggcaucagcugcaagguccggauccacgugaacgagcccgacgaguucaccgugcacgucaaguccaacgaccccgacgugguggcggccgggagcagccucauggcccgcaagaucgaguccggcgccgacagcaccuucaaggcguucuccagcaugccgaagaacucccugugcuucuacaucgucgagcgggacuacugcagcuccugcaccgacgacgacacgcagaagugcguggacaucaagcuggagcacccccagagcauccucaucgagcacaaggggaccaucaucggcaagcagaacgacacgugccccaccaagaccuccugcuggcuggagagcaucaaguccuucuucuacgggcugaagaacaugcucagcggcaucuucggcaacaucuuccuggggaugcugcuguuccuggcccccuucgugcugcucauccuguucuucuucuucggcuggcgccuccucuucugccugaagugcugccggcgcacccggaagcugcugaaguacaagcaccuccgcgacgaggaggaguccggguacaagaagaucaucgagcggcugaacgacaagaagggcaagagccgccuguucgacggcgagcgccucgccgaccggaagaucgccgagcuguucuccaccaagacccacgucggguga

SEQ ID NO: 11900 - RNA, 5100 nt, Artificial Sequence
  derived and/or modified CDS sequence (opt1) from CCHFV(UCCR4432)__KY484047.1__GP
auguucugccugcgccucgugcugcugaucaaccucgcccugugccagcugcucgagggcaacgacggggucaccagcgccgacgagaucaacuccaacaccacgcagaccagccugggccugcccaccauccucaacuccaccacgccggcgcccgggcccagcaucgacgccaccauggaggccgugcccggcaccaccaacuccgugcuggagacgcaggucaccauggacagcggguccggcgagcugagcaccgacccgaccacgacccgggaggccaccacccccaucacggccgcgaccguguccgcccaggagaccaagacccacaugacgcagaaccccggcaccaccguggaccccgacaccacgaccagcaacaccaccacguccaucgagccgaucaccaccccgcccaccagccccacgccccaggccacccccacccccuccuacagcgagacccccacgcucccgaacacccaccaccugucccgcagccugcucuccgccgucgggaccgaggcgggccagaccgcccccgccacccccacggccgagguggcccuggcgcccgggggcagcuccaccgccgagagcaacaccaucagcaucccggcccaggacaccacgaucuccggggugagcaagcaggacaaccccaccaccaccggcaucucccccgaggcccagacgaugcagagccagcaggccgucgcgcccgugaccaccccggccaccgccaucuccgcccccacgagccccaccaaccgguccaagcgcgagagcaaggugcagaucauccugaccuucccccagggccucaagaaguacuacuccaagauccugaaguuccugcaccucacccaggaggaggacagcgaggggcugcuggaguggugcacgcggguccuccagcaggucugcgacgacaccuacuucaacgagcgcaucaaggaguucuucaucaccggcaagggguacuucaacgacgugcugcaguucaagcugcacgacaccccggccacgaccguccccgcgcucgccgccuccagcaccgccaugcccuuccgguccuacuacgccaagggcagccugacccuggacuccggcuacuucagcgcgaagugcuacccgcgcgccuccaacagcgggaugcagcucaucaacgugacgcagcaccccaugaagaucgccaacacccccggccccaagaucuccaaccugaagaccaucaacugcaucaaccugaaggugagcaccgacaaggagcacagcgagcucgagaucaacguccugaucccccagguggccgugaaccuguccaacugcuucgucagcaucaagucccacgugugcgacuacagccucgacacggacggggcgauccggcugcccaagguggcccacaacggcgucuucaugcccgggaccuacaagaucgugaucgacaagaagaacaagcugaacgaccgcugcgcccucaucaccaacugcgucaucaagggccgggaggugcgcaagggccaguccacccugcggcaguacaagacggagauccgcaucgggcagaccaucgccggcagccggcgccugcucgccgaggggguguccaacgacugcgucagccggacccagcugaucaagaccgagguggcggagauccacgaggacuccuacggcgggcccggcgagaagaucacgaucugcaacggcagcaccaucguggaccagcgccugggguccgagcucggcugcuacaccaucaaccgggugaagaccuacaagcugugcgagaacagcgccaccgagaaggggugcgagaucgacuccgugccggugaagugcaagcagggcuucugccugaaggucacgcaggaggggcgcggccacgugaagcucagccggggcaccgagaucgugcuggacgucugcgacaccuccugcgagcugaugaucccgaaggggaccggcgacauccugguggacugcagcgggggccagcagcacuuccuccaggacaaccugaucgaccugggcugccccaacgugccccuccuggggaagauggccaucuacaucugccgcauguccaaccacccgaagacgaccauggccuuccuguucugguucagcuucggcuacgucaucacgugcaucgugugcaagguccucuucuaccugcugaucgugaucgggacccucagcaagaagcugaagcaguaccgcgagcugaagccccagaccugcaucgugugcgaguccacccccgugaacgccaucgacgcggagaugcacgagcucaacugcaacuacaacaucugccccuacugcgccagccggcugaccuccgacggccugguccgccacgugaaccagugcccgaagcggaaggagaagguggaggagaccgagcucuaccugaaccuggagcgcauccccuggcucguccggcgccugcugcaggucagcgaguccacggggauggcccucaagcggagcugcuggaugaccacccugcugauccuccugguggugucccugagccccgugcaguccgcccccgugggccagggcaaggccgucgagguguaccgcgugcgggagagcuacaccuccaucugccucuucguccuggggagcgugcuguucgcgguguccuggcucaucaagggccugaucgacgggaucggcaacagcuucuucccggggcuguccgucugcaagacgugcagcaucggcuccaucaacggcuucgagaucgagagccacaagugcuacugcucccucuucugcugccccuacugccgcgccugcagcagcgacaagaucacccaccggaugcaccugaacgugugcaagaagcgcaaggccggguccaacgugaugcuggccgucugcaagcggaugugcuucaaggcgaccguggaggccagcaacaccgcccuccugauccgcggcaucaucaacuccacguucgugaucugcguccugauccucgugaucugcguggucagcaccuccgccguggacauggagaaccugcccgccgggaucugggagcgggaggaggaccugaccaacuucugccaccaggagugccaggugaccgagacggagugccucugccccuacgaggcgcugauccugcgcaagccgcucuaccuggacagcaucgccaagggcaugaagucccugcucaacagcaccaaccuggagaccucccugagcaucgaggcccccuggggcgccaucaacguccaguccaccuucaagcccacggugagcgccgcgaacaucgcccucuccuggagcuccguggagcaccgggggaacaagauccuggucagcggccgcuccgagagcaucaugaagcuggaggagcggaccgggaucuccuggagccucggcguggaggacgccagcgaguccaagacccugaccgucagcgugauggaccugucccagauguacagcccgguguucgaguaccucuccggggaccgccaggucgaggaguggcccaaggccacgugcaccggcgacugccaggagcgcugcgggugcaccagcagcacgugccugcacaaggaguggccccacagccggaacuggcgcugcaaccccaccuggugcuggggcgugggcaccgggugcacgugcugcggccuggacgugcgggaccucuucaccgacuacaugauggucaaguggaagguggaguacgugaagaccgaggccaucaugugcgucgagcugaccucccaggagcgccagugcagccugaucgaggcggggacccgguucaaccucggcccggugaccaucacccuguccgagccccgcaacauccagcagcggcugcccagcgagaucgugacgcuccaccccaagaucgaggagggcuucuucgaccugaugcacguccagaaggugcuguccgccagcaccgugugcaagcuccaguccugcacccacggggucccgggcgaccuccagguguaccacguggggaaccugcucaagggcgacaaggucaacgggcacagcauccacaagaucgagucccacuucaacaccagcuggauguccugggacggcugcgaccuggacuacuucugcaacaugggcgacuggcccagcugcacguacaccggggugacccagcacaaccgcgccgccuucaucaacaugcugaacaucgagaccgacuacacgaagaccuuccacuuccacagcaagcgggugaccgcgcacggcgacacgccccagcucgaccugaaggcccgccccaccuacggggccggcgaggucaccgugcugguggaggucgccgaccucgagcugcacaccaagaagaucgagguguccgggcugaaguucgccagccucacgugcuccggcugcuacgcgugcagcuccggcaucagcugcaaggugcggauccacgucaacgagccggacgaguucaccgugcacgugaaguccagcgaccccgacgucguggccgccggguccagccugauggcccgcaagaucgaguucggcgccgacuccaccuucaaggcguucagcuccaugcccaagaacagccugugcuucuacaucguggagcgggacuacugcuccagcugcaccaacgacgacacccagaagugcgucgacacgaagcucgagcacccccaguccauccugaucgagcacaaggggaccaucaucggcaagcagaacgacacgugcagcaccaagaccuccugcuggcuggagagcgugaaguccuucuucuacgggcucaagaacaugcugggcggcaucuucgggaacguguuccugggcaucuuccucuuccuggccccguucgcccugcucaucuucuucuucuucuucggguggcgccugcuguucugccugaagugcugccggcgcacccggggccuccugaaguacaagcagcugaaggacgaggaggaggccggcuacaagaagaucaucgagcgccucaacgacaagaaggggaagucccggcuguucgacggcgagcgccuggccgaccggaagaucgcggagcuguucagcaccaagacccacaucggguga

SEQ ID NO: 11901 - RNA, 5100 nt, Artificial Sequence
  derived and/or modified CDS sequence (opt1) from CCHFV(Nakiwogo)__KX013484.1__GP
auguucugccugaagcucgugcugcugaucaaccucacccugugccagcugcucgagggcaacgaccgcgucaccagcgccgacgggaucaacuccaacacgacccagaccaaccugggcaucagcaccauccugaacuccacgacccccgccccggggcccagcaccgacaccacgauggagaccgugcccuccaccgcggacagcaugcucgagacccaggugacgaccgacuccggcagcggggagcccuccaccgagccgaccacgaccggcgaggccaccagcuccaccacggccgccaccgucagcaugcaggagaccaagaagcacaugacccagaacacgcgguccaccgccgaccccgacaccaccacgcccaacagcaccaccuccguggagcccaccacgaucccgcccaccagccccaucccccaggcgaccccgacccccggccacgggaaggcccccacgcugcccaacacccaccaccugucccgcagccuccuguccgccgugagcaccgaggccggccagaccaccccggcgacgagcaccaccgaggccgccuccgcccccagcuccagcuccaccgccgagaacaacacggucagccagcccgcgcaggacaccaccaccuccggggugagcgagcaguacaaccccacgaccaccggcaucuccccgaaggcccagaccaugcaggggcagcaggccaucgugcccgucacgacccccgugaccaccacguucacccccaccaacccgaccaaccggagcaagcgcgaguccaaggugcagaucauccugacguucccccagggccucaagaaguacuacagcaagauccugaagcugcuccaccugacccaggaggaggacuccgagggccugcucgaguggugcacccggguccugcagcaggugugcgacgacaccuacuucaacgagcgcaucgaggaguucuucaucacggggaagggcuacuucaacgacgugcugcaguucaagcuccacgacacccccaccaccacggucagcgcccuggccgcguccagcaccgccaugcccuuccgguccuacuacgccaaggggagccugacccucgacuccggcuacuucagcgccaagugcuacccgcgcgccagcaacuccggcaugcagcugaucaacgugacccagcaccccaugaagaucgcgaacacgcccgggccgaagaccagcaaccugaagaccaugaacugcaucaaccucaagguguccaccgacaaggagcacagcgagcuggagaucaacguccugaucccccagguggccgugaaccucuccaacugccuggucagcaucaagucccacgugugcgacuacagccuggacacggacggcgccauccggcuccccaagguggccuacaacggggucuucaugcccggcaccuacaagaucgugaucgacaagaagaaccgccugaacgaccggugcgcccugaucaccaacugcgucaucaaggggcgcgaggugcggaagggccaguccacccuccgccaguacaagaccgagauccggaucggccagacgcugauggggagccgccggcugcucgcggagggcguguccaacgacugcgucagccgcacccagcugaucaagaccgagguggccgagauccacgaggacuccuacgggggcccgggggagaagaucaccaucugcaacggcagcacgaucguggaccagcggcugggcuccgagcucgggugcuacaccaucaaccgcgucaagaccuacaagcugugcgagaacagcgccaccgagaagggcugcgagaucgacuccgugcccgugaagugcaagcagggguucugccugaaggucacgcaggagggccgggggcacgugaagcucagccgcggcaccgagaucgugcuggacgucugcgacaccagcugcgagcugaugauccccaagggcaccggggacauccugguggacugcuccggcgggcagcagcacuuccuccaggacaaccugaucgaccugggcugccccaacgugccgcuccugggcaagauggccaucuacaucugccgcaugagcaaccaccccaagacgaccauggcguuccuguucugguucuccuucggguacgucaucaccugcguggugugcaagguccucuucuaccugcugaucgugaucggcacccucgggaagaagcugaagcaguaccgggagcugaagccccagacgugcaucgugugcgagagcauccccgucaacgugaucgacgccgagaugcacgagcucaacugcaacuacaacaucugcccguacugcgccucccgccugaccagcgacggccuggugcggcacgucacccagugccccaagcgcaaggagaagguggaggagaccgagcucuaccugaaccuggagcggauccccuggcucgugcgccggcugcugcaggucuccgagagcacggggauggcccucaagcgcuccugcuggaugaccacccugcugauccuccugguggugagccugucccccguccagagcgccccggugggccaggagaaggcgaucgagguguaccagguccgggaguccuacaccagcaugugccucuucgugcugggcuccgugcuguucgccgucagcuggcucgugaaggggcugaucgacggcaucgggaacuccuucuuccccggccugagcgugugcaagacgugcuccaucgggagcaucaacggcuucgagaucgagagccacaagugcuacugcucccucuucugcugccccuacugccgcgccugcagcuccgacaagaucacccaccggaugcaccugaacaucugcaagcgccggaaggucggcagcaacgugaugcuggccgugugcaagcgcaugugcuucaaggccaccgucgaggcguccaacagcgcccuccugauccgguccaucaucaacagcaccuucgugaucugcgugcugauccucgucaucugcgugguguccacgagcgccgucgacauggagaaccugcccgccgggaucugggagcgcgaggaggaccugaccaacuucugccaccaggagugccaggugaccgagaccgagugccucugcccguacgaggcccugauccugcggaagccccucuaccuggacuccaucgcgaagggcaugaagagccugcucaacuccacgaaccuggagaccagccuguccaucgaggcccccuggggggccaucaacgugcagagcaccuucaagcccaccgucuccgccgcgaacaucgcccucagcugguccagcguggagcaccgcggcaacaagauccuggucagcgggcgguccgagagcaucaugaagcuggaggagcgcacgggcaucuccuggagccucggcguggaggacgccuccgagagcaagacccugaccguguccgucauggaccugagccagauguacuccccgguguucgaguaccucagcggggaccgccagguggaggaguggcccaaggccaccugcaccggcgacugccccgagcggugcgggugcacguccagcaccugccugcacaaggaguggccgcacucccgcaacuggcggugcaaccccaccuggugcuggggcgucgggaccggcugcacgugcugcggccuggacgugcgcgaccucuucaccgacuacaugauggugaaguggaaggucgaguacgugaagaccgaggccaucaugugcguggagcugaccagccaggagcggcagugcucccugaucgaggcggggacgcgcuucaaccucggccccgucaccaucacccugagcgagccccggaacgugcagcagcgccugccguccgagaucgugacccuccaccccaagaucgaggagggguucuucgaccugaugcacguccagaaggugcuguucugcaagcacagccuccaggccacguccugcacccacggcgugcccggcgaccugcaggucuaccacguggggaaccugcucaagggcgacaaggugaacgggcacagcauccacaagaucgagagccacuucaacaccuccuggaugagcugggacggcugcgaccuggacuacuucugcaacaugggggacuggcccuccugcaccuacacgggcgucacccagcacaaccgggccgccuucgugaacaugcugaacaucgagaccgacuacaccaagacguuccacuuccacagcaagcgcgugaccgcccacggcgacaccccgcagcucgaccugaaggcgcggcccaccuacggggccggcgaggucacggugcugguggaggucgccgaccucgagcugcacaccaagaagaucgagguguccgggcugaaguucgccagccucaccugcuccggcugcuacgccugcagcuccgggaucagcugcaaggugcgcauccacgucaacgagcccgacgaguucaccgugcacgugaaguccaacgaccccgacgucguggcggccggcagcucccugauggcccggaagaucgagcugggcgccgacagcacguucaaggcguucuccagcaugccgaagaacucccucugcuucuacaucguggagcgcgacuacugcagcuccugcaccgacgacgacacccagaagugcgucaacaccaagcuggagcacccccagagcauccugaucgagcacaaggggacgaucaucggcaagcagaacgacaccugccccaccaagaccagcugcuggcucgaguccgugaagagcuucuucuacgggcugaagaacaugcugggcgggaucuucggcaacguguuccucggcaucuuccuguuccuggcccccuucgcccuccugauccuguucuucuucuucggguggcggcugcucuucugccugaagugcugccgccggacgcgcggccugcucaaguacaagcagcugaaggacgaggaggaggccggguacaagaagaucaucgagcggcugaacgacaagaagggcaagucccgccucuucgacggcgagcggcuggccgaccgcaagaucgcggagcuguucagcaccaagacccacaucggguga

SEQ ID NO: 11902 - RNA, 5100 nt, Artificial Sequence
  derived and/or modified CDS sequence (opt1) from CCHFV(UG3010)__AY900143.1__GP
auguucugccugcgccucgugcugcugaucaaccucgcccugugccagcugcucgagggcaacgacggggucaccagcgccgacgagaucaacuccaacaccacgcagaccagccugggccugcccaccauccucaacuccaccacgccggcgcccgggcccagcaucgacgccaccauggaggccgugcccggcaccaccaacuccgugcuggagacgcaggucaccauggacagcggguccggcgagcugagcaccgacccgaccacgacccgggaggccaccacccccaucacggccgcgaccguguccgcccaggagaccaagacccacaugacgcagaaccccggcaccaccguggaccccgacaccacgaccagcaacaccaccacguccaucgagccgaucaccaccccgcccaccagccccacgccccaggccacccccacccccuccuacagcgagacccccacgcucccgaacacccaccaccugucccgcagccugcucuccgccgucgggaccgaggcgggccagaccgcccccgccacccccacggccgagguggcccuggcgcccgggggcagcuccaccgccgagagcaacaccaucagcaucccggcccaggacaccacgaucuccggggugagcaagcaggacaaccccaccaccaccggcaucucccccgaggcccagacgaugcagagccagcaggccgucgcgcccgugaccaccccggccaccgccaucuccgcccccacgagccccaccaaccgguccaagcgcgagagcaaggugcagaucauccugaccuucccccagggccucaagaaguacuacuccaagauccugaaguuccugcaccucacccaggaggaggacagcgaggggcugcuggaguggugcacgcggguccuccagcaggucugcgacgacaccuacuucaacgagcgcaucaaggaguucuucaucaccggcaagggguacuucaacgacgugcugcaguucaagcugcacgacaccccggccacgaccguccccgcgcucgccgccuccagcaccgccauccccuuccgguccuacuacgccaagggcagccugacccuggacuccggcuacuucagcgcgaagugcuacccgcgcgccuccaacagcgggaugcagcucaucaacgugacgcagcaccccaugaagaucgccaacacccccggccccaagaucuccaaccugaagaccaucaacugcaucaaccugaaggugagcaccgacaaggagcacagcgagcucgagaucaacguccugaucccccagguggccgugaaccuguccaacugcuucgucagcaucaagucccacgugugcgacuacagccucgacacggacggggcgauccggcugcccaagguggcccacaacggcgucuucaugcccgggaccuacaagaucgugaucgacaagaagaacaagcugaacgaccgcugcgcccucaucaccaacugcgucaucaagggccgggaggugcgcaagggccaguccacccugcggcaguacaagacggagauccgcaucgggcagaccaucgccggcagccggcgccugcucgccgaggggguguccaacgacugcgucagccggacccagcugaucaagaccgagguggcggagauccacgaggacuccuacggcgggcccggcgagaagaucacgaucugcaacggcagcaccaucguggaccagcgccugggguccgagcucggcugcuacaccaucaaccgggugaagaccuacaagcugugcgagaacagcgccaccgagaaggggugcgagaucgacuccgugccggugaagugcaagcagggcuucugccugaaggucacgcaggaggggcgcggccacgugaagcucagccggggcaccgagaucgugcuggacgucugcgacaccuccugcgagcugaugaucccgaaggggaccggcgacauccugguggacugcagcgggggccagcagcacuuccuccaggacaaccugaucgaccugggcugccccaacgugccccuccuggggaagauggccaucuacaucugccgcauguccaaccacccgaagacgaccauggccuuccuguucugguucagcuucggcuacgucaucacgugcaucgugugcaagguccucuucuaccugcugaucgugaucgggacccucagcaagaagcugaagcaguaccgcgagcugaagccccagaccugcaucgugugcgaguccacccccgugaacgccaucgacgcggagaugcacgagcucaacugcaacuacaacaucugccccuacugcgccagccggcugaccuccgacggccugguccgccacgugaaccagugcccgaagcggaaggagaagguggaggagaccgagcucuaccugaaccuggagcgcauccccuggcucguccggcgccugcugcaggucagcgaguccacggggauggcccucaagcggagcugcuggaugaccacccugcugauccuccugguggugucccugagccccgugcaguccgcccccgugggccagggcaaggccgucgagguguaccgcgugcgggagagcuacaccuccaucugccucuucguccuggggagcgugcuguucgcgguguccuggcucaucaagggccugaucgacgggaucggcaacagcuucuucccggggcuguccgucugcaagacgugcagcaucggcuccaucaacggcuucgagaucgagagccacaagugcuacugcucccucuucugcugccccuacugccgcgccugcagcagcgacaagaucacccaccggaugcaccugaacgugugcaagaagcgcaaggccggguccaacgugaugcuggccgucugcaagcggaugugcuucaaggcgaccguggaggccagcaacaccgcccuccugauccgcggcaucaucaacuccacguucgugaucugcguccugauccucgugaucugcguggucagcaccuccgccguggacauggagaaccugcccgccgggaucugggagcgggaggaggaccugaccaacuucugccaccaggagugccaggugaccgagacggagugccucugccccuacgaggcgcugauccugcgcaagccgcucuaccuggacagcaucgccaagggcaugaagucccugcucaacagcaccaaccuggagaccucccugagcaucgaggcccccuggggcgccaucaacguccaguccaccuucaagcccacggugagcgccgcgaacaucgcccucuccuggagcuccguggagcaccgggggaacaagauccuggucagcggccgcuccgagagcaucaugaagcuggaggagcggaccgggaucuccuggagccucggcguggaggacgccagcgaguccaagacccugaccgucagcgugauggaccugucccagauguacagcccgguguucgaguaccucuccggggaccgccaggucgaggaguggcccaaggccacgugcaccggcgacugccaggagcgcugcgggugcaccagcagcacgugccugcacaaggaguggccccacagccggaacuggcgcugcaaccccaccuggugcuggggcgugggcaccgggugcacgugcugcggccuggacgugcgggaccucuucaccgacuacaugauggucaaguggaagguggaguacgugaagaccgaggccaucaugugcgucgagcugaccucccaggagcgccagugcagccugaucgaggcggggacccgguucaaccucggcccggugaccaucacccuguccgagccccgcaacauccagcagcggcugcccagcgagaucgugacgcuccaccccaagaucgaggagggcuucuucgaccugaugcacguccagaaggugcuguccgccagcaccgugugcaagcuccaguccugcacccacggggucccgggcgaccuccagguguaccacguggggaaccugcucaagggcgacaaggucaacgggcacagcauccacaagaucgagucccacuucaacaccagcuggauguccugggacggcugcgaccuggacuacuucugcaacaugggcgacuggcccagcugcacguacaccggggugacccagcacaaccgcgccgccuucaucaacaugcugaacaucgagaccgacuacacgaagaccuuccacuuccacagcaagcgggugaccgcgcacggcgacacgccccagcucgaccugaaggcccgccccaccuacggggccggcgaggucaccgugcugguggaggucgccgaccucgagcugcacaccaagaagaucgagguguccgggcugaaguucgccagccucacgugcuccggcugcuacgcgugcagcuccggcaucagcugcaaggugcggauccacgucaacgagccggacgaguucaccgugcacgugaaguccagcgaccccgacgucguggccgccggguccagccugauggcccgcaagaucgaguucggcgccgacuccaccuucaaggcguucagcuccaugcccaagaacagccugugcuucuacaucguggagcgggacuacugcuccagcugcaccaacgacgacacccagaagugcgucgacacgaagcucgagcacccccaguccauccugaucgagcacaaggggaccaucaucggcaagcagaacgacacgugcagcaccaagaccuccugcuggcuggagagcgugaaguccuucuucuacgggcucaagaacaugcugggcggcaucuucgggaacguguuccugggcaucuuccucuuccuggccccguucgcccugcucaucuucuucuucuucuucggguggcgccugcuguucugccugaagugcugccggcgcacccggggccuccugaaguacaagcagcugaaggacgaggaggaggccggcuacaagaagaucaucgagcgccucaacgacaagaaggggaagucccggcuguucgacggcgagcgccuggccgaccggaagaucgcggagcuguucagcaccaagacccacaucggguga

SEQ ID NO: 11903 - RNA, 5100 nt, Artificial Sequence
  derived and/or modified CDS sequence (opt1) from CCHFV(Semunya)__DQ094832.1__GP
auguucugccugaagcucgugcugcugaucaaccucgcccugugccagcugcucgagggcaacgaccgcgucaccagcgccgacgggaucaacuccaacaccacgcagaccaaccugggcaucagcaccauccugaacuccaccacgcccgcgccggggcccagcaccgacaccaccauggagacggugcccuccaccgccgacagcaugcucgagacccaggugaccacggacuccggcagcggggagcccuccaccgagccgaccaccacgggcgaggccaccagcuccaccaccgccgccacggucagcaugcaggagaccaagacccacaugacccagaacacgcgguccaccgcggaccccgacaccaccacgcccaacaccaccaccagcguggagcccacgaccaucccgcccaccucccccauccugcaggccacccccacgccgggccacgggaaggcccccacccugcccaacacccaccaccucagccgcucccugcugagcgccguguccaccgaggcgggccagaccacgcccgccaccagcaccaccgaggccgccagcgccccguccagcuccagcacggcggagaacaacaccauguuccagcccgcccaggacaccaccacguccggggucagcgagcaguacaaccccaccaccaccggcaucucccccaaggcccagacgaugcaggcccagcaggccaucgugccggugaccacccccgucaccacgaccuucacccccaucaaccccaccaaccggagcaagcgcgaguccaaggugcagaucauccucacguucccgcaggggcugaagaaguacuacagcaagauccugaagcuccugcaccugacccaggaggaggacuccgagggccuccuggaguggugcacccgggugcugcagcaggucugcgacgacaccuacuucaacgagcgcaucgaggaguucuucaucacgggcaagggguacuucaacgacgugcuccaguucaagcugcacgacacccccaccaccacggugcccgcgcuggccgccagcuccaccgccaugcccuuccggagcuacuacgccaagggcucccucacccuggacagcggguacuucuccgcgaagugcuacccgcgcgccagcaacuccggcaugcagcugaucaacgucacccagcaccccaugaagaucgccaacacgcccggcccgaagaccagcaaccucaagaccaugaacugcaucaaccugaaggugagcaccgacaaggagcacuccgagcuggagaucaacgugcucaucccccaggucgccgugaaccugagcaacugccugguguccaucaagagccacgucugcgacuacucccucgacacggacggggccauccggcugcccaagguggcguacaacggcguguucaugcccgggaccuacaagaucgucaucgacaagaagaaccgccugaacgaccggugcgcccucaucaccaacugcgugaucaagggccgcgagguccggaaggggcagagcacccugcgccaguacaagaccgagauccggaucggccagacgcugaugggcucccgccggcuccuggccgagggggugagcaacgacugcgugucccgcacccagcugaucaagaccgaggucgccgagauccacgaggacagcuacggcgggccgggcgagaagaucaccaucugcaacggguccacgaucguggaccagcggcucggcagcgagcugggcugcuacaccaucaaccgcgugaagaccuacaagcugugcgagaacuccgcgaccgagaaggggugcgagaucgacagcguccccgugaagugcaagcagggcuucugccucaaggugacgcaggaggggcggggccacgucaagcugucccgcgggaccgagaucgugcuggacgugugcgacaccagcugcgagcugaugauccccaagggcaccggcgacauccucgucgacugcuccgggggccagcagcacuuccugcaggacaaccugaucgaccucgggugccccaacgugccgcugcugggcaagauggccaucuacaucugccgcaugagcaaccaccccaagacgaccauggccuuccucuucugguucagcuucggcuacgugaucaccugcgucgugugcaaggugcuguucuaccugcucaucgucaucgggacccugggcaagaagcugaagcaguaccgggagcucaagccccagacgugcaucgugugcgaguccauccccgugaacgccaucgacgccgagaugcacgagcugaacugcaacuacaacaucugcccguacugcgcgagccgccugaccuccgacgggcucguccggcacgugacccagugccccaagcgcaaggagaagguggaggagaccgagcuguaccugaaccucgagcggauccccuggcugguccgccggcugcuccaggugagcgaguccacgggcauggcccugaagcgcagcugcuggaugaccacccugcucauccugcugguggucucccucagccccgugcaguccgccccgguggggcaggagaaggccaucgaggucuaccaggugcgggagagcuacaccuccaucugccuguucgugcugggcagcguccucuucgccguguccuggcuggugaagggccugaucgacgggaucggcaacagcuucuuccccgggcucuccgucugcaagacgugcagcaucggcuccaucaacggguucgagaucgagagccacaagugcuacugcucccuguucugcugccccuacugccgcgcgugcagcagcgacaagaucacccaccggaugcaccugaacaucugcaagcgccggaaggugggcuccaacgugaugcucgccgucugcaagcgcaugugcuucaaggccaccguggaggccagcaacuccgcccugcugauccggagcaucaucaacuccaccuucgugaucugcguccucauccuggugaucugcguggucagcacguccgcgguggacauggagaaccugcccgccggcaucugggagcgcgaggaggaccucaccaacuucugccaccaggagugccaggugaccgagaccgagugccugugcccguacgaggcccugauccuccggaagccccuguuccuggacagcaucgccaaggggaagaagucccuccugaacagcacgaaccuggagaccucccucagcaucgaggcgcccuggggcgccaucaacguccaguccaccuucaagcccaccgugagcgccgccaacaucgcccuguccuggagcuccguggagcaccgcgggaacaagauccuggucagcggccgguccgagagcaucaugaagcucgaggagcgcacggggaucagcuggucccugggcguggaggacgcgagcgaguccaagacccugaccgucagcgugauggaccucucccagauguacagcccgguguucgaguaccuguccggcgaccgccaggucgaggaguggcccaaggccaccugcaccggggacugccccgagcggugcggcugcacgagcuccaccugccugcacaaggaguggccgcacagccgcaacuggcggugcaaccccaccuggugcuggggggugggcaccgggugcacgugcugcggccucgacgugcgcgaccuguucaccgacuacaugauggucaaguggaagguggaguacgugaagaccgaggccaucaugugcgucgagcugaccucccaggagcggcagugcagccucaucgaggccggcacgcgcuucaaccuggggcccgugaccaucacccuguccgagccccggaacgugcagcagcgccucccgagcgagaucgucacccugcaccccaagaucgaggagggcuucuucgaccugaugcacgugcagaaggugcucuucugcaaguacucccugcaggccacgagcugcacccacgggguccccggcgaccugcagguguaccacgugggcaaccuccugaagggggacaaggucaacggccacuccauccacaagaucgagagccacuucaacaccuccuggaugagcugggacgggugcgaccuggacuacuucugcaacaugggcgacuggcccagcugcaccuacacgggggugacccagcacaaccgggcggccuucgugaacaugcucaacaucgagaccgacuacaccaagacguuccacuuccacuccaagcgcgucaccgcccacggcgacaccccgcagcuggaccugaaggcccggcccaccuacggcgccggggaggugacggugcucgucgagguggcggaccuggagcugcacaccaagaagaucgaggugagcggccucaaguucgccucccugaccugcagcgggugcuacgccugcuccagcggcaucuccugcaagguccgcauccacgugaacgagcccgacgaguucaccgugcacgucaagagcaacgaccccgacgugguggccgcgggguccagccugauggcccggaagaucgaguucggcgccgacuccacguucaaggccuucagcuccaugccgaagaacagccucugcuucuacaucgucgagcgcgacuacugcuccagcugcaccgacgacgacacccagaagugcgugaacaucaagcuggagcacccccaguccauccugaucgagcacaagggcaccaucaucgggaagcagaacgacacgugccccaccaagaccagcugcuggcucgaguccgugaagagcuucuucuacggccugaagaacaugcuggggggcaucuucgggaacgucuuccucggcaucuuccuguuccuggcccccuucgcgcuccugauccuguucuucuucuucggcuggcggcugcucuucugccugaagugcugccgccggacccgcgggcugcucaaguacaagcagcugaaggacgaggaggaggccggcuacaagaagaucaucgagcggcugaacgacaagaaggggaagagccgccucuucgacggcgagcggcuggccgaccgcaagaucgccaagcuguucuccacgaagacccacaucggcuga

SEQ ID NO: 11904 - RNA, 5094 nt, Artificial Sequence
  derived and/or modified CDS sequence (opt1) from CCHFV(79121)__AB069673.1__GP
augcuguuccacuucaaguucaugcuccugaucaacuucauccugugccaccuccuguggggcgggggcggggugaccggcggggucgagaccaacagcuccagcacgcaggccauccagacccccccggugaccuccaacagcaccacgcccggccccuccaccgacaccgccaccgagacggcgagcuccaugaccaccagcacccccgacacgcaggugaccaccgacaacggcuccggggagccgagcaccgacccccugacgaccaacgaggccacccccccccucuccgucaccacggcccagaccaccgagaccaagaagcacacgacccuggacccgagcaccuccaccaaccccgacgccacgacccccagcaucaccauccuguccgccagcaacaccucccuccccaucagcuccgugcacgcgagcccgagccccuccagcuccgaggagcccacgccccagaacgcccaccaccugagccgcucccugcucagcgccguguccaccgagaccggccagaucgccagcgcggccaccgccgccaaggagaucacgaccaagaacuccccgcccaccgccgggaacgacaccauggucaccagcgcgcccaacggcaacauccggaacacgcccgagcaggccaacccgaccgcccccgaggccucccccaagauccagaccacccagaaccagcagacggugacccccgaggccaccccgaucaccacgaucaccgcgcugaccgaccugaccaaccgcagcaagcgggacuccaaggugcagaagauccucacguucagccaggggcugaagaaguacuacuccaagauccugaagcuccugcagcugacccaggaggaggacagcgagggccuccuggaguggugcacccgcguccuggagcaggccugcgacgacgacuacuucaacaagcggaucgaggaguucuucaucaccggcaagggguacuucaacgacgugcuccaguuccgccugcacgacgcccuguccaacacggagcccgcccagaccaccagccccaccgccgugcccuucaaguccuacuacgcgaagggcagccucacguucgacagcggguacuucuccgcccggugcuacccgcgcgccagcaacuccggccugcagcugaucaacgucacccagcaccccgugaagaucgccaacacccccggcccgaagcucagcaaccugaagaccaucaacugcaucaaccugaagguguccacggacaaggagcacagcgagcucgaggucaacgugcugcugccccagguggccgucaaccucuccaacugccacgugagcaucaagucccacgugugcgacuacagccuggacaccgacggggcgaucaagcugccccgggucgcccacaacggcguguucauccccgggaccuacaagaucgugaucgacaagaagaacaaccucaacgaccgcugcacccugaucacgaacugcgucaucaagggccgggaggugcgcaaggggcaguccgcccugcggcaguacaagaccgagauccgcaucggccagaccuucaccggcagccggcgccuccuggccgaggggggcuccagcgacugcaucucccggacgcagcuggucaagaccgagguggcggagauccacgaggacagcuacgggggcccgggggagaagaucaccaucugcaacggcuccaccaucguggaccagggccucgggagcgagcugggcugcuacacgaucaaccgcguccggagcuacaagcugugcgagaacuccgccagcgggaaguccugcgagaucgacagcauccccgugaagugcaagcagggcuucugccucaagaucacccaggaggggcgcggccacgugaagcugucccggggcaccgagaucguccuggacgugugcgacagcuccugcgagcugaugauccccaaggggaccggcgacauccucguggacugcagcgggggccagcagcacuuccugcagaacaaccugaucgaccucggcugccccaacgucccgcugcuggggaagauggccaucuacgugugccgcauguccaaccaccccaagaccacgauggccuuccucuucugguucagcuucggcuacgugaucaccugcaucgccugccgcguccuguucuaccugcucaucgcgaucgggaccgugggcaagaagcugaagcaguaccgggagcugaagccccagaccugcaucgugugcgaguccguccccgugaacgccaucgacgccgagaugcacgagcucaacugcagcuacaacaucugcccguacugcgccucccgccugagcacggacgggcugauccggcacgugacccagugccccaagcgccgggagaaggucgaggagaccgagcucuuccugaaccuggagcgcauccccuggcucgugcggaagcugcugcagguguccgagagcaccggcauggcccucaagcgcuccugcuggaugaucacgcugcugauccuccugcuggucagcaucucccccgugcagagcgcgccggugggcaaggagcgggccaucgagaccuaccaggcccgcgagaccuacaccgggaucugccucuucguccugggcagcgugcuguucgccguguccuggcucacgaaggcccugaucgacgggaucggcaacagcuucucccccgggcugagcgucugcaagaccugcuccaucggcagcaucaacggcuucgagaucgagucccacaagugcuacugcagccucuucugcugccccuacugccgggcgugcuccagcgacaagaacacccaccgcaugcaccugaacgugugcaagaagcggaagaugggguccaacgugaugcuggccgucugcaagcgcaugugcuuccgggccaccaucgaggccagcaacaaggcgcuccugauccgcuccaucaucaacagcacguucgugaucugcauccugauccucaccaucugcguggucuccaccagcgccguggacauggagaaccugcccgccggcaucugggagaaggaggaggaccugaccaacuucugccaccaggagugccaggugacggagaccgagugccucugcccguacgaggccaugguccugcggaagccccuguuccucgacuccaccgccaaggggaugaagagccugcugaacuccaccagccucgagacgagccuguccaucgaggcgcccuggggcgccaucaacgugcagagcaccuucaagcccaccguguccgccgccaacaucgcccugagcugguccagcgucgagcaccgcgggaacaagauccucguguccggccggagcgaguccaucaugaagcuggaggagcgcaccggcgugagcuggaaccugggggucgaggacgcguccgagagcaagacgcucaccguguccgugauggaccugagccagauguacuccccggucuucgaguaccugagcggcgaccgccagguggaggaguggcccaaggccaccugcaccggggacugccccgagcggugcggcugcacguccagcaccugccuccacaaggaguggccgcacucccgcaacuggcggugcaaccccaccuggugcuggggggugggcaccggcugcacgugcugcgggcuggacgucaaggacuucuucaccgacuacaugcuggugaaguggaagguggaguacaucaagaccgaggccaucgucugcguggagcucaccagccaggagcgccagugcagccugaucgaggccggcacccgguucaaccuggggcccgucacgaucacccucuccgagccccgcaacgugcagcagcggcugccgcccgagaucgugacccugcaccccaagaucgaggagggcuucuucgaccucaugcacguccagaagauccugagcgccuccaccgugugcaagcugcagagcugcacgcacggcgugcccggggacuuccagaucuaccacgucggcaaccuccugcgcggggacaaggugaacggccacuccauccacaagaucgagccgcacuucaacaccagcuggauguccugggacgggugcgaccuggacuacuucugcaacaugggcgacuggcccagcugcaccuacaccggcgugacgcagcacaaccgggcggccuucaucaacaugcucaacaucgagaccgacuacaccaagaccuuccacuuccacuccaagcgcgucacggcccacggggacaccccccagcuggaccugaaggcccggcccgcguacggcgccggggaggugaccgugcucgucgagguggccgaccuggagcugcacaccaagaaccucgaggugagcggccugaagaucgccucccugacgugcagcgggugcuacgccugcuccagcggcaucuccugcaagguccgcauccacgugaacgagccggacgaguucaccgugcacguccggagcuccgaccccgacgugguggcggccggcagcucccucauggcccgcaagaucgaguucggggccgacagcaccuucaaggccuucagcuccaugcccaaggacagccugugcuucuacaucgucgagaaggacuacugcuccagcugcaccgacgacgacacgcagaagugcgugaacaccaagcuggaccacccccaguccauccucaucgagcacaagggcaccaucaucgggaagcagaacgacaccugcagcacgaagaccuccugcuggcuggagagcgugaagggcuucuucuacgggcugaagaacaugcucuccggcaucuucggcaacgucuuccuggggaucuuccuguuccucgcgccguucgugcugcugaucuucuucuucuucuucggcuggcggcuccuguucugccugaagugcugccgccggacccgcgggcugcucaaguacaagcaccugaaggacgaggaggaggccggcuacaagaagaucaucgagcggcugaacggcaagaaggggaagagccagcucuucgacggcgagcgccuggccgaccggaagaucgccgagcuguucuccaccaagauccacaucggguga

SEQ ID NO: 11905 - RNA, 5094 nt, Artificial Sequence
  derived and/or modified CDS sequence (opt1) from CCHFV(7001)__AB069670.1__GP
augcuguuccacuucaaguucaugcuccugaucaacuucauccugugccaccuccuguggggcgggggcggggugaccggcggggucgagaccaacagcuccagcacgcaggccauccagacgcccccggugaccuccaacagcaccacccccggccccuccaccgacaccgccaccgagacggcgagcuccaugaccaccagcacccccgacacgcaggucaccaccgacaacggcuccggggagccgagcaccgacccccugacgaccaacgaggccaccccgccccucuccgucaccacggcccagaccaccgagaccaagaagcacacgacccuggaccccagcaccuccaccaaccccgacgccacgacccccagcaucaccauccuguccgccagcaacaccucccuccccaucagcuccgugcacgcgagcccgagccccuccagcuccgaggagcccacgccccagaacgcccaccaccugagccgcucccugcucagcgccguguccaccgagaccggccagaucgccagcgcggccaccgccgccaaggagaucacgaccaagaacuccccgcccaccgccgggaacgacaccauggucaccagcgcgcccaacggcaacauccggaacacgcccgagcaggccaacccgaccgcccccgaggccucccccaagauccagaccacccagaaccagcagacggugacccccgaggccaccccgaucaccacgaucaccgcgcugaccgaccugaccaaccgcagcaagcgggacuccaaggugcagaucauccucacguucagccaggggcugaagaaguacuacuccaagauccugaagcuccugcagcugacccaggaggaggacagcgagggccuccuggaguggugcacccgcguccuggagcaggccugcgacgacgacuacuucaacaagcggaucgaggaguucuucaucaccggcaagggguacuucaacgacgugcuccaguuccgccugcacgacgcccuguccaacacggagcccgcccagaccaccagccccaccgccgugcccuucaaguccuacuacgcgaagggcagccucacguucgacagcggguacuucuccgcccggugcuacccgcgcgccagcaacuccggccugcagcugaucaacgucacccagcaccccgugaagaucgccaacacccccggcccgaagcucagcaaccugaagaccaucaacugcaucaaccugaagguguccacggacaaggagcacagcgagcucgaggucaacgugcugcugccccagguggccgucaaccucuccaacugccacgugagcaucaagucccacgugugcgacuacagccuggacaccgacggggcgaucaagcugccccgggucgcccacaacggcguguucauccccgggaccuacaagaucgugaucgacaagaagaacaaccucaacgaccgcugcacccugaucacgaacugcgucaucaagggccgggaggugcgcaaggggcaguccgcccugcggcaguacaagaccgagauccgcaucggccagaccuucaccggcagccggcgccuccuggccgagggcggguccagcgacugcaucucccggacgcagcuggucaagaccgagguggcggagauccacgaggacagcuacgggggcccgggggagaagaucaccaucugcaacggcuccaccaucguggaccagcgccucggcagcgagcuggggugcuacacgaucaaccgggugcgcagcuacaagcugugcgagaacuccgccagcggcaaguccugcgagaucgacagcauccccgugaagugcaagcagggguucugccucaagaucacccaggagggccgggggcacgugaagcugucccgcggcaccgagaucguccuggacgugugcgacagcuccugcgagcugaugauccccaagggcaccggggacauccucguggacugcagcggcgggcagcagcacuuccugcagaacaaccugaucgaccucggcugccccaacgucccgcugcugggcaagauggccaucuacgugugccgcauguccaaccaccccaagaccacgauggccuuccucuucugguucagcuucggguacgugaucacgugcaucgccugccggguccuguucuaccugcucaucgcgaucggcaccguggggaagaagcugaagcaguaccgcgagcugaagccccagaccugcaucgugugcgaguccguccccgugaacgccaucgacgccgagaugcacgagcucaacugcagcuacaacaucugcccguacugcgccucccggcugagcaccgacggccugauccgccacgugacccagugccccaagcggcgcgagaaggucgaggagaccgagcuguuccucaaccuggagcggauccccuggcucgugcgcaagcugcugcaggucuccgagagcaccgggauggcccucaagcgguccugcuggaugaucacgcugcugauccuccugcuggugagcaucucccccgugcagagcgcgccggugggcaaggagcgcgccaucgagaccuaccaggcccgggagaccuacaccggcaucugccucuucguccuggggagcgugcuguucgccguguccuggcucacgaaggcccugaucgacggcaucgggaacagcuucuuccccggccuguccgucugcaagaccugcagcaucggguccaucaacggcuucgagaucgagagccacaagugcuacugcucccucuucugcugccccuacugccgcgcgugcagcuccgacaagaacacccaccggaugcaccugaacgugugcaagaagcgcaagaugggcagcaacgugaugcuggccgucugcaagcggaugugcuuccgcgccaccaucgaggccuccaacaaggcgcuccugauccggagcaucaucaacuccacguucgugaucugcauccugauccucaccaucugcguggucagcaccuccgccguggacauggagaaccugcccgccgggaucugggagaaggaggaggaccugaccaacuucugccaccaggagugccaggugacggagaccgagugccucugcccguacgaggccaugguccugcgcaagccccuguuccucgacaacaucgccaagggcaugaagucccugcugaacagcaccagccucgagaccucccugagcaucgaggcgcccuggggcgccaucaacgugcagagcacguucaagcccaccguguccgccgccaacaucgcccugagcugguccagcgucgagcaccgggggaacaagauccucguguccgggcgcagcgaguccaucaugaagcuggaggagcgcaccggcgugagcuggaaccugggcgucgaggacgcguccgagagcaagacccucacgguguccgugauggaccugagccagauguacuccccggucuucgaguaccugagcggggaccgccagguggaggaguggcccaaggcgaccugcaccggcgacugccccgagcggugcgggugcaccuccagcacgugccuccacaaggaguggccgcacucccggaacuggcgcugcaaccccaccuggugcuggggcguggggaccggcugcacgugcugcggccuggacgucaaggacuucuucaccgacuacaugcuggugaaguggaagguggaguacaucaagaccgaggccaucgucugcguggagcucaccagccaggagcggcagugcucccugaucgaggccgggacccgcuucaaccugggccccgucaccaucacgcucagcgagccccggaacgugcagcagcgccugccgcccgagaucgugacccugcaccccaagaucgaggagggguucuucgaccucaugcacguccagaagauccugagcgccuccaccgugugcaagcugcagagcugcacccacggcgugcccggcgacuuccaggucuaccacguggggaaccuccugcggggcgacaaggugaacgggcacuccauccacaagaucgagccgcacuucaacacgagcuggauguccugggacggcugcgaccuggacuacuucugcaacaugggggacuggcccagcugcaccuacaccggcgucacccagcacaaccgcgccgccuucaucaacaugcucaacaucgagacggacuacaccaagaccuuccacuuccacuccaagcgggugaccgcccacggcgacacgccccagcuggaccugaaggcccgccccgcguacggggccggcgaggugaccguccucguggagguggccgaccuggagcugcacaccaagaagcucgaggucagcgggcugaagaucgccucccugaccugcagcggcugcuacgccugcuccagcgggaucuccugcaaggugcggauccacgugaacgagccggacgaguucacgguccacgugcgcagcuccgaccccgacguggucgcggccggcagcucccucauggcccggaagaucgaguucggcgccgacagcaccuucaaggccuucuccagcaugcccaaggacagccugugcuucuacaucguggagaaggacuacugcuccagcugcaccgacgacgacacccagaagugcgugaacacgaagcuggaccacccccaguccauccucaucgagcacaaggggaccaucaucggcaagcagaacgacacgugcagcaccaagaccuccugcuggcuggagagcgucaagggguucuucuacggccugaagaacaugcucuccgggaucuucggcaacguguuccugggcaucuuccuguuccucgcgccguucgugcugcugaucuucuucuucuucuucggguggcgccuccuguucugccugaagugcugccggcgcacccggggccugcucaaguacaagcaccugaaggacgaggaggaggccggguacaagaagaucaucgagcgccugaacggcaagaagggcaagagccagcuguucgacggggagcggcucgccgaccgcaagaucgccgagcuguucuccaccaagauccacaucggcuga

SEQ ID NO: 11906 - RNA, 5094 nt, Artificial Sequence
  derived and/or modified CDS sequence (opt1) from CCHFV(YL16070)__KY354081.1__GP
augcuguuccacuucaaguucaugcuccugaucaacuucauccugugccaccuccuguggggcggggugggcgucaccgggggcguggagaccaacagcuccagcacgcaggccauccccaccccgcccgugaccuccaacagcaccacgcccgggcccuccaccgacaccgccaccgagacggcgagcuccaugaccaccagcaccccggacacgcaggucaccaccgacaacggcuccggcgagcccagcaccgacccccugacgaccaacgaggccacgcccccgcucuccgugaccaccgcccagaccaaggagaccaagaagcacaccacgcuggaccccaacaccagcgccaaccccgacgccaccacccccuccaucacgauccugagcgcguccaacaccagccucccgaccuccagcgugcacgccucccccagccccagcuccagcgaggagcccaccccgcagaacgcccaccaccugucccgcagccugcucuccgccgucagcacggagaccgggcagaccgcguccgccaccacggccaccaaggagaucaccaccaagaacagcccgcccaccgccggcaacgacacgauggugaccuccgcccccaacgggaacacccggaacacccccgagcaggcgaaccccacggcccccgaggccagccugaagauccagaccacccagaaccagcagaccgugacgcccgaggccaccccgaucaccaccgucacggcccugaccgaccucaccaaccgcuccaagcgggacagcaaggugcagaucauccugaccuucucccagggccugaagaaguacuacagcaagauccucaagcugcugcagcucacgcaggaggaggacuccgaggggcugcuggaguggugcacccgcgugcucgagcaggcgugcgacgacgacuacuucaacaagcggaucgaggaguucuucaucaccggcaagggcuacuucaacgacguccugcaguuccgccugcacgacgcccucagcaacaccgagcccgcccagacgaccucccccaccgccgugcccuucaagagcuacuacgccaaggggucccugaccuucgacagcggcuacuucagcgcgcggugcuacccgcgcgccuccaacagcgggcugcagcucaucaacgugacgcagcaccccgucaagaucgccaacacccccggcccgaagcuguccaaccugaagaccaucaacugcaucaaccucaaggugagcaccgacaaggagcacuccgagcuggaggugaacguccugcucccccagguggccgugaaccugagcaacugccacgucuccaucaagagccacgugugcgacuacucccuggacacggacggcgccaucaagcucccccggguggcgcacaacggggucuucauccccggcaccuacaagaucgugaucgacaagaagaacaaccugaacgaccgcugcacccugaccacgaacugcgucaucaaggggcgggaggugcgcaagggccagagcgcccuccggcaguacaagaccgagauccgcaucgggcagaccgugaccggcucccggcgccugcuggccgagggcgggagcuccgacugcaucagccggacgcagcucgucaagaccgagguggccgagauccacgaggacuccuacggcgggccgggcgagaagaucaccaucugcaacgggagcaccaucguggaccagcgccugggcuccgagcugggcugcuacaccaucaaccgggucaagagcuacaagcucugcgagaacagcgcguccggcaagagcugcgagaucgacuccauccccgugaagugcaagcagggguucugccugaagaucacgcaggaggggcgcggccacgugaagcugagccgggggaccgagaucguccuggacgugugcgacuccagcugcgagcucaugauccccaagggcaccggcgacauccugguggacugcuccgggggccagcagcacuuccugcagaacaaccucaucgaccuggggugccccaacgucccgcugcucggcaagauggccaucuacgugugccgcaugagcaaccaccccaagaccacgauggccuuccuguucugguucuccuucggcuacgugaucacgugcaucgucugccgcgugcuguucuaccuccugaucgccaucgggaccgugggcaagaagcugaagcaguaccgggagcucaagccccagaccugcaucgucugcgagagcgugcccgugaacgccaucgacgcggagaugcacgagcugaacugcuccuacaacaucugcccguacugcgccagccgccuguccaccgacgggcucauccggcacgucacccagugccccaagcgccgggagaagguggaggagaccgagcuguuccugaaccucgagcgcauccccuggcuggugcggaagcugcuccaggucagcgaguccaccggcauggcccugaagcgcagcugcuggaugaucacgcugcucauccugcugcucguguccaugagccccgugcaguccgccccggucgggaaggagcgggccaucgagaccuaccaggcgcgcgaggccuacaccggcaucugccuguucgugcugggcagcguccucuucgccgugagcuggcugaccaaggcccugaucgacgggaucggcaacuccuucuuccccgggcucagcgugugcaagacgugcuccaucggcagcaucaacggguucgagaucgagucccacaagugcuacugcagccuguucugcugccccuacugccgggccugcuccagcgacaagaacacccaccgcaugcaccugaacgugugcaagaagcggaagaugggcuccaacgucaugcucgcggugugcaagcgcaugugcuuccgggccaccaucgaggccagcaacaaggcccugcugauccgcuccaucaucaacagcaccuucgugaucugcauccucauccugacgaucugcgucguguccaccagcgcgguggacauggagaaccugcccgccggcaucugggagaaggaggaggaccucaccaacuucugccaccaggagugccaggucaccgagacggagugccugugcccguacgaggccauggugcugcggaagccccucuuccuggacuccaucgccaaggggaugaagucccugcucaacagcaccagccuggagaccucccugagcaucgaggcccccuggggcgcgaucaacgugcagagcaccuucaagcccacggucuccgccgccaacaucgcccucagcugguccagcguggagcaccgcgggaacaagauccugguguccggccggagcgaguccaucaugaagcuggaggagcgcaccggggucagcuggaaccucggcguggaggacgccuccgagagcaagacccugaccguguccgucauggaccugagccagauguacuccccgguguucgaguaccucagcggcgaccgccagguggaggaguggcccaaggcgacgugcaccggggacugccccgagcggugcggcugcaccuccuccacgugccugcacaaggaguggccgcacagccgcaacuggcggugcaaccccaccuggugcuggggcgucgggaccgggugcacgugcugcggccuggacgugaaggacuucuucaccgacuacaugcucgucaaguggaagguggaguacaucaagaccgaggccaucgugugcgucgagcugaccagccaggagcgccagugcucccugaucgaggccggcacccgguucaaccucgggcccgugaccaucacccugagcgagccccgcaacgugcagcagcggcugccgcccgagaucgucacgcuccaccccaagaucgaggagggcuucuucgaccugaugcacgugcagaagauccugagcgccuccaccgugugcaagcuccagagcugcacccacgggguccccggcgacuuccagguguaccacgugggcaaccugcugcgcggggacaaggucaacggccacuccauccacaagaucgagccgcacuucaacaccagcuggauguccugggacgggugcgaccucgacuacuucugcaacaugggcgacuggcccagcugcacguacaccggggugacccagcacaaccgggccgcguucaucaacaugcugaacaucgagaccgacuacacgaagaccuuccacuuccacuccaagcgcgugaccgcccacggcgacacgccccagcuggaccucaaggcccggcccgccuacggcgcgggggaggucaccgugcugguggaggucgccgaccuggagcuccacaccaagaagcuggaggugagcggccugaagaucgccucccugaccugcagcgggugcuacgccugcuccagcggcaucuccugcaaggugcgcauccacgucaacgagccggacgaguucaccgugcacgugcggagcuccgaccccgacgucguggccgcggggagcucccugauggcccgcaagaucgaguucggcgccgacagcacguucaaggccuucuccagcaugcccaaggacagccugugcuucuacaucguggagaaggacuacugcuccagcugcaccgacgacgacacccagaagugcgucaacaccaagcucgaccacccccaguccauccugaucgagcacaagggcacgaucaucgggaagcagaacgacacgugcagcaccaagaccuccugcuggcucaagagcuucaagggcuucuucuacgggcucaagaacaugcuguccggcaucuucgggaacguguuccugggcauccuccuguuccuggccccguucgugcuccugaucuucuucuucuucuucggcuggcggcugcuguucugccucaagugcugcaagaagaccaaggggcugcugaaguacaagcaccucaaggacaaggaggaggcgggcuacaagaagaucaucgagcgccugaacgggaagaagggcaagagccagcuguucgacggcgagcggcucgccaaccgcaagaucgccgagcuguucuccaccaagauccacaucggguga

SEQ ID NO: 11907 - RNA, 5094 nt, Artificial Sequence
  derived and/or modified CDS sequence (opt1) from CCHFV(YL04057)__FJ562094.1__GP
augcuguuccacuucaaguucaugcuccugaucaacuucauccugugccaccuccuguggggcgggggcggggugaccggcggggucgagaccaacagcuccagcacgcaggccauccccaccccgcccgugaccuccaacagcaccacgcccggccccuccaccgacaccgccaccgagacggcgagcuccaugaccaccagcaccccggacacccaggugaccaccgacaacggcuccggggagcccagcaccgacccgcccacgaccaacgagaccaccccgccgcccuccgccacgaccgcccagaccaccgagacgaagaagcacaccacccuggaccccaacaccagcacgaaccccgacgccaucacccccuccaucaccauccucagcgccuccaacaccagccugcccaucuccagcguccacgcgucccccagcccgagcuccagcgaggagcccacgccccagaacgcccaccaccugucccgcagccuccuguccgccgugagcaccgagaccggccagaucgccuccgcgaccacggccgccaaggagaucaccaccaagaacagcccgcccaccgccgggaacgacaccaugaucacguccgcccccaacggcaacacccggaacacccccgagcaggcgaaccccaccgccccggaggccagccccaagauccagacgacccagaaccagcagaccgugauccccgaggccacccccaucacgaccaucaccgcccugaccgaccucacgaaccgcuccaagcgggacagcaagguccagaucauccugaccuucucccaggggcugaagaaguacuacagcaagauccucaagcugcugcagcucacccaggaggaggacuccgagggccugcuggaguggugcacccgcgugcucgagcaggcgugcgacgacgacuacuucaacaagcggaucgaggaguucuucaucacgggcaagggguacuucaacgacgugcugcaguuccgccugcacgacgcccucagcaacaccgagccggcccagaccaccucccccacggccguccccuucaagagcuacuacgccaagggcucccugaccuucgacagcggguacuucagcgcgcggugcuacccgcgcgccuccaacagcggccugcagcucaucaacgugacccagcaccccgugaagaucgccaacacccccggccccaagcuguccaaccugaagacgaucaacugcaucaaccucaaggucagcaccgacaaggagcacuccgagcuggaggugaacgugcugcucccgcaggucgccgugaaccugagcaacugccacguguccaucaagagccacgucugcgacuacucccuggacaccgacggggccaucaagcucccccggaucgcgcacaacggcguguucauccccgggaccuacaagaucgugaucgacaagaagaacaaccugaacgaccgcugcacgcugaccaccaacugcgucaucaagggccgggaggugcgcaaggggcagagcgcccuccggcaguacaagaccgagauccgcaucggccagacguucaccggcucccggcgccugcuggccgagggcgggagcuccgacugcaucagccggacccagcucgugaagaccgaggucgccgagauccacgaggacuccuacgggggccccggggagaagaucacgaucugcaacggcagcaccaucguggaccagcgccugggccgggagcuggggugcuacaccaucaaccgcguccgguccuacaagcucugcgagaacagcgcgagcggcaaguccugcgagaucgacagcaucccggugaagugcaagcagggguucugccugaagaucacccaggagggccgcgggcacgugaagcugucccgcggcaccgagaucguccucgacgugugcgacagcuccugcgagcugaugauccccaagggcacgggggacauccugguggacugcagcggcgggcagcagcacuuccugcagaacaaccucaucgaccugggcugccccaacgucccccugcucggcaagauggccaucuacgugugccggauguccaaccacccgaagaccaccauggccuuccuguucugguucagcuucggguacgugaucacgugcaucgccugccgcguccuguucuaccuccugaucgccaucggcacgguggggaagaagcugaagcaguaccgggagcucaagccccagaccugcaucgugugcgaguccguccccgugaacgcgaucgacgccgagaugcacgagcugaacugcagcuacaacaucugccccuacugcgccucccgccugagcaccgacggccucauccggcacgugacccagugcccgaagcgccgggagaaggucgaggagacggagcuguuccugaaccucgagcgcauccccuggcuggugcggaagcugcuccagguguccgagagcaccgggauggcccugaagcgcuccugcuggaugaucacccugcucauccugcugcucgucagcaucucccccgugcagagcgcccccgugggcaaggagcgggcgaucgagaccuaccaggcccgcgagacguacaccggcaucugccuguucguccugggguccguccucuucgccgugagcuggcugaccaaggcccugaucgacggcaucgggaacagcuucuucccgggccucuccgugugcaagaccugcagcaucggguccaucaacggcuucgagaucgagagccacaagugcuacugcucccuguucugcugccccuacugccgggccugcagcuccgacaagaacacgcaccgcaugcaccugaacgugugcaagaagcggaagaugggcagcaacgugaugcucgcggucugcaagcgcaugugcuuccgggccaccaucgaggccuccaacaaggcccugcugauccgcagcaucaucaacuccaccuucgugaucugcauccucauccugaccaucugcguggucagcacguccgcgguggacauggagaaccugcccgccgggaucugggagaaggaggaggaccucaccaacuucugccaccaggagugccaggugaccgagaccgagugccugugccccuacgaggccaugguccugcggaagccccucuuccuggacagcaucgccaagggcaagaagucccugcucaacagcacgucccuggagaccagccuguccaucgaggcccccuggggcgcgaucaacgugcagagcaccuucaagcccaccgugagcgccgccaacaucgcccucuccuggagcuccgucgagcaccgcgggaacaagauccuggugagcgggcgcuccgagagcaucaugaagcuggaggagcggacgggcguguccuggaaccucggcgucgaggacgccagcgaguccaagacccugaccgugagcgugauggaccugucccagauguacagcccggucuucgaguaccucuccggggaccgccagguggaggaguggcccaaggcgaccugcacgggcgacugccccgagcggugcgggugcaccagcuccacgugccugcacaaggaguggccccacagccgcaacuggcggugcuccccgaccuggugcuggggcguggggaccggcugcacgugcugcggccuggacgucaaggacuucuucaccgacuacaugcucgugaaguggaagguggaguacaucaagaccgaggccaucgucugcguggagcugaccagccaggagcgccagugcucccugaucgaggccgggacccgguucaaccucggccccgugaccaucacccugagcgagccccgcaacguccagcagcggcugcccccggagaucgugacccuccaccccaagaucgaggagggguucuucgaccugaugcacguccagaagauccugagcgccuccacggugugcaagcuccagagcugcacccacggcgugcccggcgacuuccaggucuaccacguggggaaccugcugcgcggcgacaaggugaacgggcacuccauccacaagaucgagccccacuucaacaccagcuggauguccugggacggcugcgaccucgacuacuucugcaacaugggggacuggccgagcugcaccuacacgggcgucacccagcacaaccgggccgcguucaucaacaugcugaacaucgagaccgacuacaccaagacguuccacuuccacuccaagcgcgugaccgcccacggcgacacgccccagcuggaccucaaggcccggcccgccuacggggcgggcgaggugaccguccugguggagguggccgaccuggagcuccacaccaagaagcuggaggucagcgggcugaagaucgccucccugaccugcagcggcugcuacgccugcuccagcgggaucuccugcaaggugcgcauccacgugaacgagcccgacgaguucaccguccacgugcggagcuccgacccggacguggucgccgcgggcagcucccugauggcccgcaagaucgaguucggcgccgacagcaccuucaaggccuucuccagcaugcccaaggacagccugugcuucuacaucguggagaaggacuacugcuccagcugcacggacgacgacacccagaagugcgugaacaccaagcucgaccacccccaguccauccugaucgagcacaaggggaccaucaucggcaagcagaacgacacgugcagcaccaagaccuccugcuggcuggagagcgucaagggguucuucuacggccucaagaacaugcuguccgggaucuucggcaacguguuccugggcauccuccuguuccuggcccccuucgugcuccugaucuucuucuucuucuucggguggcggcuccucuucugccugaagugcugccgccggacccgcggccugcugaaguacaagcaccucaaggacgaggaggaggcgggguacaagaagaucaucgagcggcugaacggcaagaagggcaagagccagcuguucgacggggagcgccucgccgaccgcaagaucgccgagcuguucuccacgaagauccacaucggcuga

SEQ ID NO: 11908 - RNA, 5094 nt, Artificial Sequence
  derived and/or modified CDS sequence (opt1) from CCHFV(79121M18)__GU477493.1__GP
augcuguuccacuucaaguucaugcuccugaucaacuucauccugugccaccuccuguggggcgggggcggggugaccggcggggucgagaccaacagcuccagcacgcaggccauccagacccccccggugaccuccaacagcaccacgcccggccccuccaccgacaccgccaccgagacggcgagcuccaugaccaccagcacccccgacacgcaggugaccaccgacaacggcuccggggagccgagcaccgacccccugacgaccaacgaggccacccccccccucuccgucaccacggcccagaccaccgagaccaagaagcacacgacccuggacccgagcaccuccaccaaccccgacgccacgacccccagcaucaccauccuguccgccagcaacaccucccuccccaucagcuccgugcacgcgagcccgagccccuccagcuccgaggagcccacgccccagaacgcccaccaccugagccgcucccugcucagcgccguguccaccgagaccggccagaucgccagcgcggccaccgccgccaaggagaucacgaccaagaacuccccgcccaccgccgggaacgacaccauggucaccagcgcgcccaacggcaacauccggaacacgcccgagcaggccaacccgaccgcccccgaggccucccccaagauccagaccacccagaaccagcagacggugacccccgaggccaccccgaucaccacgaucaccgcgcugaccgaccugaccaaccgcagcaagcgggacuccaaggugcagaagauccucacguucagccaggggcugaagaaguacuacuccaagauccugaagcuccugcagcugacccaggaggaggacagcgagggccuccuggaguggugcacccgcguccuggagcaggccugcgacgacgacuacuucaacaagcggaucgaggaguucuucaucaccggcaagggguacuucaacgacgugcuccaguuccgccugcacgacgcccuguccaacacggagcccgcccagaccaccagccccaccgccgugcccuucaaguccuacuacgcgaagggcagccucacguucgacagcggguacuucuccgcccggugcuacccgcgcgccagcaacuccggccugcagcugaucaacgucacccagcaccccgugaagaucgccaacacccccggcccgaagcucagcaaccugaagaccaucaacugcaucaaccugaagguguccacggacaaggagcacagcgagcucgaggucaacgugcugcugccccagguggccgucaaccucuccaacugccacgugagcaucaagucccacgugugcgacuacagccuggacaccgacggggcgaucaagcugccccgggucgcccacaacggcguguucauccccgggaccuacaagaucgugaucgacaagaagaacaaccucaacgaccgcugcacccugaucacgaacugcgucaucaagggccgggaggugcgcaaggggcaguccgcccugcggcaguacaagaccgagauccgcaucggccagaccuucaccggcagccggcgccuccuggccgaggggggcuccagcgacugcaucucccggacgcagcuggucaagaccgagguggcggagauccacgaggacagcuacgggggcccgggggagaagaucaccaucugcaacggcuccaccaucguggaccagggccucgggagcgagcugggcugcuacacgaucaaccgcguccggagcuacaagcugugcgagaacuccgccagcgggaaguccugcgagaucgacagcauccccgugaagugcaagcagggcuucugccucaagaucacccaggaggggcgcggccacgugaagcugucccggggcaccgagaucguccuggacgugugcgacagcuccugcgagcugaugauccccaaggggaccggcgacauccucguggacugcagcgggggccagcagcacuuccugcagaacaaccugaucgaccucggcugccccaacgucccgcugcuggggaagauggccaucuacgugugccgcauguccaaccaccccaagaccacgauggccuuccucuucugguucagcuucggcuacgugaucaccugcaucgccugccgcguccuguucuaccugcucaucgcgaucgggaccgugggcaagaagcugaagcaguaccgggagcugaagccccagaccugcaucgugugcgaguccguccccgugaacgccaucgacgccgagaugcacgagcucaacugcagcuacaacaucugcccguacugcgccucccgccugagcacggacgggcugauccggcacgugacccagugccccaagcgccgggagaaggucgaggagaccgagcucuuccugaaccuggagcgcauccccuggcucgugcggaagcugcugcagguguccgagagcaccggcauggcccucaagcgcuccugcuggaugaucacgcugcugauccuccugcuggucagcaucucccccgugcagagcgcgccggugggcaaggagcgggccaucgagaccuaccaggcccgcgagaccuacaccgggaucugccucuucguccugggcagcgugcuguucgccguguccuggcucacgaaggcccugaucgacgggaucggcaacagcuucucccccgggcugagcgucugcaagaccugcuccaucggcagcaucaacggcuucgagaucgagucccacaagugcuacugcagccucuucugcugccccuacugccgggcgugcuccagcgacaagaacacccaccgcaugcaccugaacgugugcaagaagcggaagaugggguccaacgugaugcuggccgucugcaagcgcaugugcuuccgggccaccaucgaggccagcaacaaggcgcuccugauccgcuccaucaucaacagcacguucgugaucugcauccugauccucaccaucugcguggucuccaccagcgccguggacauggagaaccugcccgccggcaucugggagaaggaggaggaccugaccaacuucugccaccaggagugccaggugacggagaccgagugccucugcccguacgaggccaugguccugcggaagccccuguuccucgacuccaccgccaaggggaugaagagccugcugaacuccaccagccucgagacgagccuguccaucgaggcgcccuggggcgccaucaacgugcagagcaccuucaagcccaccguguccgccgccaacaucgcccugagcugguccagcgucgagcaccgcgggaacaagauccucguguccggccggagcgaguccaucaugaagcuggaggagcgcaccggcgugagcuggaaccugggggucgaggacgcguccgagagcaagacgcucaccguguccgugauggaccugagccagauguacuccccggucuucgaguaccugagcggcgaccgccagguggaggaguggcccaaggccaccugcaccggggacugccccgagcggugcggcugcacguccagcaccugccuccacaaggaguggccgcacucccgcaacuggcggugcaaccccaccuggugcuggggggugggcaccggcugcacgugcugcgggcuggacgucaaggacuucuucaccgacuacaugcuggugaaguggaagguggaguacaucaagaccgaggccaucgucugcguggagcucaccagccaggagcgccagugcagccugaucgaggccggcacccgguucaaccuggggcccgucacgaucacccucuccgagccccgcaacgugcagcagcggcugccgcccgagaucgugacccugcaccccaagaucgaggagggcuucuucgaccucaugcacguccagaagauccugagcgccuccaccgugugcaagcugcagagcugcacgcacggcgugcccggggacuuccagaucuaccacgucggcaaccuccugcgcggggacaaggugaacggccacuccauccacaagaucgagccgcacuucaacaccagcuggauguccugggacgggugcgaccuggacuacuucugcaacaugggcgacuggcccagcugcaccuacaccggcgugacgcagcacaaccgggcggccuucaucaacaugcucaacaucgagaccgacuacaccaagaccuuccacuuccacuccaagcgcgucacggcccacggggacaccccccagcuggaccugaaggcccggcccgcguacggcgccggggaggugaccgugcucgucgagguggccgaccuggagcugcacaccaagaagcucgaggugagcggccugaagaucgccucccugacgugcagcgggugcuacgccugcuccagcggcaucuccugcaagguccgcauccacgugaacgagccggacgaguucaccgugcacguccggagcuccgaccccgacgugguggcggccggcagcucccucauggcccgcaagaucgaguucggggccgacagcaccuucaaggccuucagcuccaugcccaaggacagccugugcuucuacaucgucgagaaggacuacugcuccagcugcaccgacgacgacacgcagaagugcgugaacaccaagcuggaccacccccaguccauccucaucgagcacaagggcaccaucaucgggaagcagaacgacaccugcagcacgaagaccuccugcuggcuggagagcgugaagggcuucuucuacgggcugaagaacaugcucuccggcaucuucggcaacgucuuccuggggaucuuccuguuccucgcgccguucgugcugcugaucuucuucuucuucuucggcuggcggcuccuguucugccugaagugcugccgccggacccgcgggcugcucaaguacaagcaccugaaggacgaggaggaggccggcuacaagaagaucaucgagcggcugaacggcaagaaggggaagagccagcucuucgacggcgagcgccuggccgaccggaagaucgccgagcuguucuccaccaagauccacaucggguga

SEQ ID NO: 11909 - RNA, 5088 nt, Artificial Sequence
  derived and/or modified CDS sequence (opt1) from CCHFV(ArD39554)__DQ211628.1__GP
augcugugccacaucaagcacauccuccuguucugcaucauccuguaccaccagcaguggaacaccggcgccagcaacaccacgaucucccccaccaccaacaagagccacaccgacaucucccaccagccgacgagcaucaccgccgcguccagccccgggucccccgccaccaccgcgcccccggagcgcagcgugacgcccucccacacccccaccaccagcgucuccgaggccggcagcggggagcccccggccgccacgcccgccuccgccaccgcccagagccccgagcccgcguccgccgcccagccgagccccaccauccccaagcccaccacgccggaccccaccuccgaggcccucagcacccccgccaccucccggccccaggagccgagcacgcaccccagcccccgcuccagccccuccaagccgguggagacccagagcacccggcacaccgcgcgcgagcugcuguccgugacgggcaccgaggccgagcagcucaucacccagaccauccacacgaccaaggaggccaccaaggccaccagcccccagcccacggccuccaaccccgacccgacccuggcgaccaccagccgguccaucaacagcaucaaccccaaggggcccgaguccacgcgcgccaccccgcagagcaccucccccacccccgagagcuccaccauccagacgcagauccugcccaucaucaccaccccgggcacccucgaggccaucauccaccccacgaaccggagcaagcgcaaccugggcaccgagaucauccugacccucccccaggggcugaagaaguacuacuccaagguccugaagcucaugcaccugacccgggaggaggacagcgagggccugcucgaguggugcacgcgcauccuggggcagaccugcgacgacgacuacuuccagaagcggaucaccgaguucuucaucaccggcgugggguacuucaacgaggugcugcuguucaaggagacgaccgacgcccccacccuggccccgacccacaagggcgcgccgcccacggagcccuucaaguccuacuacgccaagggcuucaucaccauggacagcggguacuucagcgccaagugcuacucccgcgccagcaacuccggccugcagcucaucaacgucaccaugcacagcuccaagaugcccaucacccccgggcccaaguacagcaaccugaagaacaucaacugcaucaaccugaagguguccacggacaaggagcacaacgagguggagaucaacguccuccugccccagguggccgugaaccugagcuccugccacguccucgugcggagccacgugugcgacuacucccuggacgcggacggcaugaucaagcugccgcagaucacccacgagggcaccuucauccccgggaccuacaagaucaucaucgacaagaagaacaagcagaacgaccgcugcacgcucaucaccaacugcgucaucaagggccgggaggugcgcaaggggcagagcgcccugcggcaguacaagaccgagauccgcgugggccaggccuccagcgggacccggcgccugcucuccgagagcaacaacaacgacugcgucucccggacgcagcugaucaagaccgagaacgccgagauccacggcgacgacuacggcgggcccggcgagaagaucaccaucugcaacgggagcaccaucguggagcagcgccugggcagcgagcucgggugcuacacgaucaaccgcaucaaguccuucaagcugugcgagaacagcgcguccggcaagggcugcgagaucgacagcacccccgugaagugcaagcagggguucugccugaagaucacccaggagggccgggggcacgucaagcucucccgcggcagcgagaucauccuggacgugugcgacuccagcugcgagaugaugaucccgaagggguccggcgacauccugguggacugcagcggcgggcagcagcacuuccuccaggacaaccuggucgaccugggcugccccaacgugccccuccuggggaagauggccaucuacaucugccggauguccaaccaccccaagaccacgauggccuuccuguucugguucagcuucggcuacgucaucacgugcaucuucugcaaggugaucuucuacgugcugaucaucaucggcacccucgggaagcgcaucaagcaguaccgggagcugaagccgcagaccugcaccaucugcgaggccacccccgucaacgccaucgacgcggagaugcacgaccugaacugcuccuacaacaucugccccuacugcgccagccgccucaccuccgagggccuggugcggcacgugacccagugcccgaagcgcaaggagaagaucgaggagaccgagcuguaccucaaccuggagcggauccccugguucguccgcaagcugcuccaggugagcgaguccacggggguggcccugaagcggagcuccuggcuggucacccuccuggugcugcucaccgugagccugagccccguccaguccgcccccaucggccaggagcgcaccguggugacguaccagguccgggagagcuacaccgggaugugccuguucauccucggcuccgugcuguucgccaucagcuggcugaccaagggccucguggacuccgucgggaacaucuucuucccgggccugagcgugugcaagaccugcuccaucgggagcaucaacggcuucgagaucgagucccacaagugcuacugcagccuguucugcugccccuacugccgcuacugcuccgcggaccgcggggcccaccagagccaccucuccgugugcaagaagcggaagacgggcagcaacgucaugcuggccgugugcaagcggaugugcuuccgcgccacccugaagguguccagcgaggcccucaucauccgguccaucaucaacaccaccuucgucgugugcauccugauccugguggucugcguggugagcacguccgcggucgagauggagaaccuccccgccggcaccugggagaaggaggaggaccugaccaacuucugccaccaggagugccaggugaccgagacggagugccugugccccuacgaggccuucgugcuccgcaagccgcuguuccuggacagcaccgccaagagcaugaagucccuccugaacagcaccucccuggagaccagccucuccaucgaggcgcccuggggcgccaucaacguccagagcacguucaagcccaccgccuccaccgccaacaucgcccugagcugguccagcguggagcaccgcgggaacaagauccuggugaccgggcgguccgagagcaucaugaagcucgaggagcgcacgggcaucuccuggaaccugggggucgaggacgcgagcgaguccaagacccugaccgugagcgugauggaccucucccagauguacagcaccgucuucgaguaccuguccggcgaccgccagguggaggaguggcccaaggccacgugcaccggcgacugcccggagcggugcgggugcaccagcagcacgugccugcacaaggccuggccccacucccggaacuggcgcugcaaccccaccuggugcuggggcguggggaccggcugcacgugcugcgggcucgacgucaagaaccuguucaccgacuacaugcugaucaaguggaagguggaguucaucaagaccgaggccaucgugugcgucgagcucaccagccaggagcggcagugcucccugaucgaggccggcacccgcuucaaccugggccccgugaccaucacccucagcgagccgcggaacauccagcagaagcugccgcccgagcuggugacgcuccacccccgcgucgaggagggguucuucgaccugaugcacgugcagaaggugcuguccgcgagcaccgucugcaagcuccaguccugcacccacggcgugcccggggaccugcaggucuaccacgugggcaaccugcucaagggcgacaagaucaacgggaacagcuuccacaagaucgagcccaaccugaacaccuccuggaugagcugggacggcugcgaccuggacuacuacugcaacaugggggacuggcccuccugcacguacaccggcgugacccagcacaaccacgccgccuucgucaaccuccugaacaucgagaccgacuacacgaagaacuuccacuuccacagcaagcgggugaccgcccacggggagacgccccagcuggaccucaaggcccgcccgaaguacggcgcgggcgaggugaccguccugguggagguggccgacauggagcugcacaccaagaagaucgagaucuccgggcucaaguucgccagccugaccugcaccggcugcuacgccugcuccagcgggaucuccugcaagguccggcugcacguggacgagcccgacgagcucaccgugcacgucaagagcgacgaccccgacgugguggcggccuccagcagccugauggcccgcaagaucgaguucggcacggacuccaccuucaaggccuucagcuccaugcccaaggacaagcugugcuucuacaucgucgagcgggacuacugcagcuccugcagcaaggaggacacccagaagugcgugaacgccaagcucgagcagccgcaguccauccugaucgagcacaaggggaccaucaucggcaagcagaacgacacgugcaccgugaaggcgagcugcuggcuggaguccgucaagagcuucuucuacggccucaagaacaugcucgggggcaucuucgggaacgugauccugggcaucaucauguuccucgcccccuucgcccugcugcuccuguucuuccuguucggguggcgcauccucuucugccugcggugcugccgccggacccgcggccuguucaaguacaagcacaucaaggacgacgaggaguccggcuacaagcggaucaucgagcgccucaacaacaagaaggggaagaacaagcuguucgacggcgagcgccuggccgacaagaagaucgccgagcuguucagcaccaagacgcacaucggguga
